United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 35

SEQ ID NO: 202245 - protein, 67 aa, Triticum aestivum
  unsure (1)..(67): unsure at all Xaa locations
  Clone ID: PAT_TA_96663.pep
TDGRPASQLIGFQSVHLKAEEAAHVEFEVSPCKHLSRAAEDGRKVIDQGSHFLKVGDDEXFELSFMA

SEQ ID NO: 202246 - protein, 100 aa, Triticum aestivum
  unsure (1)..(100): unsure at all Xaa locations
  Clone ID: PAT_TA_96664.pep
RTLADYNIQKESTLHLVLRLRGGMQIFVKTLTGKTITLEVESSDTIDNVKAKIQDKEGIPPDQQRLIFAGKQLEDGRTLADYXIQXESTLHLVLRLRGXQ

SEQ ID NO: 202247 - protein, 89 aa, Triticum aestivum
  unsure (1)..(89): unsure at all Xaa locations
  Clone ID: PAT_TA_96665.pep
SKADDARRRCGRETPXEALPXERXPLQXPARAPAXAPXMIGRALPPERPLPEPPPPRPPPPPPPWPPPPPPPWPPPPPPPRQCAPWRCA

SEQ ID NO: 202248 - protein, 138 aa, Triticum aestivum
  Clone ID: PAT_TA_96666.pep
MSPLYCHGKPRPLLLLLLLAVTLTLLAAAATAEDVSSGTAPFYPSAEAAAAAHCEGTLYPELCLSTLADIPDLHKKPLPDVICAAVNRTETEVTTMSANCSAYLHGRSLKSRDHLAVMDCMELLDTTMGRSWWPRADL

SEQ ID NO: 202249 - protein, 59 aa, Triticum aestivum
  unsure (1)..(59): unsure at all Xaa locations
  Clone ID: PAT_TA_96667.pep
RRXAAAPSSXLFGELSIAXLDKPVTETKIWMXQIKERNTSVVAXNXPALCGVMEPCKVK

SEQ ID NO: 202250 - protein, 147 aa, Triticum aestivum
  unsure (1)..(147): unsure at all Xaa locations
  Clone ID: PAT_TA_96668.pep
XXWRXDXRXXERIRRHTWSSREEXXRXCARESGWWSXXVXRGGGRGRREWMAAAGGWGCGWGDADLGSGGQEPLEGGEVWGVDAGGXPWCEGRRRQRLCFSRAVWALEGGSKGGGGGAVVEGGDTARGGEDRAAPAALPPVDWAPRP

SEQ ID NO: 202251 - protein, 107 aa, Triticum aestivum
  unsure (1)..(107): unsure at all Xaa locations
  Clone ID: PAT_TA_96669.pep
ILVPLQSFRSPADSIKTPARSTPHSHSQGDTPSCRASHDAVPWQEICALRRGRGRGHRGXGGXGXGRARXXEDXHRSTARTPSCPAXFAAXWPXGXPSXLAXPVSGR

SEQ ID NO: 202252 - protein, 143 aa, Triticum aestivum
  unsure (1)..(143): unsure at all Xaa locations
  Clone ID: PAT_TA_96670.pep
EQREXVPRPAYSXQAHRAVTGFGVILLLDLPASGGIVRLLLLLHDDHPHGDPLERALGRLPRRRRAFGVEPGGLFLAGGAEAGVEHAEGDVGDGGDEERGGGDAQHPLQVRLLRLHGRVSRRRGGRRRRDQQAARGPAPAAWL

SEQ ID NO: 202253 - protein, 112 aa, Triticum aestivum
  unsure (1)..(112): unsure at all Xaa locations
  Clone ID: PAT_TA_96671.pep
MKFFSAFDPWPVFFRREWGRTWPFLAGFAVTGTLITKMTAGFTXEDLKNSKFVQAHXXXVVARPPGVRRVTGGKQAVTGDGVPMPGEKSPTRQLGDWLSVFVGSLVIFGGFL

SEQ ID NO: 202254 - protein, 72 aa, Triticum aestivum
  unsure (1)..(72): unsure at all Xaa locations
  Clone ID: PAT_TA_96672.pep
MVRGLKXHLKRLNAPSHWMLDKLGGAFAPKXSSGPHKAXECLPLILXLXNXXKYALTYRXXHSILMXXHIMD

SEQ ID NO: 202255 - protein, 143 aa, Triticum aestivum
  unsure (1)..(143): unsure at all Xaa locations
  Clone ID: PAT_TA_96673.pep
HRSPIKEIKREYLCKVLPFRLVDDERDCLSLTKRYPRLSVIPDFSKIVLNWAKESLNLSLHTXVSLEHAICEDDDKADESALVSSENTSSIKTPETIWNAKVLLMXSGMSNGAFADITSMRSTDERVVHLNNILKFAVFKKDS

SEQ ID NO: 202256 - protein, 116 aa, Triticum aestivum
  unsure (1)..(116): unsure at all Xaa locations
  Clone ID: PAT_TA_96674.pep
MLLVSQAANGSLSARRLPSKPLASRRGANPYPLFAGPRVARRRLVLSGAADARDAPRRASASPPAHAGAGEGPSGSPAAAEDPVLXGVSDDRVALEGRHPSRESPGKAERPVQRLV

SEQ ID NO: 202257 - protein, 135 aa, Triticum aestivum
  unsure (1)..(135): unsure at all Xaa locations
  Clone ID: PAT_TA_96675.pep
MARTKQTARKSTGGKAPRKQLATKAARKSAPATGGVKKPHRFRPGTVALREIRXYXKSTELLIRKLPFXRLVREIAQDFKTDLRFQSSAVSALQEAAEAYLVGLFEDTNLXANPRQSASPTCPKDIQARGRILGE

SEQ ID NO: 202258 - protein, 54 aa, Triticum aestivum
  unsure (1)..(54): unsure at all Xaa locations
  Clone ID: PAT_TA_96676.pep
XDLRTCPINGIENDRSYGLERYAWPSLAAARVRSCGTTSLSVYKGVGVPLRSSI

SEQ ID NO: 202259 - protein, 85 aa, Triticum aestivum
  unsure (1)..(85): unsure at all Xaa locations
  Clone ID: PAT_TA_96677.pep
MSTAEATREENVYMAKLAEQAERYEEMVEFMEKVAKTADVGELTVEERNLLSVAYXNVIGARRASWRXIISSIEQXGGRAGGNRG

SEQ ID NO: 202260 - protein, 140 aa, Triticum aestivum
  unsure (1)..(140): unsure at all Xaa locations
  Clone ID: PAT_TA_96678.pep
MASTFSGDETAPFFGFLGAAAALVFSCMGAAYGTAKSGVGVASMGVMRPELVMKSIVPVVMAGVLGIYGLIIAVIISNGINPKAKPYFLFXTGNAQLSSGLACGLRGASPPGMXAIGIVGDARRQGATQNKPKACSVRND

SEQ ID NO: 202261 - protein, 108 aa, Triticum aestivum
  unsure (1)..(108): unsure at all Xaa locations
  Clone ID: PAT_TA_96679.pep
RPQRPAXSGRGKGGKGLGKGGAKRHRKVLRDNIQGITKPAIRRLARRGGVNRISGLIYEETXRGVLKIFLQNVIRDAVXYTXHAXRXTVTGHVSSRSDRTLLRGSGEI

SEQ ID NO: 202262 - protein, 61 aa, Triticum aestivum
  unsure (1)..(61): unsure at all Xaa locations
  Clone ID: PAT_TA_96680.pep
MXSPKLLXLLATLLPSYGLXLADLAPMTLTVVNNCAYPIWVGXIKGSXGSEVLEGGGFFSP

SEQ ID NO: 202263 - protein, 130 aa, Triticum aestivum
  unsure (1)..(130): unsure at all Xaa locations
  Clone ID: PAT_TA_96681.pep
FPSLLRASSPPASSPPPLPSXRPPPCPAAGVATAARPDTHPRPHAAHLERWGPRATRPAXPSPPSPATAPPSPPSSRKXPSPSSXXPPXHXAXPAPPSARLSSPGIRALPLLRVSVANRLFGPHIRFSPI

SEQ ID NO: 202264 - protein, 112 aa, Triticum aestivum
  unsure (1)..(112): unsure at all Xaa locations
  Clone ID: PAT_TA_96682.pep
MASVLVVEVKSPXXKLXTAXRXSXXLFPXIFPXQVQXHPKTVEGDGKSAGTVRLIKYTEGVPMVTFXNXNVXVADXENNVVXXNXVDGDLVKLLHNFKVXVQNRAPDRRRCG

SEQ ID NO: 202265 - protein, 143 aa, Triticum aestivum
  unsure (1)..(143): unsure at all Xaa locations
  Clone ID: PAT_TA_96683.pep
SVLTASSQSLASFPRRHPPRKGGCLAAAATAGAAPAASAATAAAGARCSPTWRPPPAPPPWSCPPPPTRGXAPAGSRRPGRPAAATAPPAKCGQRGAAAPAASLQLKPGPKEGRAGKRSEGLEGSGKQSTNRKQNQIITKPGL

SEQ ID NO: 202266 - protein, 102 aa, Triticum aestivum
  unsure (1)..(102): unsure at all Xaa locations
  Clone ID: PAT_TA_96684.pep
CKFVLLEPSNYEQWSGEAGRSCTMPFPAILTMNKCNCYPLNQPATCGTTAPDMRYYRMRGRGKTSPDAMKQRAVEPPERYYRSPLRYYRKXRFCLRLGRDGH

SEQ ID NO: 202267 - protein, 135 aa, Triticum aestivum
  unsure (1)..(135): unsure at all Xaa locations
  Clone ID: PAT_TA_96685.pep
PCNKPSGLQLIQPRGHAVEARRWRVRREGRGAVXVARSLRRSARDDLFFAQWVDGSSDARLHARSWISGRACRWRRRRRLSPLCTSMPSRRPEELGSVYPWLSAPGAKNQESTSTRSPPRYHKTSTSFSAVAPRS

SEQ ID NO: 202268 - protein, 94 aa, Triticum aestivum
  unsure (1)..(94): unsure at all Xaa locations
  Clone ID: PAT_TA_96686.pep
MGISRDSMHKRRATGGKQKAWRKKRKYELGRQPANTKLSSNKTVRRVRVRGGNVKWRALRLDTGNFSWGSEXAVTRKDPSPGMVXYNSSNNGAW

SEQ ID NO: 202269 - protein, 91 aa, Triticum aestivum
  unsure (1)..(91): unsure at all Xaa locations
  Clone ID: PAT_TA_96687.pep
SHQHIIILRNHKLGIYPPKIGVITKLLYCCCCWCAINLAGTVDEXFSEIWPAQVIYFTAEFPXWELVPIFITRGSRYMAYFXXSGWLPLVX

SEQ ID NO: 202270 - protein, 76 aa, Triticum aestivum
  unsure (1)..(76): unsure at all Xaa locations
  Clone ID: PAT_TA_96688.pep
MRECISIHIGQAGIQVGNACWELYCLEHGIQPDGQXMPGDKTVGGGDDAFNTFFXETGAGKXVPRAVFXRXRAHCD

SEQ ID NO: 202271 - protein, 128 aa, Triticum aestivum
  unsure (1)..(128): unsure at all Xaa locations
  Clone ID: PAT_TA_96689.pep
MAAAFSSTVGAPASTPTNFLGKKLKKQVTSAVNYHGKSSKANRFTVMAAENIDEKEGTQTKWKGLAYDISGRTSKDIXQEGKXIVGSLFXGGQGAKXNQXRPSSNSXXVTLSXGTQRXYDFDKNNGEF

SEQ ID NO: 202272 - protein, 129 aa, Triticum aestivum
  unsure (1)..(129): unsure at all Xaa locations
  Clone ID: PAT_TA_96690.pep
EKGVGKSGKPLHYKGSSFHRVIPDFMCQGGDFTKGNGTGGESIYGEKFADEKFVHKHTKPGILSMANAGPNTNXSQFFICTXVPCNWXDGKHVVFGXVVEGXDLVKNIEKVGLPQXGTWSKASPSAWKL

SEQ ID NO: 202273 - protein, 81 aa, Triticum aestivum
  unsure (1)..(81): unsure at all Xaa locations
  Clone ID: PAT_TA_96691.pep
XAGXMPTSLXGRXWVPGPPPFXXVNKNTKGRYXSXPKSTYTXXHTHRTCSXTRSPTIHHQLDRSMTQIASPSSSVGXSWMN

SEQ ID NO: 202274 - protein, 120 aa, Triticum aestivum
  unsure (1)..(120): unsure at all Xaa locations
  Clone ID: PAT_TA_96692.pep
MGAYKFVSELWRRKQSDVMRFVQRVRCWEXRQQPAIVRITRXTRPDRARRLGFKAKQGYVVYRXXVXRRXXRKRPVPXGIVXGXPKXTSGITQLKFQKEXXGLLXEXIEXGRRALPFVTP

SEQ ID NO: 202275 - protein, 100 aa, Triticum aestivum; identical to SEQ ID NO: 160859
  Clone ID: PAT_TA_96693.pep

SEQ ID NO: 202276 - protein, 104 aa, Triticum aestivum
  unsure (1)..(104): unsure at all Xaa locations
  Clone ID: PAT_TA_96694.pep
FQSTIHHRQERSHLPLRPERCHIRSPSIPMXRTKQTARKSTGGKAPRKQLATKAARKSAPATGGVKKPHRFRPGTVXLREDPQGXRMSTELLIRKLPFQAPGGD

SEQ ID NO: 202277 - protein, 130 aa, Triticum aestivum
  unsure (1)..(130): unsure at all Xaa locations
  Clone ID: PAT_TA_96695.pep
EWXIKMMHFLFFIGMCLVVEEGVALSFVLLISTTPSNALRNVSWNFSIQLLRHFGKHISVSSSSIHHFPXPFQDGGSMTLIDRFVFNHSXSINFLSMQHDCLLRXMISTQDASMLYAIGSNVVNPRGLXV

SEQ ID NO: 202278 - protein, 69 aa, Triticum aestivum
  unsure (1)..(69): unsure at all Xaa locations
  Clone ID: PAT_TA_96696.pep
AAXSEXAVRRQQWAXVXWXLDXEVHLXQXPPXPRRRLLXSFXIRIVXXQPLXXMLSLRXLTVRADGEPG

SEQ ID NO: 202279 - protein, 61 aa, Triticum aestivum
  unsure (1)..(61): unsure at all Xaa locations
  Clone ID: PAT_TA_96697.pep
IKGEWXPSSCVRVXVRIXXNWHFLAFDXSKGCHWINTLXHDCRXACIFSSKSXEXGIVVSL

SEQ ID NO: 202280 - protein, 114 aa, Triticum aestivum
  unsure (1)..(114): unsure at all Xaa locations
  Clone ID: PAT_TA_96698.pep
SSVLTASSQSLSSFPRRHPPRKGGCLAAAATAGAAPAAXAAXAAAGAXCSPTWXPPPAPPPWSCPPPPTGXAPAGSIRPXXPXAAIAPPASAXPXXXALAAXAIEPXPHGAAIH

SEQ ID NO: 202281 - protein, 80 aa, Triticum aestivum; identical to SEQ ID NO: 106963
  Clone ID: PAT_TA_96699.pep

SEQ ID NO: 202282 - protein, 118 aa, Triticum aestivum
  unsure (1)..(118): unsure at all Xaa locations
  Clone ID: PAT_TA_96700.pep
DCAXQPXEXXIXXGSXLXWPKTPGXPDXSCRYRHRRRXEIXWXRTGSLLAIXXTTRHGXXXPRXPAXAPAAXXRRXRGLEGGSXRGXXXEAVXGXRWRXAEVVGXGDGHGWLSRAKLV

SEQ ID NO: 202283 - protein, 105 aa, Triticum aestivum
  unsure (1)..(105): unsure at all Xaa locations
  Clone ID: PAT_TA_96701.pep
MDGSKLNKVAGKKFGGPRNKSVTKSIKAGLQFPVGRIGRYLKKGRYXQRVXSGAPVYLXAAVLEYLAAEVLELAGNXANGXXGRTRXVPRHLLXVIPRDAAGVAV

SEQ ID NO: 202284 - protein, 57 aa, Triticum aestivum
  unsure (1)..(57): unsure at all Xaa locations
  Clone ID: PAT_TA_96702.pep
TGFAVNXTFFPYXQGXXLLVSSXELIFSXXDPITTXFXMPMGPXQXHDLXGXGXLPS

SEQ ID NO: 202285 - protein, 84 aa, Triticum aestivum
  unsure (1)..(84): unsure at all Xaa locations
  Clone ID: PAT_TA_96703.pep
GGXYGEMGXKIDYVXKVVLIXDSAVGMSQLLARFARNEFXLNXKATIGVQXHXRXLQIDIRTXNXHIWDTRGIGAVTSGHLQGQ

SEQ ID NO: 202286 - protein, 120 aa, Triticum aestivum
  Clone ID: PAT_TA_96704.pep
HHRSSHPTLARSSRSSAMSGRGKGGKGLGKGGAKRHRKVLRDNIQGITKPAIRRLARRGGVKRISGLIYEETRGVLKIFLENVIRDAVTYTEHARRKTVTAMDVVYSLKRQGRTLYGFGG

SEQ ID NO: 202287 - protein, 131 aa, Triticum aestivum
  unsure (1)..(131): unsure at all Xaa locations
  Clone ID: PAT_TA_96705.pep
GLSADPETFAKNRELEVIHSRWAMLGALGCVFPEILSKNGIKFGEAVWFKAGAQIFSEGGLDYLGNPNLVHAXQSILAIWAVQVVLMGFIGGLXVXGGPLGEGLXINLRGAAPFDPLWXSPDDPEPPSEAG

SEQ ID NO: 202288 - protein, 89 aa, Triticum aestivum
  unsure (1)..(89): unsure at all Xaa locations
  Clone ID: PAT_TA_96706.pep
MAEPPPPPSQSPXPTQXXTPAXTXRDEMXACVAXLXAXLLPCLPARELQXVDRSLQSSXXIDVERYAMDFMXAAKXLXSCFIXMQRGNH

SEQ ID NO: 202289 - protein, 139 aa, Triticum aestivum
  unsure (1)..(139): unsure at all Xaa locations
  Clone ID: PAT_TA_96707.pep
KKFETLSYLPXLXXEXLLKQVDYLIRSKWVPCLEFSKVGFIXREHXASPGYYDXRYWTMWKLPMFGCTDATQVINEVEEVKKXYPDAYVRIIGFDXMAPRCKCVXFIAFKAIGSAKEVRVKGLASPRGTMLKCWRFGPS

SEQ ID NO: 202290 - protein, 91 aa, Triticum aestivum
  unsure (1)..(91): unsure at all Xaa locations
  Clone ID: PAT_TA_96708.pep
LVAYNNNGIRIQCADSTEHPCIGHIRIWXLIHGSLTLDEPXHGSILHLPRRARYQGDCXXPXVPCRGGGWGPARVGXSLASXXAGAPVGAS

SEQ ID NO: 202291 - protein, 54 aa, Triticum aestivum
  unsure (1)..(54): unsure at all Xaa locations
  Clone ID: PAT_TA_96709.pep
AAPTDQPAPSTSPPRRHRTWLPSPARAPGWPPSATPTSPPDRAPGQGSAXPPGA

SEQ ID NO: 202292 - protein, 134 aa, Triticum aestivum
  unsure (1)..(134): unsure at all Xaa locations
  Clone ID: PAT_TA_96710.pep
DLGIVSQCLKPXQGRKXNKXYFENVALKVNVKAGGRNTALQQALTRQIPLVTDQPTIFFGADVTHPAAGDDSSPXSIAAVXASMDWXPEITKXKAVVSAQPPXQXIIQDXQLHKATPKGTPCTVGMNAGSVIPF

SEQ ID NO: 202293 - protein, 120 aa, Triticum aestivum
  unsure (1)..(120): unsure at all Xaa locations
  Clone ID: PAT_TA_96711.pep
EEAPCIIXGGMIKDTAGGKHXRTGTELRNTRRFYFIQRARGRAHASAXDGGGGGGGCLSXLSSSSSCSPRRAGLLGACSVAXAXGASACPXPHXXVGXSLSRRVXPRLSVLXIPPVXPPP

SEQ ID NO: 202294 - protein, 127 aa, Triticum aestivum
  unsure (1)..(127): unsure at all Xaa locations
  Clone ID: PAT_TA_96712.pep
TALPRGSXGAXYLEEKVAVGTEDSATIPLXXAXGGPPAXGHLQRRVPQAPXALRRGAVRRAXCQHAHRVAVAXRGGSVDGGQLTVRGPRDQGXRHGHEXLHVGVVEARDGVPGEGHRADVVVRAGGG

SEQ ID NO: 202295 - protein, 80 aa, Triticum aestivum
  Clone ID: PAT_TA_96713.pep
YFLIICLLTSKPVRRLAQALVHMLLADQTYSITALMMVRCSSSMEAPQSASSKLSDASGWTEVIGTRGSPPLVRGCLPES

SEQ ID NO: 202296 - protein, 58 aa, Triticum aestivum
  Clone ID: PAT_TA_96714.pep
EHRDLLSSVAQLPDLLDPSVVSVLLVTSVGFHRYPRVLITIALLITTQTCTISSFAKK

SEQ ID NO: 202297 - protein, 111 aa, Triticum aestivum
  unsure (1)..(111): unsure at all Xaa locations
  Clone ID: PAT_TA_96715.pep
GKGLGKGGAKRHRKVLRDNIHGITNPAIRXLARRGGVKRISGLIYXEXXGXLKIFLXNVIRDAVTYTEHARRRTVTHGSSTHSPRDAPLYGFGRLHPPDSLGFVGRLIVIA

SEQ ID NO: 202298 - protein, 60 aa, Triticum aestivum
  Clone ID: PAT_TA_96716.pep
NIHFMTYFFIHARLLYFCLYLEIFYLYLYITKKSSSFFEKMVQQVFKKMLNKVLKMLNKY

SEQ ID NO: 202299 - protein, 98 aa, Triticum aestivum
  unsure (1)..(98): unsure at all Xaa locations
  Clone ID: PAT_TA_96717.pep
LTHKPRSSPSGSLSSLXRRRKHGPLGDXAAGGRLGVPGPPPRAPRLPRLKLHDPRRGVXGAXSSRSRSASCPPVDXFSSILXXGXHRWXAXLGRGXAN

SEQ ID NO: 202300 - protein, 69 aa, Triticum aestivum
  Clone ID: PAT_TA_96718.pep
GTSLLSFLFNCRIKSFITPLSHIEISPIQVASCYICNSDSCLLYADSLVLLRTNHLRQNLKKKKKKTRD

SEQ ID NO: 202301 - protein, 82 aa, Triticum aestivum
  unsure (1)..(82): unsure at all Xaa locations
  Clone ID: PAT_TA_96719.pep
AMXYRPAVMLQAPAXFXPDSLXTXHSPPDSSRSDSSSSSAVAGHGSPAVEGYACGGTRGRGRRASGVGGGGRRRAVRQGGAW

SEQ ID NO: 202302 - protein, 134 aa, Triticum aestivum
  unsure (1)..(134): unsure at all Xaa locations
  Clone ID: PAT_TA_96720.pep
XTMPPKPXVVKVQPTGXHCRVFXAAAHAAATMVEDPPPLDLLYIWPVSHKHPTXPDPSRAPPPRPDPARDTMPPPWFGLLREGDAWRRAAQIRWPSIQRPSLMSLWRIESARRQRRWLWPWRIESARRHQRWPR

SEQ ID NO: 202303 - protein, 123 aa, Triticum aestivum
  Clone ID: PAT_TA_96721.pep
RRLHAAAIMAAALRPLLRWHAVLPPSSMLRALFPVPYSKAAARPPAVCHAPLPPPLLREVTPRRAPPIPKGEPHRCTAVQSTMSDSTKSLLDKLKDLKDSKKPLDDMEKNIKERREMIKKAPA

SEQ ID NO: 202304 - protein, 73 aa, Triticum aestivum
  Clone ID: PAT_TA_96722.pep
SVTVVCVRLWWCSSVSPLLLCMLKISMAAIVVRRASCSRRCLGSSLFSDATICLPNLLIFLIFHGEAPSQGSC

SEQ ID NO: 202305 - protein, 118 aa, Triticum aestivum
  Clone ID: PAT_TA_96723.pep
REQGVLFPFDLSTRYIGLITPPTHTLTGQPLSTSTTSTSRSQPRAISRSQRKKGSGSPWPFARRRRRMQTTAQAMMAKKQATATVAASATATVWSGPGGGAGTAGGGGGAGNARRGRP

SEQ ID NO: 202306 - protein, 58 aa, Triticum aestivum
  unsure (1)..(58): unsure at all Xaa locations
  Clone ID: PAT_TA_96724.pep
MGERVXGTVXWFNVTXGFGFISPDDXGKTFXTXKXSIKSXRYRKXQXKXSLXXRQSPA

SEQ ID NO: 202307 - protein, 69 aa, Triticum aestivum
  unsure (1)..(69): unsure at all Xaa locations
  Clone ID: PAT_TA_96725.pep
PSXXXLLXPKXEXQLXXXTXNEXQLPPCNTYMKFHXXITLLILHCKXHYXXLCXRENXLXRYXSXFQFT

SEQ ID NO: 202308 - protein, 63 aa, Triticum aestivum
  unsure (1)..(63): unsure at all Xaa locations
  Clone ID: PAT_TA_96726.pep
RXGPCXHMVKVEYXSDLCXXPVXXCAXSXWVQGKXFLXIFFAIMXWFYRXDALLXXFXCKTHI

SEQ ID NO: 202309 - protein, 88 aa, Triticum aestivum
  Clone ID: PAT_TA_96727.pep
LTRLPSRSFVVCWRTTKTISSLPSASRRQICLCRSSFNQTYCRLLADGKRICRPPWQTAKFLILVVSSQSLHIPNPLSESFGNLIQFK

SEQ ID NO: 202310 - protein, 120 aa, Triticum aestivum
  unsure (1)..(120): unsure at all Xaa locations
  Clone ID: PAT_TA_96728.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSXT

SEQ ID NO: 202311 - protein, 119 aa, Triticum aestivum
  unsure (1)..(119): unsure at all Xaa locations
  Clone ID: PAT_TA_96729.pep
CTHTNSSSHLAAGPPLPSSHITALVATGSAISPTNPSLTHPISLLTQLLVAPPPAXDSGYLRRVPPLRHSPTSPHTAGALSCGEDSMLAGNKAQPRPSLMAKGFGVXPGAGWQVVXFSA

SEQ ID NO: 202312 - protein, 102 aa, Triticum aestivum
  unsure (1)..(102): unsure at all Xaa locations
  Clone ID: PAT_TA_96730.pep
NQLDQQASEPWQRPPPPPTPSRSLSSACSPPMAAAAXPGPAPAPTPTPTRAPATPSPVPVTPPPAPAPPSPVPVTPPPVPATPSPGSGSGSGRNNSSSGGLG

SEQ ID NO: 202313 - protein, 134 aa, Triticum aestivum
  unsure (1)..(134): unsure at all Xaa locations
  Clone ID: PAT_TA_96731.pep
MYMLRGYAKRAYFVGPXSRRSSPSHSPAGGVDDQQPPCIGWLDSKPGRSVVYLCFGSLTHVSDAQLRQLALGLEAAGKPFLWVVRDAGNWTPPEGWSERVGDRGLLVTAWAPQTAILGHPAVGAFVXRNCGWNS

SEQ ID NO: 202314 - protein, 118 aa, Triticum aestivum
  unsure (1)..(118): unsure at all Xaa locations
  Clone ID: PAT_TA_96732.pep
GGGXXTSXPLXEXFXPXAPXALXPPSSSWLXSPAATPAPRPSTGAAAGRPCRTPRRRTGPSSCPRRARQPSRRPPTGGSWACQPCSPSPSSRRDRLGTRPSQTRPAFVSPDPRTSHPR

SEQ ID NO: 202315 - protein, 64 aa, Triticum aestivum
  unsure (1)..(64): unsure at all Xaa locations
  Clone ID: PAT_TA_96733.pep
QFPXLXRGVFXIXGXTXTDXXIEXITLVVFSSRNQLLINPGQSDTGARDQKHHRTERHTRLKTD

SEQ ID NO: 202316 - protein, 122 aa, Triticum aestivum
  unsure (1)..(122): unsure at all Xaa locations
  Clone ID: PAT_TA_96734.pep
MAAATMALSSPAMAGTPVKASRAAPFGEGRITMRKTAGKPKVAASSSPWYGSDRVLYLGPLSGDPPSYLNGEXFPGEYGWETAGLSADPXETFAKKRELEVIXGGWAMLRGRSGWVFPRSLV

SEQ ID NO: 202317 - protein, 136 aa, Triticum aestivum
  Clone ID: PAT_TA_96735.pep
KDLVSRGAEPVPAVDVDLIKKKRAEKGLDDDGDLDVRWRVLRDKSSEDSKVVLSKAVGIFHESFDPIIQAGTGRDLIPAMVYGRSVRDQDYTGMYCAVLTVGKTVVSAGLFRVMGNVTPELPLGATSKDNQGLGYS

SEQ ID NO: 202318 - protein, 94 aa, Triticum aestivum
  unsure (1)..(94): unsure at all Xaa locations
  Clone ID: PAT_TA_96736.pep
MDSSRVILIPGTPPLPXAAYEQLPSSSADAKGQEXQRAGGGLRWXACAAVLAVSAVVAXVVAAAVFRGXXGWVRWAGIPCPNPSNWFPGQGGTG

SEQ ID NO: 202319 - protein, 101 aa, Triticum aestivum
  unsure (1)..(101): unsure at all Xaa locations
  Clone ID: PAT_TA_96737.pep
MARTKQTARKSTGGKAPRKQLATKAARKSAPATGGVKKPHRFRPGTVALREIRKYQKXSTELLIRKLPFQXRLVREIAQDFKTDLRFQSSAVSALARRPEG

SEQ ID NO: 202320 - protein, 50 aa, Triticum aestivum
  unsure (1)..(50): unsure at all Xaa locations
  Clone ID: PAT_TA_96738.pep
VGFSSPLSPRFPALFGSLGFSSGDXSLXXSXVGXXXXPCLXXXXAXXSIH

SEQ ID NO: 202321 - protein, 73 aa, Triticum aestivum
  unsure (1)..(73): unsure at all Xaa locations
  Clone ID: PAT_TA_96739.pep
SPNKRAIVLASFGDCCEXSSLPYLEKPFHLLRRXGVNVQXIXSQGASKLNISLIVHDSEAKQCVEALHPLLRR

SEQ ID NO: 202322 - protein, 72 aa, Triticum aestivum
  unsure (1)..(72): unsure at all Xaa locations
  Clone ID: PAT_TA_96740.pep
LALVXRDXXACTXGSEXGRTXLRAXLXLCXGEERXPGGVRXREXTAGAVRGREGVAGDGGRRRGRGRRRAAS

SEQ ID NO: 202323 - protein, 100 aa, Triticum aestivum
  unsure (1)..(100): unsure at all Xaa locations
  Clone ID: PAT_TA_96741.pep
MSGRGKGGKXXAKXHRKVLRDXIXGIIKXXIRXXXRRXGXKRIXGLIYEDTXGVXXIFLKIXIRXXVTYTXXARRKXTVTXMXXVXAGHPPGPAPLYRFA

SEQ ID NO: 202324 - protein, 124 aa, Triticum aestivum
  unsure (1)..(124): unsure at all Xaa locations
  Clone ID: PAT_TA_96742.pep
MYTARKKIQKDKGVEPSEFEDTVAQAFFDLENGNQELKSDLKDLYINTAIQMDVVGNRKAVVIHVPYRLRKPFRKIHVRLVRXAGEEXXRQGILSFVATRKDCXGXPXXGFWLFKXPRNKPLTS

SEQ ID NO: 202325 - protein, 142 aa, Triticum aestivum
  unsure (1)..(142): unsure at all Xaa locations
  Clone ID: PAT_TA_96743.pep
RLDPACLHVEAHQDRAIHLASTLPSPRSTPRPSMDHKTAARPESVRAFALARATVVVFAMATAADYVLDRYHLCSSHSQASFILPCVRVTAAAAAEWRALWLAMVCCAVLEVTRRGAGTAASTPRPXPRLXPXSRSHRPPTT

SEQ ID NO: 202326 - protein, 148 aa, Triticum aestivum
  unsure (1)..(148): unsure at all Xaa locations
  Clone ID: PAT_TA_96744.pep
QXGMXXGGXKVRGAPQEREAASPGAGGAPARGTVAXHDRHQQKRQEVGSPGXWYPSFTYLSLTDPAKPLPSALGMTGRSVDRRCSLLRPLARPAPARHPGLPSRRAPLPACFCGAPLGSGWCYAHVHVSSPGAGWVWGWREVRRGEMP

SEQ ID NO: 202327 - protein, 153 aa, Triticum aestivum
  unsure (1)..(153): unsure at all Xaa locations
  Clone ID: PAT_TA_96745.pep
QRPLSXVRLAAIXLGAKECSGXVVXWXGXAGRXXLRXPNAGSPFEXACNELWTTCPGXSPAWPSSPVGXFPSXAXAPGASXAAGAGFAGRLDGRGRVGDRGGRLRGRLRLLRRRHCRRRQEQRGDQEDPRXRRHCRGGVPAGDGLVGGLGRRS

SEQ ID NO: 202328 - protein, 62 aa, Triticum aestivum
  unsure (1)..(62): unsure at all Xaa locations
  Clone ID: PAT_TA_96746.pep
SPYVITRLAHYTGHCVFTAFFSFSXIVTPCIFXLAHXFSXIXGGIQSNLXGLCNTTHYPGXL

SEQ ID NO: 202329 - protein, 95 aa, Triticum aestivum
  unsure (1)..(95): unsure at all Xaa locations
  Clone ID: PAT_TA_96747.pep
MKGTKLAAILILQAVLVMGLLSHVNADFFPKCCNNCRSFSGVDVCDDAHPKCPQGCSACRVVSTSPEMWRCADMKSNVTXTCGXPCXEVLGSMPA

SEQ ID NO: 202330 - protein, 143 aa, Triticum aestivum
  unsure (1)..(143): unsure at all Xaa locations
  Clone ID: PAT_TA_96748.pep
FPELLARNGVKFGEAVWFKAGSQIFSEGGLDYLGNPSLVHAQSILAIWACQVVLMGAVEGYRVAGGPLGEIVDPLYPGGSFDPLGLADDPEAFAELKVKXEIKNGPPRPCSPMFGFFXQGQSSPXKGPPETSPQLFRTPSKQP

SEQ ID NO: 202331 - protein, 111 aa, Triticum aestivum
  unsure (1)..(111): unsure at all Xaa locations
  Clone ID: PAT_TA_96749.pep
TLGPAVREGEHVFGVAHIFASFNDTFIHVTDLSGRETLVRITGGMKVKADRDESSPYAAMLASQDVAVRCKELGITALHIKLRATGGKQDKNXPGPGAQAALRALARXGNE

SEQ ID NO: 202332 - protein, 119 aa, Triticum aestivum
  unsure (1)..(119): unsure at all Xaa locations
  Clone ID: PAT_TA_96750.pep
MRECISIHIGQAGIQVGNACWELYCLEHGIQPDGXMPGDKTVGGGDDAFNTFFSXTGAGKHVXPRAVFVDLEPTVIDEVRTGAYRQPLPPXSSXIXXAXEDPAKQTFXRGHLHFGKGLF

SEQ ID NO: 202333 - protein, 117 aa, Triticum aestivum
  unsure (1)..(117): unsure at all Xaa locations
  Clone ID: PAT_TA_96751.pep
KTASKEAGGEAXTRGRKKGSKAXKGVETYKIYIFKVLKQVHPDIGISSKAMSIMNSFINDIFEKLAAEAAKLARYNKKPTITSREIXTSVRLVXPGKLAKHARLRGQQRAVTXVPPP

SEQ ID NO: 202334 - protein, 100 aa, Triticum aestivum
  unsure (1)..(100): unsure at all Xaa locations
  Clone ID: PAT_TA_96752.pep
MARTKQTRKSTGGKXPXKHXATXAARKSAPATXGVKKPHRFRPGIVALREIRKYQKXTELLIRKLPFQRLVPRXIAXDFKTDLLFPVLPXVSAXXGGLPP

SEQ ID NO: 202335 - protein, 90 aa, Triticum aestivum
  unsure (1)..(90): unsure at all Xaa locations
  Clone ID: PAT_TA_96753.pep
MANPRVFFDMTVGGXAPAGRIVMELYKDAVPRTVENFRALCTGEKGXAXSXXPLHYKGSAFXRVIPRLQFRANFNRGKHAGEVHLGKVPT

SEQ ID NO: 202336 - protein, 108 aa, Triticum aestivum
  unsure (1)..(108): unsure at all Xaa locations
  Clone ID: PAT_TA_96754.pep
YREGLMSPQTETKAGVGFKAGVKDYKLTYYTPXYETKDTDILAAFRVSPQPGVPPEEAGXAAVAAESSTGTWTTVWTXDGLTSLDRYKGRFXHIEPCLGERTANGLFW

SEQ ID NO: 202337 - protein, 118 aa, Triticum aestivum
  unsure (1)..(118): unsure at all Xaa locations
  Clone ID: PAT_TA_96755.pep
MAGRKAGXRXXAVTRSVKAGLQFPVGRIGRYLKKGRYAXAXVGSGAPVYLAAVLEXTSAAEVLELAGNAAXRDNKKXRIIPPPCLPFQTKELRCLPGSAQRGVIPNIPLAFPRVPALP

SEQ ID NO: 202338 - protein, 90 aa, Triticum aestivum
  unsure (1)..(90): unsure at all Xaa locations
  Clone ID: PAT_TA_96756.pep
MXKQGGKAKPLKQAKVAEKDYDENDLAYLQKKKDEQKALKELKAKAGXKGXLGGSGLKKSGEXMILPTHSTRKMIIYSIYLAWCRATIWL

SEQ ID NO: 202339 - protein, 129 aa, Triticum aestivum
  Clone ID: PAT_TA_96757.pep
RRSGPAAAEASNCRRRCRRRFHGQHGGRNSGGLQGAGGRRGGGRLPRARPRGGAAGSAALPARLQRVLRPRRGPRPGGRRHPRFRARRRHNPRRTLQHRARHREGRPGRPRRRRRGGGAWERAARPRRV

SEQ ID NO: 202340 - protein, 135 aa, Triticum aestivum
  unsure (1)..(135): unsure at all Xaa locations
  Clone ID: PAT_TA_96758.pep
LTPIVVNAKDEYQNLEWNTPCYKDRRKNCLRLTDVHPKEPWVLIVEGFHIWYSLYIWNIQTKESMGKKASVSGVLAKFIPQKQWVITGNSSGDIRMWTAPTMDPCNGYIAHHSGITSXAIHPNRPFLLSYSDDAX

SEQ ID NO: 202341 - protein, 141 aa, Triticum aestivum
  unsure (1)..(141): unsure at all Xaa locations
  Clone ID: PAT_TA_96759.pep
SPWRSLLGGCLGGAAGDHEAKXKVRPRSGGGGGGGLRRLSFTDLSGAADEDLSISLVGSNLHVFTVAELRAATGEFADDNFLGEGGFGPVYKGFVDGGVKPGLKPQAIAVKLWDPXGAQGHKEWLAEVIFLGQLRDPXLGE

SEQ ID NO: 202342 - protein, 121 aa, Triticum aestivum
  Clone ID: PAT_TA_96760.pep
MPSMASSKGLLVFALLLAAAAILVASTDEHPEAKKEENEAGVENFFHFGGGHHGHGGGGGGYGGGGGGYGGGGGGYPGGGGGYGGGGGYPGHGGEGGGGYGGGGYPGGGGGYGGGGGYPGH

SEQ ID NO: 202343 - protein, 98 aa, Triticum aestivum
  unsure (1)..(98): unsure at all Xaa locations
  Clone ID: PAT_TA_96761.pep
MAKETVLLVLAFAAAAAFLCSCPAVASARKVGETCALSRNCDAGLHCETCVVDGNVRPRCTRVTPVDPQSKDRXLPFNRYAXWLTNHNSFARLGNQSQ

SEQ ID NO: 202344 - protein, 119 aa, Triticum aestivum
  unsure (1)..(119): unsure at all Xaa locations
  Clone ID: PAT_TA_96762.pep
MGRVIRAQRKGAGSVFKSHTHHRKGPARFRSLDFGEXRNGYLKGVVTDVIHDPGRGAPLAKVTFRHPFXRYKHXKELFVXXPEGMYTGQFGLTGGREATPLSGKSPPRSGGSKGRASFL

SEQ ID NO: 202345 - protein, 119 aa, Triticum aestivum
  unsure (1)..(119): unsure at all Xaa locations
  Clone ID: PAT_TA_96763.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQXKLGXLXARXVTNXPNGGXGFPNINSVAAP

SEQ ID NO: 202346 - protein, 120 aa, Triticum aestivum
  unsure (1)..(120): unsure at all Xaa locations
  Clone ID: PAT_TA_96764.pep
MARTKQTARKSTGGKAPRKQLATKAARKSAPTTGGVKKPHRYRPGTVALREIRKYQKXARRLLIRKLPFQRLVREIAQDFXKTDLRFQEPRRCWASKKAAEAYLVXGLFEDNQPCAPIQN

SEQ ID NO: 202347 - protein, 62 aa, Triticum aestivum
  unsure (1)..(62): unsure at all Xaa locations
  Clone ID: PAT_TA_96765.pep
YKEHMVKYNADGYFTHTKGDIHIYFFTKGDCLTHTKIAMCMTWGKIXKKKXSFXNXXXPTNX

SEQ ID NO: 202348 - protein, 114 aa, Triticum aestivum
  unsure (1)..(114): unsure at all Xaa locations
  Clone ID: PAT_TA_96766.pep
MSGRGKGGKGLGKGGAKRHRKVLRDNIQGITKPAIRRLAKEGXAXKRISRLIYEGDTRRLKIFLQNVIXRDAVTYTXEHARRKPFTAMTFVYPFKRQGRXFYVFXVIRWPVVTF

SEQ ID NO: 202349 - protein, 98 aa, Triticum aestivum
  unsure (1)..(98): unsure at all Xaa locations
  Clone ID: PAT_TA_96767.pep
MARGLKKHLKRLNAPSHWMLDKLXGGAFAPKPSSGPHKAREXCLPLILIXRNRLKYALTYRXNCIYPLCSVILWFDGKXRTDKTTCWFNGIISIPQTG

SEQ ID NO: 202350 - protein, 82 aa, Triticum aestivum
  unsure (1)..(82): unsure at all Xaa locations
  Clone ID: PAT_TA_96768.pep
QMKPCVAFLQQKCSPLRMPFLQTQVEQLSSCQIVQYQCCQQFGAVPERTGAXXSTSWGRGIIQQQXQQQLQPNKTTLGMFSL

SEQ ID NO: 202351 - protein, 95 aa, Triticum aestivum
  unsure (1)..(95): unsure at all Xaa locations
  Clone ID: PAT_TA_96769.pep
APPPISPRNLLRSKRSQGSLVLLRKMQIFVKTLTGKTITLEVESSDTIDNVKAKIQDKEGIPPDQQRSTFAGKQFEDGPTLAXXNIXXXSTSWQG

SEQ ID NO: 202352 - protein, 112 aa, Triticum aestivum
  unsure (1)..(112): unsure at all Xaa locations
  Clone ID: PAT_TA_96770.pep
SSYHVSYNMVVMAKRDGAALGELSVLRRPAATRRQSADFPQXXCPIHAXSXPXVLQLPTLRPXRGFQQFXPXLLXRNXEKAPXSFRYPALGXIPXGVXRXPXXLXXYXKLPS

SEQ ID NO: 202353 - protein, 63 aa, Triticum aestivum
  unsure (1)..(63): unsure at all Xaa locations
  Clone ID: PAT_TA_96771.pep
FXXSSAFGTRKHRAHHTTLTSLSEADCRRPAPSVASSPVIRRGRTLLHCSTAAAAGVSPEVSG

SEQ ID NO: 202354 - protein, 97 aa, Triticum aestivum
  unsure (1)..(97): unsure at all Xaa locations
  Clone ID: PAT_TA_96772.pep
MAGMRKQQVVAALVLALMVLAAAPGGARAACQASQLAVCASAILSGAKPSGECCGNLRAQQPCFCQXYAKDPPNGQYIXRSPNAARHLNSCGSPRNG

SEQ ID NO: 202355 - protein, 116 aa, Triticum aestivum
  unsure (1)..(116): unsure at all Xaa locations
  Clone ID: PAT_TA_96773.pep
RPPTQTLPRRRRRRRSARRRPPTAAKMQIFVKTLTGKTXGLEXVESSDTIDNVKAKXQDKEGIPPDQQRFNLRRKXXRDGXTLRLKFKSTSIPSGGQKPRRTLPQETKKNPLSNLR

SEQ ID NO: 202356 - protein, 163 aa, Triticum aestivum
  unsure (1)..(163): unsure at all Xaa locations
  Clone ID: PAT_TA_96774.pep
MKTFLILALLAIVATTATTAVRVPVPQLQPQNPSQQQPQEQVPLXVQQQQFLGQQQPFPPQQPYPQPQPFPSQQPYLQLQHFRSATTIFRKPQPFRPQQPYPQPQPQYSQPQRXISQQQQQQQQQQQSFQQFWQQQRXPXXGVVLQQHNITXGKLQVWHKFQL

SEQ ID NO: 202357 - protein, 59 aa, Triticum aestivum
  unsure (1)..(59): unsure at all Xaa locations
  Clone ID: PAT_TA_96775.pep
NLXGGEXXLXPRAPSFXXXPSGSGHQRWPLPWLMQENARSGRRCRLAEASPTVIRECEA

SEQ ID NO: 202358 - protein, 62 aa, Triticum aestivum
  unsure (1)..(62): unsure at all Xaa locations
  Clone ID: PAT_TA_96776.pep
SESASGGRTGXXCXPGDGGCEMGLCAAQSTGEATTRSRRKTAEGSGNAIVPHLEIEIERGGG

SEQ ID NO: 202359 - protein, 119 aa, Triticum aestivum
  unsure (1)..(119): unsure at all Xaa locations
  Clone ID: PAT_TA_96777.pep
THHACLISRSSSRRSLQEQWRPRVFSLGGSCLGGLCSLPSPGRLPPGSPPSSSGHRPXPPAKQNDNKQLXFPSSIXPTNLTEXARDXWFQPXXXSXPXGTGVXSXQXXGXGXFKRPTDM

SEQ ID NO: 202360 - protein, 135 aa, Triticum aestivum
  unsure (1)..(135): unsure at all Xaa locations
  Clone ID: PAT_TA_96778.pep
MARTKQTARKSTGGKAPRKQLATKAARKSAPATGGVKKPHRFRPGTVALREIRKYQKSTEXLIRKXPFQRLVRXIXAKTSKTDFRFQSSAVSALQGAAXATGGSSRQLCASSQLHIPRIRRNLKRLSDLIKLVRY

SEQ ID NO: 202361 - protein, 46 aa, Triticum aestivum
  Clone ID: PAT_TA_96779.pep
TNQNKTGTVALESRPAARPAGASRVRAAVEECCGNQAAYLVDDLRV

SEQ ID NO: 202362 - protein, 135 aa, Triticum aestivum
  unsure (1)..(135): unsure at all Xaa locations
  Clone ID: PAT_TA_96780.pep
MEASKLKAARLLEQMSAHLATDAGKEIANKVGFVYQXLNISPKKMGVDEEIFXSVDLKKGAVSTRKYEGTPDAXFNFNDDXFLAIXSXKLNPXMAFXXKGKLKXKGXIXAAQNXXXDLPQAFNLPIAFFPMIRLK

SEQ ID NO: 202363 - protein, 68 aa, Triticum aestivum
  unsure (1)..(68): unsure at all Xaa locations
  Clone ID: PAT_TA_96781.pep
CNSLTGYPPLCPWXLGRKSRCCREAHARVSLVSPSLKLPQLLSFSPAAGGAPDVRRRWGRRETRIDGG

SEQ ID NO: 202364 - protein, 92 aa, Triticum aestivum
  unsure (1)..(92): unsure at all Xaa locations
  Clone ID: PAT_TA_96782.pep
MAPKAEKKPVEEKAEKTTAGKKTKAEKRPPASKEGGADKKGKKXXKKSVWDXKIYIFKVLXQSXPRHXIPPKAFSSIXPLSNNSFKIPFNFP

SEQ ID NO: 202365 - protein, 83 aa, Triticum aestivum
  unsure (1)..(83): unsure at all Xaa locations
  Clone ID: PAT_TA_96783.pep
EGSSENIMASNWLERVXSLVXLSLGLNMSQSLLIALXHLPLPITLVLAHMASNLVREGLLSCLLQPLDPXAGIPCSPGNPLVS

SEQ ID NO: 202366 - protein, 68 aa, Triticum aestivum
  Clone ID: PAT_TA_96784.pep
PDDDSDNDTKWGQSSLNPSFDEEGSNNSREDQLQKAMSEVMNGQFKILVSRFLAAEGFSLSDGATDNI

SEQ ID NO: 202367 - protein, 67 aa, Triticum aestivum
  Clone ID: PAT_TA_96785.pep
NRNKSQWPKDTRCLAQPGSRVRFDRVDLSQTHARIAYRVYHPPTTLPMGIQSDPCPYPSGNPTQRVA

SEQ ID NO: 202368 - protein, 116 aa, Triticum aestivum
  unsure (1)..(116): unsure at all Xaa locations
  Clone ID: PAT_TA_96786.pep
MRSWRAXSEFCASRSTVQXPRWGXVQMLEGSXLERPPPPKSSDSFMTVTTATTGGGSGSGVSSSVASTFASSVAAPPAPVPSPNVEQEMSVGRSASARTREIAALPLRSSEPYMTM

SEQ ID NO: 202369 - protein, 61 aa, Triticum aestivum
  unsure (1)..(61): unsure at all Xaa locations
  Clone ID: PAT_TA_96787.pep
FQSRHGLGHWVHDLQLWIKTQCKAEWTATPXTRVFGXKXXLGSPPXXXXFXXTXPGGGPYQ

SEQ ID NO: 202370 - protein, 122 aa, Triticum aestivum
  unsure (1)..(122): unsure at all Xaa locations
  Clone ID: PAT_TA_96788.pep
HKSTMKKFLVLALIVIAATTTAAEPFTAFRIASEPQHPSSPEQQPTLQPQEHPVPHQKLNPCXGCLLXXCSPXAXVLSPRQKLVKKXXPWKLEKFFXDLXVSXXSKFRDSXFXTPXFCXXXN

SEQ ID NO: 202371 - protein, 87 aa, Triticum aestivum
  unsure (1)..(87): unsure at all Xaa locations
  Clone ID: PAT_TA_96789.pep
RKAXPTAXREXXXGQNWKXSAALPFSAWGRGETSIXYLTATDAPLFILPFSXPHXPQARAQAHSVIRRRRDGVVVFSPRIGGGSGGG

SEQ ID NO: 202372 - protein, 47 aa, Triticum aestivum
  unsure (1)..(47): unsure at all Xaa locations
  Clone ID: PAT_TA_96790.pep
MGKEKTHINIVVIGHVDSGKSTTTGHLIXKXGXIXKRXIXKVERKPL

SEQ ID NO: 202373 - protein, 54 aa, Triticum aestivum
  unsure (1)..(54): unsure at all Xaa locations
  Clone ID: PAT_TA_96791.pep
VSELTRSALAAAEQKASVAGSALMGNQYVSAGASWLTSAFGMVTKAAGIMGXMA

SEQ ID NO: 202374 - protein, 77 aa, Triticum aestivum
  Clone ID: PAT_TA_96792.pep
VSGLMEGKAILLCLMVIVQLGNSIHAKDCFIGIAFGATLCTELKCRLSCMTKWGPEVTKSVLYRSHPKLQALLLCCL

SEQ ID NO: 202375 - protein, 117 aa, Triticum aestivum
  unsure (1)..(117): unsure at all Xaa locations
  Clone ID: PAT_TA_96793.pep
WGRYRGEFQGKGVPXGARFSPKXRPXPGPPXLXAQPLPTRGXPAGXRRPAGRPXXATAPPASAARPAAAPAAXATEPAPRRPAGXGEHEDEEDNLDKQPPPPPPPSLAAACARPRAR

SEQ ID NO: 202376 - protein, 80 aa, Triticum aestivum
  unsure (1)..(80): unsure at all Xaa locations
  Clone ID: PAT_TA_96794.pep
AIHIVVEAIIQQQSQQQWQEPQQQAQHKSMRMLLENLSLMCNIYVPVQCQQQQQLGATTTTTVAGAVDTVXISPXKRFXP

SEQ ID NO: 202377 - protein, 119 aa, Triticum aestivum
  unsure (1)..(119): unsure at all Xaa locations
  Clone ID: PAT_TA_96795.pep
MAPTVMASSATSVAPFQGLKSTAGLPVSRRSNGASLGSVSNGGRIRCMQVWPIEGIKNSRPVLXPPLNTEASFSKSIXYSXQXVPSXHLXRLXXSXRKTSPWXXXGRYGNELLFVHPLK

SEQ ID NO: 202378 - protein, 149 aa, Triticum aestivum
  unsure (1)..(149): unsure at all Xaa locations
  Clone ID: PAT_TA_96796.pep
XXXSXGXKPXGPHXRARXIPVRXGKSEXXIQXKXRLVXXIXFXKTQRNFGGSFNLHLEMTASSTASPXTNSXXRNSQXKXTLDYLFPKSKRGRXKNXAKHXFQLXKAFXGXXPQFXAEXXPXFXXPNFGXXIFSQKLFLKKKXFFKRGG

SEQ ID NO: 202379 - protein, 96 aa, Triticum aestivum
  Clone ID: PAT_TA_96797.pep
ETKVIRKARDPRWNEEFQFVVDEAPMDEKIHIEIRSRRRRLLPFRTQESLGHVNINLVDVVNNGRINENYHSSTPRNGKLQLQIKVDTVTSTPIHT

SEQ ID NO: 202380 - protein, 88 aa, Triticum aestivum
  unsure (1)..(88): unsure at all Xaa locations
  Clone ID: PAT_TA_96798.pep
YVNPDIQQSLSFVSKYRQGSYMDQAGAGEATAVAAAVCVTGAGGFIASWSWERSSPEETTPVHGXFVTPTTQELHLKXLDGAXXRFGX

SEQ ID NO: 202381 - protein, 117 aa, Triticum aestivum
  unsure (1)..(117): unsure at all Xaa locations
  Clone ID: PAT_TA_96799.pep
KFSLXFGXKRAAPERRGQRAXFXFSPGFXPXRXPGFXPPXFFSGNGTPXPXHLSWAPPPERKMKERRRRHSGERGRRGSGLTGRGGEEAGEGDRGRGERGGGGRRIRHGAEGRGGGG

SEQ ID NO: 202382 - protein, 103 aa, Triticum aestivum
  unsure (1)..(103): unsure at all Xaa locations
  Clone ID: PAT_TA_96800.pep
MSSSEVACTLAALILHDDGIPITSEKIATVVKAAGIKVEAYWARALXAKSWEKRSVDDLILSVGSGGGWCSQXAAAAAPAAGWCCARKEXEXXEKKEEARKKR

SEQ ID NO: 202383 - protein, 36 aa, Triticum aestivum
  Clone ID: PAT_TA_96801.pep
KSMNFFSKLDEHFSNSVNFFQINELFSNSMNFFHIQ

SEQ ID NO: 202384 - protein, 135 aa, Triticum aestivum
  unsure (1)..(135): unsure at all Xaa locations
  Clone ID: PAT_TA_96802.pep
MAPKAAEKKPVAVAAEKTAAGKKPKAEKRAAATKEAGGEGXXXGRKKGSKAKKGVETYKIYIFKVLKQVHPDVGISSKAMSIMNSFINDIFEKLAGESAKLARYXKNPXITSREIQTSVRLVSPXRVAKHAVSRX

SEQ ID NO: 202385 - protein, 109 aa, Triticum aestivum
  unsure (1)..(109): unsure at all Xaa locations
  Clone ID: PAT_TA_96803.pep
AMPQSLARSQMLQQSSCHVMQQQCCQQLPQIPQQSRYEAIRAIIYSIILQEQQQVQGSIQTPQQQPQQLXGQCVSQPQQQSQQQLRATTQQQQLAQGTFXQPHQDTXLK

SEQ ID NO: 202386 - protein, 151 aa, Triticum aestivum
  unsure (1)..(151): unsure at all Xaa locations
  Clone ID: PAT_TA_96804.pep
GKTTILYKLKLGEIVTTIPTIGFNVETVEYKNISFTVWDVGGQDKIRPLWRHYFXNTQGLIFVXDSNDRDRVVXARDXLHRMLNEDXLRXAVLLVFGXTXNXPKCHEAAEITDNLGLHPXXXXNWYIPXTFAKXGKGLFXSLDGCPTNCQQ

SEQ ID NO: 202387 - protein, 65 aa, Triticum aestivum
  unsure (1)..(65): unsure at all Xaa locations
  Clone ID: PAT_TA_96805.pep
LQAARKSAPTTGGVKKPHRYRPGXVALREIRKYQKXTELLIRKXFQRLVREDSARLKDGLRSNPP

SEQ ID NO: 202388 - protein, 112 aa, Triticum aestivum
  unsure (1)..(112): unsure at all Xaa locations
  Clone ID: PAT_TA_96806.pep
DPLIKANDTIKLDLETNKIVDFIKFDVGNVVMVTGGRNTGRVGVIKNREKHKGTFRDHPRLRMPKGXXFATRLXXXHQLGKXNKPXVSXPXXKGIQSNNNLGAGTSPPCCGD

SEQ ID NO: 202389 - protein, 149 aa, Triticum aestivum
  unsure (1)..(149): unsure at all Xaa locations
  Clone ID: PAT_TA_96807.pep
MKKFLVLALIVIAXTTTAAEPFTAFRIASEPQHPSSPEQQPTLQPQEHPVPHQKLNPCRDALLHQCSPVADMSFLRSQVXQHSSCLVMWEQCCQATKSDXQASRCGGIHNVRARHYLQQXNIGTRYSTNLNSNNTSQQEMRFPPQHNNN

SEQ ID NO: 202390 - protein, 152 aa, Triticum aestivum
  Clone ID: PAT_TA_96808.pep
GTLSVLASLSNKVYNDQGIPAAFKVPSGAVLPFGSMEDALKKSGSLESFTSLLDKIETAEIENGELDTLSSELQATAPLLHQPKKHQIPENNFPEGRRLIRQVQRQRGNWPGCSVQGLRTPCLSRPTIAAYAVWHVHPEGTSTPVVAQGQEA

SEQ ID NO: 202391 - protein, 71 aa, Triticum aestivum
  unsure (1)..(71): unsure at all Xaa locations
  Clone ID: PAT_TA_96809.pep
MSCCGGNCGCGAGCKCGNGCGGCKMFPDVEATAGAAAMVMPTAPKRGTSXXFKMAGGXTALQKTSNGVPVN

SEQ ID NO: 202392 - protein, 88 aa, Triticum aestivum
  unsure (1)..(88): unsure at all Xaa locations
  Clone ID: PAT_TA_96810.pep
MKTFLILALLAIVATTATTAVRVPVPQLQPQNPSQXQQPQEQVPLVQQQQFXGQQQQFXPQQPPFRNNNNNNSTATTIHINHLSLQQA

SEQ ID NO: 202393 - protein, 136 aa, Triticum aestivum
  unsure (1)..(136): unsure at all Xaa locations
  Clone ID: PAT_TA_96811.pep
RIPRGPSSPEREERWPGRPGERKKAVTRSVKAGLQFPVGRIGRFLKKGRYAQRVXSGAPVYLAAVLXYLAAEXVLELAGNAAXKDNKXSRILPRQLSSPSRNDXDSGNCRRHIRTRLLPKTFPKGKAKEPFPNPRN

SEQ ID NO: 202394 - protein, 140 aa, Triticum aestivum
  unsure (1)..(140): unsure at all Xaa locations
  Clone ID: PAT_TA_96812.pep
LLLLLPPIPNQGGTRREEGKGREEEITEPSARTGQQAPRSRAGAEMGLTFTKXLFSRSSAKKEMRILMGRLRCXAGKTTILYKLQLXGRFVTTIPTIRFNVQTXEYKNXFNVLDXRGQDKFSPCWRYFQTPRFLSAHYKT

SEQ ID NO: 202395 - protein, 73 aa, Triticum aestivum
  unsure (1)..(73): unsure at all Xaa locations
  Clone ID: PAT_TA_96813.pep
MAAQGRGSAAVVVCVLLSAAAVVDAAVFNVGDRGGWAFNTNSWATGKRFKAGDXLVSKYDATAHTXVAVNPAG

SEQ ID NO: 202396 - protein, 104 aa, Triticum aestivum
  unsure (1)..(104): unsure at all Xaa locations
  Clone ID: PAT_TA_96814.pep
MSTVTPAYLDQRLAAAKRSSREAAMAGAKAAAVATVAAAIPTLASVXRMLRXAKGALNQTGXALIISTVAGXGYFIVAEQXNLSHXQXXILXTSAKXLXETPFN

SEQ ID NO: 202397 - protein, 85 aa, Triticum aestivum
  Clone ID: PAT_TA_96815.pep
ARTSLGISCMEGKTTLCFLMVLLLLGNCAHAENSCKEHRTLEIGCIRKYCRKNCNRDYEGHRVRNAYCTGFIPFRLLVSATSVDG

SEQ ID NO: 202398 - protein, 150 aa, Triticum aestivum
  unsure (1)..(150): unsure at all Xaa locations
  Clone ID: PAT_TA_96816.pep
QLQQPQQPFPQPQQQLPQPQQPQQSFPQQQRPFIQPSLQQQLNPCKNILLQQCKPASLVSSLWSIIWPQSDCQVMRQQCCQQLAQIPQQLQCAAIHSVXVHSIIMQQXSKQQQQQQGMHIFLPLSQQQQXXQGSLVXRQXIIQPQQQLND

SEQ ID NO: 202399 - protein, 87 aa, Triticum aestivum
  unsure (1)..(87): unsure at all Xaa locations
  Clone ID: PAT_TA_96817.pep
MSPQTETKAGVGFKAGVKDYKLTYYTPEYETKDTDILAAFRVSPQLGVPPEEAGXAALPAXXSTGYMXXLFGXEWTYNLNRYKGQCF

SEQ ID NO: 202400 - protein, 158 aa, Triticum aestivum
  unsure (1)..(158): unsure at all Xaa locations
  Clone ID: PAT_TA_96818.pep
FLQPHQPFSQQPQQIFPQPQQTFPHQPQQQFPQPQQPQQQFLQPRQPFPQQPQQPYPQXQPQQPFPQXTQQPQQPFPQSKQPQQXFPQAQQPQQSFPQQQPSLIQXSLQQQLNPCKXSSWQQCNCVLGVSLXGIILPPSDCXVMPXQCCQQLXQSTIQ

SEQ ID NO: 202401 - protein, 105 aa, Triticum aestivum
  unsure (1)..(105): unsure at all Xaa locations
  Clone ID: PAT_TA_96819.pep
FIKEDLKTNDTQLQVLAGILNVCALVGSLTAGRVSDXSGRRLTISLAACIFLAGSVLMGSRPTTXVLXRRAXRGRGREPPXFALLPXKIXXGDISVTSPYEFENP

SEQ ID NO: 202402 - protein, 95 aa, Triticum aestivum
  unsure (1)..(95): unsure at all Xaa locations
  Clone ID: PAT_TA_96820.pep
RPPGRRPSAKGRITMRKTAGNPRWRRPAXXCNXPNASLLRPSSGXPPSTHXXXSRXLSWKPRGFXPTQXFQKRSWSIXXLASXGARGFSPMFPXG

SEQ ID NO: 202403 - protein, 131 aa, Triticum aestivum
  unsure (1)..(131): unsure at all Xaa locations
  Clone ID: PAT_TA_96821.pep
GRRLSPQQSALPSGNFGTSLSPPSHPTTEYGASRRHGSPPYQRSEHAASGSRGPYMNPRGXRPCRLRNGKEKFPLSPRFSQCPRXTLGPPLEYGAAKKXCFRLXLLXPLGPYXTTRFRPWQTTKWKENVPL

SEQ ID NO: 202404 - protein, 64 aa, Triticum aestivum
  Clone ID: PAT_TA_96822.pep
ARPPPPTTPPRPRPTAPAAAEAATGPRPRPSPSPTGAVTGPRPPPSPSPTAAAATGAPPAGQPI

SEQ ID NO: 202405 - protein, 113 aa, Triticum aestivum
  unsure (1)..(113): unsure at all Xaa locations
  Clone ID: PAT_TA_96823.pep
QHLDELVQEVARLKAENARVLARANDITGQFVRVDQENTVLRARAAELGDRLRSVNQVLRVVXXFSGVXIDPXXNCPPEQPXFPAXEIPYPATAMPMAATASKSPRIGYNGSY

SEQ ID NO: 202406 - protein, 149 aa, Triticum aestivum
  unsure (1)..(149): unsure at all Xaa locations
  Clone ID: PAT_TA_96824.pep
MPRRLGTTYSGRIAAATPSPSGPSITVTVSGTPPPTPLDPRGYPLPRRHLICAAAGILRFPASPTPLVDLADYLRDRRLTLTTSEASEIARLSPDPALALAFFRFAPAXPGFRHDAFSYNRILGLLFRTRRTKSAYLSEIRTREIHVIG

SEQ ID NO: 202407 - protein, 90 aa, Triticum aestivum
  unsure (1)..(90): unsure at all Xaa locations
  Clone ID: PAT_TA_96825.pep
MAPKRGGKAPVPAKKKAADKVVNPLFEKRPKQFGIGGALPPKKDLHRFVKWPXVVRIQAPSARILXASAQXAPGLNXSTXTFDKNFATTL

SEQ ID NO: 202408 - protein, 117 aa, Triticum aestivum
  unsure (1)..(117): unsure at all Xaa locations
  Clone ID: PAT_TA_96826.pep
PEVISLIRYPWRHTHICLSPLSSFLFSVSTSKPKEQQKVSQLTTQYVTGRQLSKGPICLKEPFQDGAHHAEVVHKKLVATNLFAMILQIQSTCVGTMPXVAVQLKLVYXFNFLADKN

SEQ ID NO: 202409 - protein, 130 aa, Triticum aestivum
  unsure (1)..(130): unsure at all Xaa locations
  Clone ID: PAT_TA_96827.pep
MKGAKSKGAVKADTKLAVKSKGAEKPAQKGKKGKAGKDPNKPKRAPSAFFVFMGEFREEFKQKNPKNXSVAAVGKAAGESGXAXSESEXAPXVAKGQQVKGEFNKAXRXNKGXMLXLLPKXXXARSLRIR

SEQ ID NO: 202410 - protein, 139 aa, Triticum aestivum
  unsure (1)..(139): unsure at all Xaa locations
  Clone ID: PAT_TA_96828.pep
MALPNQNTVDYPSFKLVIVGDGGTGKTTFVKRHLTGEFEKKYEPTIGXVEVHPLDFTTNCGKIRFYCWXDTAGAREXGGLRMGYYXHGQCAIIMFDVTSKXWTYKNVPTWDKDXXVCEEXPIVLCXNKVDVXEQQVRQQ

SEQ ID NO: 202411 - protein, 142 aa, Triticum aestivum
  unsure (1)..(142): unsure at all Xaa locations
  Clone ID: PAT_TA_96829.pep
MAPTVMASSATSVAPFQGLKSTAGLPVSRRSNGASLGSVSNGGRIRCMQVWPIEGIKNSRPVLPANAQQRRASSKQVXLPDXSKWVPCLXLNKXXSXFRXXNGLPGXNEXXLMXIWELXXFRCTXXTSXNXVEEVXKGYLLP

SEQ ID NO: 202412 - protein, 130 aa, Triticum aestivum
  unsure (1)..(130): unsure at all Xaa locations
  Clone ID: PAT_TA_96830.pep
TLYGEGWNFLIPDLICDAENGLLWKLHLDLEAIAASTSDAPSILEFLQRRKSDLSMVKDTXXLAIXRTNXLXXGGQKXWVAKGNGXQXLNSKPPXXXTGRRAXGVXEXXXPNQRPVLNPPPVVFRPPTLP

SEQ ID NO: 202413 - protein, 96 aa, Triticum aestivum
  unsure (1)..(96): unsure at all Xaa locations
  Clone ID: PAT_TA_96831.pep
MSCCGGNCGCGAGCKCGNGCGGCKMFPDVEATAGAAAMVMPTASHKGSXGGFETAGETGGXCDCTTCKCGPPAAAPAAAAXEPGPKXGXRQRRHED

SEQ ID NO: 202414 - protein, 61 aa, Triticum aestivum
  unsure (1)..(61): unsure at all Xaa locations
  Clone ID: PAT_TA_96832.pep
DRXXFSGGXXADPAGPXXDXXGDXNXXGVVXGCGXQRERRGRRRRTXGXTHDSLNRGGDAD

SEQ ID NO: 202415 - protein, 120 aa, Triticum aestivum
  unsure (1)..(120): unsure at all Xaa locations
  Clone ID: PAT_TA_96833.pep
LGVTKLLLVYPSKVCENCXEVHVGISGHKARMCGVFKFEGWRGKHKWKKAGVDDLVPQKIVWHQRPHDPPILVDSGRDYYGHAPAVVELCVQVGARASPKYNCMMKEHGLAPPVQRDQAT

SEQ ID NO: 202416 - protein, 86 aa, Triticum aestivum
  unsure (1)..(86): unsure at all Xaa locations
  Clone ID: PAT_TA_96834.pep
VHKXXVXEXDXRRRXIRXRRVGXXXXXLLARXRVAVXVARXRXXXVLARRRXRXARRRVAHGVSLSLDRCHPRNTGGVCLATLHCA

SEQ ID NO: 202417 - protein, 126 aa, Triticum aestivum
  unsure (1)..(126): unsure at all Xaa locations
  Clone ID: PAT_TA_96835.pep
VLLRPSSAPRLVADQSPNFSPLLFLPNLLAFYSWGSVVVFFPQLSFVSLFSFLPERSAACPLPPSLPLPSPSRLNPNWVGLEEXPNWGLIXXEEEEEDXHSXXRGCXLPHRSWDWXXASRTXLAHE

SEQ ID NO: 202418 - protein, 89 aa, Triticum aestivum
  unsure (1)..(89): unsure at all Xaa locations
  Clone ID: PAT_TA_96836.pep
TFXSGPGRXLRMRQAESPARRRXRGXGPKLNFEPGEMTGLASRLGWHARGRFQRALPRRHGGATRSRRRRRRLGLEEMKSWGFGWVAVG

SEQ ID NO: 202419 - protein, 56 aa, Triticum aestivum
  Clone ID: PAT_TA_96837.pep
DRVVSCAKSDCKLPRLLMIAYCICELCSVYTQGRSSRCYVVFSLSHRNFPPESMCR

SEQ ID NO: 202420 - protein, 51 aa, Triticum aestivum
  unsure (1)..(51): unsure at all Xaa locations
  Clone ID: PAT_TA_96838.pep
XIVXSSAAXXRGXLVKRXILAXXHPHSXXPPTTXATMXXAXALLLAAXLCL

SEQ ID NO: 202421 - protein, 83 aa, Triticum aestivum
  Clone ID: PAT_TA_96839.pep
ETFPIQILVDSAWISFLSHGDYSINTPHVRLCRFFFAKSLSRALERRSHLAGVPLPGALAPPLKLFHQLILSLQNNNEVELTS

SEQ ID NO: 202422 - protein, 91 aa, Triticum aestivum
  unsure (1)..(91): unsure at all Xaa locations
  Clone ID: PAT_TA_96840.pep
MAXXXYRCFMGGLAWATDDNNLQQAFSQYGEILDAXIINDRETXRSRGFGFVXFGXXDSXXXAIXEMNGXDLDXXNIXVNXAXXRXXGCWG

SEQ ID NO: 202423 - protein, 82 aa, Triticum aestivum
  unsure (1)..(82): unsure at all Xaa locations
  Clone ID: PAT_TA_96841.pep
MARRWRPSHLVFVAGVAYLILISLKFRRVLDLATADLAAVDSAFSSPSSTDNFPSPPRNSLLKCNLFKXKPFWNATTGSLPE

SEQ ID NO: 202424 - protein, 122 aa, Triticum aestivum; identical to SEQ ID NO: 179533
  Clone ID: PAT_TA_96842.pep

SEQ ID NO: 202425 - protein, 110 aa, Triticum aestivum
  unsure (1)..(110): unsure at all Xaa locations
  Clone ID: PAT_TA_96843.pep
MSSSEVACTLAALILHDDGIPITSEKIATVVKAAGIKVEAYWPALFAKLLEKRSVDDLILSVGSGGGGAPXAAAAAPAAGGAAAAEEKXXEKKEEGKEENDDDMGFNLFD

SEQ ID NO: 202426 - protein, 58 aa, Triticum aestivum
  Clone ID: PAT_TA_96844.pep
LRASSCSRHSPLPLRPFRGLGAVTWRLHTGRETDQRPGYGLWAFMGYGLDDSTCQLGL

SEQ ID NO: 202427 - protein, 138 aa, Triticum aestivum
  unsure (1)..(138): unsure at all Xaa locations
  Clone ID: PAT_TA_96845.pep
MAPKAAEKKPVEKTPAGKKPKAEKKVPASKEGGDKKGKKKXKKSVETYKIYIFKVLKQVHPDIGISSKAMSIMNSFINDIFEKLAGESAKLARYNKKPTITSREIQTSVRLVLPGEXLAKHAVSXGTRRHKTRLGLVR

SEQ ID NO: 202428 - protein, 181 aa, Triticum aestivum
  unsure (1)..(181): unsure at all Xaa locations
  Clone ID: PAT_TA_96846.pep
MKTFLILALLAIVATTATTAVRVPVPQLQLQNPSQQQPQEQVPLVQEQQFPGQQQPFPPQQPYPQPQPFPSQQPYLQLQPFPQPQLSYPQPQPFRPQQPYPQPQPQYSQPQQPISQQQQQQQQQQQQQQQILQQILQQQLIXCXDVVLQQHNIAHGSHKFARXYLQLXQQLCCXQLWKFPS

SEQ ID NO: 202429 - protein, 157 aa, Triticum aestivum
  unsure (1)..(157): unsure at all Xaa locations
  Clone ID: PAT_TA_96847.pep
MAGATMALSSPAMAGTPVKASRAAPFGEGRITMRKTAGKPKVAASSSPWYGSDRVLYLGPLSGDPPSYLTGEFPGDYGWDTAGLSADPEXFAKNRELEXIHCRWXMLGALGASSRELLARNGSIRRXVXLKXVQISKAAQYSTKLVKRISIGPQVNG

SEQ ID NO: 202430 - protein, 183 aa, Triticum aestivum
  unsure (1)..(183): unsure at all Xaa locations
  Clone ID: PAT_TA_96848.pep
QQPVLPQQPPFSQQQQPILPQQPPFSQQQQQPVLPQQQIPFVHPSILQQLNPCKVFLQQQCSPVAMPQSLARSQMLQQSSCHVMQQQCCQQLPQIPQQSRYEAIRAIIYSIILQEQQQVQGSIQSQQQXQPQQLGQCVSNPTXVATTIGXQPQQQQLXKVLFAAHXVLNRGDSMPYLQRCACN

SEQ ID NO: 202431 - protein, 188 aa, Triticum aestivum
  unsure (1)..(188): unsure at all Xaa locations
  Clone ID: PAT_TA_96849.pep
SPFPQQQQHQQLVQQQIPVVQPSILQQLNPCKLFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAXGTFXQPHQIXQLEVMTPXALRILPTMCXVNVPCTEHTSVHSTTELVLRIRK

SEQ ID NO: 202432 - protein, 183 aa, Triticum aestivum
  unsure (1)..(183): unsure at all Xaa locations
  Clone ID: PAT_TA_96850.pep
PANLVSDRPQARRILLPRRLKMQIFVKTLTGKTITLEVESSDTIDNVKAKIQDKEGIPPDQQRLIFAGKQLEDGRTLADYNIQKESTLHLVLRLRGGMQIFVKTLTGKTITLEVEXSSDTIDNVKAKIQGQGGIPPDQXQRLIFAGKXLEDGRTSLTTTSKKDQPQLVLRLLVDFGRPHKTYT

SEQ ID NO: 202433 - protein, 184 aa, Triticum aestivum
  unsure (1)..(184): unsure at all Xaa locations
  Clone ID: PAT_TA_96851.pep
SQQPYLQLQPFPQPQLPYSQPQPFRPQQPYPQPQPQYSQPQQPISQQQQQQQQQQQQQQQQQQKQILQQILQQQLIPCMDVVLQQHNIAHGRSQFCNKXLTKLLQELCXQHLWQXPGASQXCQGIQNVVQAIIXLHQQXKQQQQPSDQVSFQQXLQQYPFRQGXFRASQQNPXDKXLSTSTTAQ

SEQ ID NO: 202434 - protein, 174 aa, Triticum aestivum
  unsure (1)..(174): unsure at all Xaa locations
  Clone ID: PAT_TA_96852.pep
SFPQQQQPLIQPYLQQQMNPCKNYLLQQCNPVSLVSSLVSMILPRSDCQVMQQQCCQQLAQIPRQLQCAAIHSVVHSIVMQQEQQQGIQXLRPLFQSSKXQGIIQLNNHSYXXSXXLXLXPFXTMXNXFSXLXXPTINGQFANIXPGMDNGKWFMLIGNHCLDHNICMRINGVH

SEQ ID NO: 202435 - protein, 159 aa, Triticum aestivum
  unsure (1)..(159): unsure at all Xaa locations
  Clone ID: PAT_TA_96853.pep
MANPRVFFDMTVGGAPAGRIVMELYKDAVPRTVENFRALCTGEKGVGKSGKPLHYKGSSFHRVXIPDFMCQGGDFTKGNGTGGXSIYGEXXADEXFVHKHTXPGILSMGNXGPNTNGPILQSARPCNWSTATLVFGEVXXGMDSSRTSRSGSRXGTAQT

SEQ ID NO: 202436 - protein, 159 aa, Triticum aestivum
  unsure (1)..(159): unsure at all Xaa locations
  Clone ID: PAT_TA_96854.pep
MAPTVMASSATSVAPFQGLKSTAGLPVSRRSNGASLGSVSNGGRIRCMQVWPIEGIKNSETLSYLPPLSTEXLLKQVDYLIPSKWVLAXRFSKVGSSSRXAQPSPGYYDGRYWTCWNCYVPGALTHTXINEVEESRRXPDPIPHRFHKSQVHAHSPSTT

SEQ ID NO: 202437 - protein, 146 aa, Triticum aestivum
  unsure (1)..(146): unsure at all Xaa locations
  Clone ID: PAT_TA_96855.pep
MAPKAEKKPVAEKAEKTTTAKKTKAEKRPPASKEGGEKKGKKXSKKSVETYKIYIFKVLKQVHPXDIGSPPKAISINNXFINEFFQNFAXDSAKLGKXNKKPTFTXREFXTLVRFCXPGSXXXXLFPKGPRIYIYLLPLPMFPRFP

SEQ ID NO: 202438 - protein, 79 aa, Triticum aestivum
  unsure (1)..(79): unsure at all Xaa locations
  Clone ID: PAT_TA_96856.pep
WNGDHPFXRLKQDGHIYSRLXSLALMVPKYVGLGNRRRFAYLNVITLTQDRTXXHALVLSCEVVDPRRKASLFINVKEG

SEQ ID NO: 202439 - protein, 150 aa, Triticum aestivum
  unsure (1)..(150): unsure at all Xaa locations
  Clone ID: PAT_TA_96857.pep
PPKTVFDAFPHYKKWWPSWDPRRQLNCLQASVATAKFTDQIQRALARSGNPSVQXKHVVDECKTWDLVWVGKNKVAQLGAWMRWISARFPKGPHKGILKTERYSFLXDSFQVDTXAYHLTIXRTCXPXGVNVRPLPTGIXGGGPKAWNSP

SEQ ID NO: 202440 - protein, 121 aa, Triticum aestivum
  unsure (1)..(121): unsure at all Xaa locations
  Clone ID: PAT_TA_96858.pep
MGKEKIHISIVVIGHVDSGKSTTTGHLIYKLGGIDKRVIERFEKEAAEMNKRLSKYAWXVLTSSKAXRXRGITIDIAPVGNSETTSYPCTVNXCSLVNRNFNKDMITGTPKLDWXGLTIAH

SEQ ID NO: 202441 - protein, 154 aa, Triticum aestivum
  unsure (1)..(154): unsure at all Xaa locations
  Clone ID: PAT_TA_96859.pep
LQLASLCHSGHFLASTTAMATADVQNPSAALTEEAPAVEKPVAAEEVAKTEEAPAPVEAEVEAPAPSRFEETKEEAPGSILGRGDEGPRASNFRPNRRPSAALSXTKTKEXFVRKXRRRXRSLRKKPRLLPKATRXPLLLRTPXEDPRXVELNX

SEQ ID NO: 202442 - protein, 145 aa, Triticum aestivum
  unsure (1)..(145): unsure at all Xaa locations
  Clone ID: PAT_TA_96860.pep
AEALKGVKMELIDAAFPLLKGVVATTDVVEACTGVNVAVMVGGFPRKEGMERKDVMTKNVSIYKAQASALEAHAAPNCKVWVXANPANTNALILKXXAPSIPGEXIIVWTRLNTTRTPSDSEXXGVQFPDVKNAIILGXHPPSLP

SEQ ID NO: 202443 - protein, 138 aa, Triticum aestivum
  unsure (1)..(138): unsure at all Xaa locations
  Clone ID: PAT_TA_96861.pep
RPPVSAHLLRLRRRRTNRGSSDSSDQERRAGRKSTYAGGDEMGLTFTKLFSRLFAKKEMRILMVGLDAAGKTTILYKLKLXGEILTTIPTIXGFNVETVXEYKNISFTVXDFGXQDKLRXXXEXYFQDKKXQLVVATT

SEQ ID NO: 202444 - protein, 148 aa, Triticum aestivum
  unsure (1)..(148): unsure at all Xaa locations
  Clone ID: PAT_TA_96862.pep
MPAGHGLRSRTRDLFARPFRKKGYIPLTTYLRTYKVGEHVDVKVNGAVHKGMPHKFYHGRTGRVWNVTKRAIGVEINKQVXGNRIIKKRFHVRVGHFSIQVQRGFLQRNSTTTEAEQVRCEASHKSNHRPTGSCGGTQSAPTLHSQSR

SEQ ID NO: 202445 - protein, 126 aa, Triticum aestivum
  unsure (1)..(126): unsure at all Xaa locations
  Clone ID: PAT_TA_96863.pep
QQQQQQPPCSQQQQPFPQQQQPIIILQQSPFSQQQQPVLPQQQPVIILQQPPFSQQQQPVLPQQPPFSQQQQXXHXXQQPPFSQQQHPVLPQXXXIFTTTTIXISAASMQPSSXQPXFPQXHQQFX

SEQ ID NO: 202446 - protein, 97 aa, Triticum aestivum
  unsure (1)..(97): unsure at all Xaa locations
  Clone ID: PAT_TA_96864.pep
WIQYXGMQVXLKXXPLGXTSCLSRRRRWVPXPAAXXHGLAFSDRSSATXXHTMCCXHXCGNFTPGVEHYPEWNGHLASIFXXMXPIHSPELYCCQXA

SEQ ID NO: 202447 - protein, 182 aa, Triticum aestivum
  unsure (1)..(182): unsure at all Xaa locations
  Clone ID: PAT_TA_96865.pep
ATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAXAESXXFYXKXKGDXQKYLAXEFKAGAXKEGATXKTXVQNKSGQGHPAWXXXLXNHXPLXXGXSLNF

SEQ ID NO: 202448 - protein, 164 aa, Triticum aestivum
  unsure (1)..(164): unsure at all Xaa locations
  Clone ID: PAT_TA_96866.pep
ATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMXGDYHXYLAXEFXAGAXKKEXAENTXVXYKSGQGQSRLL

SEQ ID NO: 202449 - protein, 169 aa, Triticum aestivum
  unsure (1)..(169): unsure at all Xaa locations
  Clone ID: PAT_TA_96867.pep
ARHRPTLPLLFYRDLAIKTEPPARESSQPGTAQWKPPRPSRAPSPSSPAPAAPPAPRSPRRRRRASSRSAAPGRTPTSSDPSPPRRQAPPAPSSSARPAXAPSGRETTRRWKTASTARAPGKGXQQLRARGGERXRRXERQSRXIGGAYRKVAKAGSRTTRCCXRNLRK

SEQ ID NO: 202450 - protein, 173 aa, Triticum aestivum
  unsure (1)..(173): unsure at all Xaa locations
  Clone ID: PAT_TA_96868.pep
LSSLASSAAAAAAISSSPGCPPSKPFHDPKPLHLSVRLFSRFAKPQSLSCSGPHVPRAATGDGSGAGNRGGDSGGNGGKDGGGNDGDGGGEDDYEEAEFGPLLGFSEVXRLANARXVTLPXDMIEXXAKDAXIREWILLRIXDLQGRNKGSPPKDSGASQSAKMSPREISSVG

SEQ ID NO: 202451 - protein, 61 aa, Triticum aestivum
  unsure (1)..(61): unsure at all Xaa locations
  Clone ID: PAT_TA_96869.pep
MARERREIKRIESAAARQVTFSKRRRGLFXKAEELSVLCDAXVALIVFSSNRQFPSFALQL

SEQ ID NO: 202452 - protein, 44 aa, Triticum aestivum
  Clone ID: PAT_TA_96870.pep
FFFFHRTTICGLFNSQRQELTANSTIHVYTQPENFAPFRNSMLP

SEQ ID NO: 202453 - protein, 167 aa, Triticum aestivum
  unsure (1)..(167): unsure at all Xaa locations
  Clone ID: PAT_TA_96871.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVLTXVEXVXERSTLALSPQSTSDNNASRCGQLTRGEGPE

SEQ ID NO: 202454 - protein, 136 aa, Triticum aestivum
  unsure (1)..(136): unsure at all Xaa locations
  Clone ID: PAT_TA_96872.pep
MARTKQTARKSTGGKAPRKQLATKAARKSAPATGGVKKPHRFRPGTVALREIRKYQKSTELLIHKLPFQRLVREIAQDFKTDLRFQSSAVSALQEAAEAXLVGLFEDTNLCAIQAKRVTIMPKGIQXARRXRGEKG

SEQ ID NO: 202455 - protein, 141 aa, Triticum aestivum
  unsure (1)..(141): unsure at all Xaa locations
  Clone ID: PAT_TA_96873.pep
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRXQEVPTMXVTALRFNRDKRRAKVCNAWXGNCPTFDQPPNWGKPFFFGDPM

SEQ ID NO: 202456 - protein, 145 aa, Triticum aestivum
  unsure (1)..(145): unsure at all Xaa locations
  Clone ID: PAT_TA_96874.pep
MATDVQMGGGAAEAETFAFQAEINQLLSLIINTFYSNKEIFLRELISNSSDALDKIRFESLTDKSKLDAQPELFIRLVPDKATKTLSIIDSGVGMTKSDLVNNLGTIARSGTKEFMEALQAGADVSMIGQFGVXSXPAXLVAXKV

SEQ ID NO: 202457 - protein, 40 aa, Triticum aestivum
  unsure (1)..(40): unsure at all Xaa locations
  Clone ID: PAT_TA_96875.pep
SXXFXFFXSALXEWCTXVTSFSAXXLRLXDGXKLNLVWFH

SEQ ID NO: 202458 - protein, 61 aa, Triticum aestivum
  Clone ID: PAT_TA_96876.pep
FFFYHEGSVLTFILKPNTHVSCCITYPSRCNLTALVITHQNDHPRRRTSNVSHELNRLQEK

SEQ ID NO: 202459 - protein, 89 aa, Triticum aestivum; identical to SEQ ID NO: 130083
  Clone ID: PAT_TA_96877.pep

SEQ ID NO: 202460 - protein, 185 aa, Triticum aestivum
  unsure (1)..(185): unsure at all Xaa locations
  Clone ID: PAT_TA_96878.pep
GENTAHLVKHLLIVAMDKKAFDRCNAVHPFCYWFRVEGMDFAAEQKYMKGDYLEMMWKRNRFQQTILELGYTFLFTDVDILWFRDPFPRMPPAAQVVMSSDFFVGDPGSPGNYPNGGLLYVRSCAGSVGFYEHWQASRARFPGMHEQYVFDKIXKXGVPGRLGTXVXFLXTGRXRGVWQXGKXLG

SEQ ID NO: 202461 - protein, 54 aa, Triticum aestivum
  unsure (1)..(54): unsure at all Xaa locations
  Clone ID: PAT_TA_96879.pep
GCXREVRDLSQXQXLXGELGWXXLXXVRWEGXREEXEKRGREGVXWFASXISPX

SEQ ID NO: 202462 - protein, 96 aa, Triticum aestivum
  unsure (1)..(96): unsure at all Xaa locations
  Clone ID: PAT_TA_96880.pep
VSDGSCTPLGVHLQPRTPAPPLPLVPPLPPFFPSSPDARRPPXPAPATPPPTPPPGTTXAPCTASRCXCPLPVGTPPAXLPSRSXIPXPPXXLPIR

SEQ ID NO: 202463 - protein, 158 aa, Triticum aestivum
  unsure (1)..(158): unsure at all Xaa locations
  Clone ID: PAT_TA_96881.pep
HTCGRERNLSKQSAQQAEQCCAPAPATAPGRSPLRARPRRHTAAGASTSSARAAAQRSPPRMQSQVGAAPRTPSPARSPARPRSCAPARFSSPSASSTPGTAATGPASAPSPRTQRSAQARGLRRRASLPGPRTPGARRRRQLNLXKEXNSLTFRIVG

SEQ ID NO: 202464 - protein, 164 aa, Triticum aestivum
  unsure (1)..(164): unsure at all Xaa locations
  Clone ID: PAT_TA_96882.pep
QQQQPAIQSFLQQQMNPCKNFLLQQCNHVSLVSSLVSIILPRSDCQVMQQQCCQQLAQIPQQLQCAAIHSVAHSIIMQQEQQQGVPXLRHYLSSAQXXLGIIQPQQPSQXXGVXALGLGXLPTKWNVFVATGXXPTFNIPYANNRPXIWXQRMQDYPCLAPLVR

SEQ ID NO: 202465 - protein, 114 aa, Triticum aestivum
  Clone ID: PAT_TA_96883.pep
RRNTHTHREAKMSGRGKGGKGLGKGGAKRHRKVLRDNIQGITKPAIRRLARRGGVKRISGLIYEETRGVLKIFLENVIRDAVTYTEHARRKTVTTMDVVYALKATGPHLYGSGG

SEQ ID NO: 202466 - protein, 127 aa, Triticum aestivum
  unsure (1)..(127): unsure at all Xaa locations
  Clone ID: PAT_TA_96884.pep
KIPSFPFQLLLAPILLLSRRCGSPQTSTTTTTTSRARDGARRKLGQSGSVGRFPGRRRYFTTPADSPTEDQTPTPPQPSCRRPPNPRGAFIHRGFLVVSRAXGGAAAGLLPPRWPHIAPGLDPLVFG

SEQ ID NO: 202467 - protein, 145 aa, Triticum aestivum
  unsure (1)..(145): unsure at all Xaa locations
  Clone ID: PAT_TA_96885.pep
MKFIAAYLLAYLSGNASPSAEDLTSILESVGCEIDNEKMELMLSQVKGKDITELLAAXGREKFAAVPXGGGGVAVSTAAPAAXGGAAAPAAESKKEEKXXEKEESDDDXGSIXFRLIVGVSELPLGKETKKVLPLFFKGNVLKVI

SEQ ID NO: 202468 - protein, 162 aa, Triticum aestivum
  Clone ID: PAT_TA_96886.pep
MKTFLIFALLAIVATSAIAQMENSHIPGLERPSQQQPLPPQQTLSHHQQQQPIQQQPQPFSQQQPCSQQQQQPLSQQQQPPFSQQQPPFSQQQQQPLSQQQQPPFSQQQPPFSQQQQPPFSQQQPPFSQQQQPVLPQQHQFHNNYNIFTATSRFPTTTRTTT

SEQ ID NO: 202469 - protein, 95 aa, Triticum aestivum
  unsure (1)..(95): unsure at all Xaa locations
  Clone ID: PAT_TA_96887.pep
AKMRFTLALLVTFAFLILVSDGKTQHCTETTIGQSGGCSASSCQNGCNQKYKNVCHPNDECIWKANCVGTTCKCTVCTFSSFPMQASKKGNNDAX

SEQ ID NO: 202470 - protein, 133 aa, Triticum aestivum
  unsure (1)..(133): unsure at all Xaa locations
  Clone ID: PAT_TA_96888.pep
XQLLXSVSPPXSPWTQAEHXLDGAQPLALLPHGPNKFLANKHSPTGRRTNTGRSVRSAPPRSITSYPRSGAGRMPRRQGKRTHKRARLYRCRQSAGEPPPVQPNGSFCGSKVRRAGRAGECPCGAVRWRAATN

SEQ ID NO: 202471 - protein, 127 aa, Triticum aestivum
  unsure (1)..(127): unsure at all Xaa locations
  Clone ID: PAT_TA_96889.pep
MPRSSSSAPRILGRAMXILTLPLTPLSKARAATTLLLFKRRRARRLRHYNYAYVGEXQFSPSGSPLLXPRPPGVSXXRAXWXSRVXTVLAALLCXGXCMXQRAXIGXGXIDVAVLXGLXVCPQLDDQ

SEQ ID NO: 202472 - protein, 152 aa, Triticum aestivum
  unsure (1)..(152): unsure at all Xaa locations
  Clone ID: PAT_TA_96890.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIKKLSDNCTGLQGFXLVLKAFGGGTGSWPWV

SEQ ID NO: 202473 - protein, 70 aa, Triticum aestivum
  unsure (1)..(70): unsure at all Xaa locations
  Clone ID: PAT_TA_96891.pep
RKXXRRXQXRXRRQTVMTMAGRRWXFXCXGXWXGPRGGQEGRFERPHPXHXGAXYRXATQPQGPEXYSIP

SEQ ID NO: 202474 - protein, 177 aa, Triticum aestivum
  unsure (1)..(177): unsure at all Xaa locations
  Clone ID: PAT_TA_96892.pep
MSPQTETKAGVGFKAGVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGSVTNMFTSIVGNVFXFKALRALRLEDLRIPPTYSKTFQRPASMVSKVXRDKXNKXGXXLMGCSNSP

SEQ ID NO: 202475 - protein, 162 aa, Triticum aestivum
  unsure (1)..(162): unsure at all Xaa locations
  Clone ID: PAT_TA_96893.pep
MQIFVKTLTGKTITLEVESSDTIDNVKAKIQDKEGIPPDQQRLIFAGKQLEDGRTLADYNIQKESTXLHLVLKTRGGMQIFXVKTXTGKTITXSXPPTTSTTSXASSRQGGIPPDKSVSFCWQALEDGXTLADYNIQKDPHPPGAQXRGXMQXFVQDLTGKT

SEQ ID NO: 202476 - protein, 85 aa, Triticum aestivum
  unsure (1)..(85): unsure at all Xaa locations
  Clone ID: PAT_TA_96894.pep
PLLSSPLPHKHARKVLRPPPPPRXAPPRSSSSPPARPPGPSSPPPPXPPXXPPSQKGKQPLQTSGIPPRKSQIQKFPRKGFAIPP

SEQ ID NO: 202477 - protein, 96 aa, Triticum aestivum
  unsure (1)..(96): unsure at all Xaa locations
  Clone ID: PAT_TA_96895.pep
RKVSCHGAATWLLQKTVEMHIILGIAPQNEGSRGAMELLGYDEDNGVLFLYAAAYVYMVELMSMQSNELHLSNLXNKCHPFTCFYAPTILGGRNGT

SEQ ID NO: 202478 - protein, 49 aa, Triticum aestivum
  Clone ID: PAT_TA_96896.pep
VVVVVVVVVVEERGGMHGICLIDLILVIRNYNCGACLVWSLPCKKEKNV

SEQ ID NO: 202479 - protein, 162 aa, Triticum aestivum
  unsure (1)..(162): unsure at all Xaa locations
  Clone ID: PAT_TA_96897.pep
APTNGTNKSPSRSRLRSTPAPPPPVLPHRPKMQIFVKTLTGKTITLEVESSDTIDNVKAKIQDKEGIPPDQQRLIFAGKQXEDGRTLADYNIQKESTLHLVLRLRGGMQIFCQDLTGKTITLEVESPDTSTCPRRXFKDKEGIPPGQQRXXFSGKXLEDGGP

SEQ ID NO: 202480 - protein, 118 aa, Triticum aestivum
  Clone ID: PAT_TA_96898.pep
FLRVKFLFSCFSCTNSLSQTDLFLSWEGSCAAPRKGGMIFIFTSQTGVPRPSVSGIALCHTTAPRTAPAHDPKRTSALFGFRPFRTAIDSKMDTCIRSLLKAPSAATESKLSAYPSAP

SEQ ID NO: 202481 - protein, 121 aa, Triticum aestivum
  unsure (1)..(121): unsure at all Xaa locations
  Clone ID: PAT_TA_96899.pep
MPAGHGLRSRTRDLFARPFRKKGYIPLTTYLRTYKVGEHVDVKVNGAVHKGMPHKFYHGRTGRVWNVTKRAIGVEINKQVGNRIIKKRIHVRVEHXQHPGATRILQEELNNDKLKAEAXCW

SEQ ID NO: 202482 - protein, 134 aa, Triticum aestivum
  unsure (1)..(134): unsure at all Xaa locations
  Clone ID: PAT_TA_96900.pep
ETQENCCGKTMRSPQALSLLVVVLLLASSSASVIEDTCRRFDGADIYDICIKFFKANKDSATTDKRGLAVIAIGIAKCDSCGHPQARRHPEGRGKGSNYPSMSSPTVTICTPVLWAYLXXLARGISVGQVGATQ

SEQ ID NO: 202483 - protein, 70 aa, Triticum aestivum
  unsure (1)..(70): unsure at all Xaa locations
  Clone ID: PAT_TA_96901.pep
LHVXTKANVFPWTXSRPLXTAWQHSFSATGFEPGFVGGLKASKHLSLMVVTNWLPIISTHDFESTGNGRL

SEQ ID NO: 202484 - protein, 98 aa, Triticum aestivum
  Clone ID: PAT_TA_96902.pep
PSLSLELESPSSPRITTTVSDGHRLNSGEPSSPSTSSPHHQFPRAPAILPNPSPSRRSRCGHSAPSLAAAQSLYIHEPPPLQSSPLRARQLDEWGTSP

SEQ ID NO: 202485 - protein, 160 aa, Triticum aestivum
  unsure (1)..(160): unsure at all Xaa locations
  Clone ID: PAT_TA_96903.pep
CCGPGLGCAIVGPPASNSRSHTKLGIERRGSTSHTKQPAKVGWIHGLPTKKAWIHGRRAAACECECDRGQEDLGRSSVPGSCPAAQRLGALHGLRPRRLLRIGLRNRLRTRPLPRPLQPRPPSFCGATKPTDAEXAXVTALXIGILLRYTPSGRRRXWGL

SEQ ID NO: 202486 - protein, 159 aa, Triticum aestivum
  Clone ID: PAT_TA_96904.pep
KVAGKKFGGPRKKSVTRSVKAGLQFPVGRIGRFLKKGRYAQRVGSGAPVYLAAVLEYLAAEVLELAGNAAKDNKKSRIVPRHLLLAIRNDQELGRLLSGVTIAHGGVIPNINPVLLPKKAAEKAEKAGTAAKSPKKATSPQESHKGLCYNGVLNGPSLG

SEQ ID NO: 202487 - protein, 160 aa, Triticum aestivum
  unsure (1)..(160): unsure at all Xaa locations
  Clone ID: PAT_TA_96905.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAXYCTGXLLLARRVLKNPXLMKXFEGNVXGXXVKDFXVEPSDXXEGFSAPWVGALRANQLGNPR

SEQ ID NO: 202488 - protein, 79 aa, Triticum aestivum
  Clone ID: PAT_TA_96906.pep
FTHRSCEYVTPSYFSYIFHPHTIVLHQSIACLYHASMSSEERFYSFVLWVCLDMAKSKKSKEKNIVGNGVTRRVKGKRI

SEQ ID NO: 202489 - protein, 158 aa, Triticum aestivum
  unsure (1)..(158): unsure at all Xaa locations
  Clone ID: PAT_TA_96907.pep
MPPKAEKKPAAKKPAEEEPAAEKAAEKAPAAKKPKAEKRLPAGKTASKEAGGEAKTRGRKKGSKAKKSVETYKIYIFKVLKQVHPDIGISSKAMSIMNSFINDIFEXKLAAXAAKLARYNKXKPNITSREIQTSVGSSSPGNSPKQAVSEGNKGVTNS

SEQ ID NO: 202490 - protein, 127 aa, Triticum aestivum
  unsure (1)..(127): unsure at all Xaa locations
  Clone ID: PAT_TA_96908.pep
KXINFGXGRKNNRDKLKSIGLKGKDLCERHKKEVLXPWQTTWGGYQGRRAWKFPGLSRXQSRGPNXEXGEGSFLGPXWFKKXGLTGERRKFFLTSLVEGSPGWGNXPWFQCXVGXXXIDPLXSXHKG

SEQ ID NO: 202491 - protein, 197 aa, Triticum aestivum
  unsure (1)..(197): unsure at all Xaa locations
  Clone ID: PAT_TA_96909.pep
XSQAIHGAQDVRQDGDAARCRGRRDRARARRXRRQRRGXSGPHYPRREGSGRGAGTRREXRRPGXKKXRGVARHVXTTGPXGXAAPGPXDXPPAAPKLXAGQTKGXXXKLSPSAPPSGXPPAXRREGPLXRSTGKPGNQANXQATRWXFPFXXGNXXKXAPMQGXNGRFPFRFPSKXSNXVSNXXGXXXXRPCCLAF

SEQ ID NO: 202492 - protein, 118 aa, Triticum aestivum
  unsure (1)..(118): unsure at all Xaa locations
  Clone ID: PAT_TA_96910.pep
EXPGXXPXGGRXEPPVLSSGFGEXKLRXSXEXGXGVVRXVXIXGPXEXVXGGGXXXPKKQXVSPARQXXELRSPVGSXALFXPSCSRPXSRLLLRXRPASMAAETLTLGRSGSVXSRR

SEQ ID NO: 202493 - protein, 76 aa, Triticum aestivum; identical to SEQ ID NO: 185994
  Clone ID: PAT_TA_96911.pep

SEQ ID NO: 202494 - protein, 103 aa, Triticum aestivum
  unsure (1)..(103): unsure at all Xaa locations
  Clone ID: PAT_TA_96912.pep
TIPTATATTISPAXXAQXXSSXNPNXHSLXNHNXHSXGNHXXPFLQXPXXPSPQPQQVVQIIPQATPTXIPSCVVKPXXSNLIXXKQPIXSXGTXQXGXPXXX

SEQ ID NO: 202495 - protein, 190 aa, Triticum aestivum
  unsure (1)..(190): unsure at all Xaa locations
  Clone ID: PAT_TA_96913.pep
XVRPMPNXAPXDYLFIFERFITPGSRQGYKDYNTXGSLRDXIXILSXXXRXEWXXQXXGNSAXRFXXVEAPGRLXRGXFXLGXLDSPSXASTPSVPLFGEXRRGXPGDVGRRPLDXLGERAGGLAARRRARSRRRAPXXXRPAXXRRPLXADGDVDRLGRVXAVVRXXLXRXQLRRHLDLAXRAAXGRXA

SEQ ID NO: 202496 - protein, 46 aa, Triticum aestivum
  Clone ID: PAT_TA_96914.pep
SPLVFFFFFFFFFFFLEIYITLALTNTIRVPVRCHGLLKKFTRVTC

SEQ ID NO: 202497 - protein, 137 aa, Triticum aestivum
  unsure (1)..(137): unsure at all Xaa locations
  Clone ID: PAT_TA_96915.pep
MAAKCYPTVSDEYLAAVAKAKRKLRGFIAEXNCAPLMLRLAWHSAGTFDVXTXTGGPFXTMKCPAXLAHXAXAXLXIAVRLLEPIKXQFPILSYADFXXLAGVVAXXVTGGPEVPFHPGRXQDKAEPPPKRRLPDVT

SEQ ID NO: 202498 - protein, 114 aa, Triticum aestivum
  unsure (1)..(114): unsure at all Xaa locations
  Clone ID: PAT_TA_96916.pep
MAPXRKPAEPPRDAEGIFRGVSAFFVPHGVQPRRLEVWKXKLVQMGGRLDKKXXGAKGAXINHVLXADAXALLRELGARLSPLHGERGVLLAGGVQIARGCPSSPSTTEEFKPG

SEQ ID NO: 202499 - protein, 66 aa, Triticum aestivum
  unsure (1)..(66): unsure at all Xaa locations
  Clone ID: PAT_TA_96917.pep
SLTSVESSWTRLCSLQALSDCSWYCLECIXGFYPFIPRKFYRLLGQIVPSLSNDPMTSNIQGVGAW

SEQ ID NO: 202500 - protein, 168 aa, Triticum aestivum
  unsure (1)..(168): unsure at all Xaa locations
  Clone ID: PAT_TA_96918.pep
VTNSPKSIPNPVPSDXSPPPPCRRRSRKQRYYCHQVRPRRRHRRPRLPRRRGLLPALRRGVRRGAPRRRGPPSPHAAAVPLLPPRQASXPPQPQRPRRGPXXRHPPPRPAPPPPPPTQTTKFDVNRLPPRAPRGAPLGRGPTSKSRGLLLPAGFASFKGGPSRGGQAR

SEQ ID NO: 202501 - protein, 159 aa, Triticum aestivum
  unsure (1)..(159): unsure at all Xaa locations
  Clone ID: PAT_TA_96919.pep
KLKXERERGINIDIALWKFETTKYYCTVIDAPGHRDFIKNMITGTSQADCAVLIIDSTTGGFEAGISKDGQTREHALLAFTLGVKQMICCCNKMDATTPXYSKARYEEIVKEXVSSYLKKVGYNPDKVPFVXPISGFEGDNNXXXGPPTLDWYKGPYPF

SEQ ID NO: 202502 - protein, 166 aa, Triticum aestivum
  unsure (1)..(166): unsure at all Xaa locations
  Clone ID: PAT_TA_96920.pep
PKVAASXSPWYGSDRVLYLGPLSGDPPSYLTGEFPGDYGWDTAGLSADPETFAKNRELEVIHCRWAMLGALGCVFPELLAXRNGVXFGEARVGSXAGSQXLQXKGRPXLPRXKPXLGXCXRGILAIWACQXXLLPPLGVPGRAGPLGDRCPRSYPREGPPLGSPEG

SEQ ID NO: 202503 - protein, 182 aa, Triticum aestivum
  unsure (1)..(182): unsure at all Xaa locations
  Clone ID: PAT_TA_96921.pep
GPPXPXXSRLISXGRTGRVLYWLRAGRXAASXFXXXYDHPPASDLXPNGLLWYCCXGXTGLAPXGFFWXAXGLXASTRSLLGSVFLGXLXSQRXPGASSLXASTXTGADASTSASTXAGTSXVFGASSAATGVSTGGXLLRQRGRRVXDISGXHYRCGCKKMPGVXEXXXPEASACVTLWXI

SEQ ID NO: 202504 - protein, 138 aa, Triticum aestivum
  unsure (1)..(138): unsure at all Xaa locations
  Clone ID: PAT_TA_96922.pep
KTLXFPPKNLPGASTNILLXMXPSLLAXAASPFXLHAAAGKRQPRGRVSAAAATGAPAPXSSRARARRQSSATLPXVGNXQSGPGCXVXSPRLSPXEICXGGSPCYQKIXLVXNXXRYFVXGRRFLIAXXVLNGXLKL

SEQ ID NO: 202505 - protein, 85 aa, Triticum aestivum
  unsure (1)..(85): unsure at all Xaa locations
  Clone ID: PAT_TA_96923.pep
RMXHXHXALPDEXAPSPRXSXSRXLYTSXXXPHPATDTVTDTGASESASVGVXLXEGXXGHHREGKGRVPXGPGGAXXXSQVLXF

SEQ ID NO: 202506 - protein, 152 aa, Triticum aestivum
  unsure (1)..(152): unsure at all Xaa locations
  Clone ID: PAT_TA_96924.pep
MXXFVKTLTGKTITLEVESSDTIDNVKXKIQDKEGIPPDQQRLIFAGKQLEDGRTLADYNIQXKESXLHLVLRLRGGXRKRKKKTYTKPKKXKHXXTKKVKLAVLQFYKVXHAGGDQGSRELPKRRLGPGTLWQTSTAIIGSWGSTKSNKKG

SEQ ID NO: 202507 - protein, 145 aa, Triticum aestivum
  Clone ID: PAT_TA_96925.pep
RTGSSADGTGPSTSSSYSTADADDNGTAGGAKVWLLVLLFSLLLLLFLPSAVRRGGGGFQRGGITLKSGWDVVNLCLVLFAILCGLLGRGGGDGDGEPPGPAAPAPKSHLRVSPAAAATPEPSTEDVWASFNKLLHQSTPRGFGG

SEQ ID NO: 202508 - protein, 135 aa, Triticum aestivum
  Clone ID: PAT_TA_96926.pep
FQEALIVAEAYSINQPMEWAPVFWNQMLKPDLIELFVAEFVLVLPLHPPMLVELARFYRAEVAARGDQSHFSVWLSPGGLPAEWGKHLGRSFRSLLRRTRDMRLRLQLATLATGFSDVLEGCNASSGQGPRTPGR

SEQ ID NO: 202509 - protein, 147 aa, Triticum aestivum
  unsure (1)..(147): unsure at all Xaa locations
  Clone ID: PAT_TA_96927.pep
MSAYCGKYKDELIKNAAYIGTPGKGILAADESTGTIGKRFASINVENVEDNRRALRELLFCTPGALQYLSGVILFEETLYQXTKGGKPFVDILKAGNVLPGIKVDKGTIELAGTNGETTTQGFDDLGKRCAKYYEAGARFAKWGAVL

SEQ ID NO: 202510 - protein, 75 aa, Triticum aestivum
  unsure (1)..(75): unsure at all Xaa locations
  Clone ID: PAT_TA_96928.pep
SPNLAXVFGDAGSRSSSRRGCGGRPVRAMATCEAGLWRRRSGAXAATRFVSRLSLRLSHLIHNAFLLDSSCVSPL

SEQ ID NO: 202511 - protein, 110 aa, Triticum aestivum
  unsure (1)..(110): unsure at all Xaa locations
  Clone ID: PAT_TA_96929.pep
PSRFEAIWLSSVXXQPPSXPLTPIHGXGXLLGTIXXGHQRGXLIPXRVPLYGGLXXMTMAXXTXRPLGEDTTVXDVGXSTLADDASPSRERSRERGXRSRRRGLASXPXQ

SEQ ID NO: 202512 - protein, 112 aa, Triticum aestivum
  unsure (1)..(112): unsure at all Xaa locations
  Clone ID: PAT_TA_96930.pep
EQFNHRXPEDXILIVNXCWXIXXDGSCREQGXPPGHXXGAGAGXXAXAXGRXRGADVLXRXQXADARAXXXCNRGGAGSAGSXAXGIKNXPXPRGXXXXPRXAFGPXXALPS

SEQ ID NO: 202513 - protein, 169 aa, Triticum aestivum
  unsure (1)..(169): unsure at all Xaa locations
  Clone ID: PAT_TA_96931.pep
VAATNNFAHDTVIGQGSSGKVYRGRLHDGREVAIKRINNDDYSIKAFXTELHTLSRXQHKHIVHLLGSCVTVSKEKRLARTQQKRKKGLLTRRXKEPEEPQRLVVYEYMKNGTLFDQLHADXGSSTLXPVTVSWKMRIDVLLXVSCAIQXLHCHXKPPIIHPGQSRVTT

SEQ ID NO: 202514 - protein, 145 aa, Triticum aestivum
  unsure (1)..(145): unsure at all Xaa locations
  Clone ID: PAT_TA_96932.pep
MAGATMXLSSPAMAGNPVXGSXAAPFGEGRITMRKTXGKXQVXXSNNPWYXSERVLXLGPLSXEPPSXLTXEFPGDXXWDNAGLSAEPENFAXNRELEVXXARWAKLGALGVRFPGXLARNGVKFGEXXWFKXAXSKFSXXXGLE

SEQ ID NO: 202515 - protein, 146 aa, Triticum aestivum
  unsure (1)..(146): unsure at all Xaa locations
  Clone ID: PAT_TA_96933.pep
QPISQXQAXQQXQQQQQQILQQILQQQQLIPCRDVIVLQQHNIAHESSQVLQXQSSYQVLQQLCCQXLRQIPEQSRCQAINNVVHAIILHQQQQQQGQHQQSXXVSYQQAXKQYPSXQGXLPAISSKNPQGPRALSXPQHLPXTRG

SEQ ID NO: 202516 - protein, 174 aa, Triticum aestivum
  unsure (1)..(174): unsure at all Xaa locations
  Clone ID: PAT_TA_96934.pep
PQYSQTQQPISQQXQQAASKQQQQQQILQQILQQQLIPCRDVVLQQHXSIAHGSSQVLQQSTYQLVQQLCCQQLWQIPEQSRCQAIHNVVHAIILHQQQQQQQQQQQQQQQQPLSQVCFQQSQQQYPSXQXSFQXPSQQNPQGQGLCPSLNNWPKFEEIREPXAXETLPAMCNV

SEQ ID NO: 202517 - protein, 75 aa, Triticum aestivum
  Clone ID: PAT_TA_96935.pep
LLHGFTPTTYLARVCHLDLNLAPSSIPIYKPTRCREEIISQSQSSATLLHHTSFASNYLHTTERERERERERERE

SEQ ID NO: 202518 - protein, 69 aa, Triticum aestivum
  unsure (1)..(69): unsure at all Xaa locations
  Clone ID: PAT_TA_96936.pep
PPPPSLSLSLSKRXTTSLXTPTXAXVSVPVHPQSPTCVASRADSXRAAPDAGTPTSSKXVXXIIXXXXS

SEQ ID NO: 202519 - protein, 154 aa, Triticum aestivum
  unsure (1)..(154): unsure at all Xaa locations
  Clone ID: PAT_TA_96937.pep
MAAAASRHLCSATALLSPSAAAAPIRQRVGYGYGSSSARRWAHRPDAASRIRRLTTRSRTARVSCAYSTGAEAITACSWNQNVICSDVPVLVEFWASWCGPCKMVHRIVDEIAGEYAGRXKCYKLDTDDXPQTANSYNIERVPTVLLIXGWRRK

SEQ ID NO: 202520 - protein, 105 aa, Triticum aestivum
  unsure (1)..(105): unsure at all Xaa locations
  Clone ID: PAT_TA_96938.pep
MGKIKXXINGFXRXGRXXPXVTLQSDDVXLVAVXEPFITXEYMTYMFKYENVXGHWXHXDIKLKXDKTLLFXEKPXNVFXVRKPXEIXXGEGGGPLNCSPTGGLY

SEQ ID NO: 202521 - protein, 93 aa, Triticum aestivum
  unsure (1)..(93): unsure at all Xaa locations
  Clone ID: PAT_TA_96939.pep
XPAXVLXXLPRETSSRRCPSPTTVAPPARXERXRQWDVXXXPPQRRXGDGTPXNRVSXGXKXPCQXXHXXLXIGNPRTXXXFRLVFXXXKLPI

SEQ ID NO: 202522 - protein, 70 aa, Triticum aestivum
  unsure (1)..(70): unsure at all Xaa locations
  Clone ID: PAT_TA_96940.pep
NLAKKYXKLLXSHWRNSFXRXXEEXQXGXYPXXCGXPPPVXKXXXTEAFLXIRLXLKAPNXFQXKEETIV

SEQ ID NO: 202523 - protein, 154 aa, Triticum aestivum
  unsure (1)..(154): unsure at all Xaa locations
  Clone ID: PAT_TA_96941.pep
MPAGHGLRSRTRDLFARPFRKKGYIPLTTYLRTYKVGEHVXVKVNGAVHKGMPHKFYHGRTGRVCNVTKRAIGVEINKQVGNRIIKKRIHVRVEHVXPSRCXTREFLQRKLNNDXPXXAEAXARGEVINNXXATNKGQSXGFMXEGHHPRRSPP

SEQ ID NO: 202524 - protein, 89 aa, Triticum aestivum
  unsure (1)..(89): unsure at all Xaa locations
  Clone ID: PAT_TA_96942.pep
RVPXXXLXEIFYPLYPGGEXSNPFWLTXEXGXFAELKXKGNQKXAPCKVLXVWXICXXQPSLVKXRXEKTXLNNXPDPVKKKKAWGLSP

SEQ ID NO: 202525 - protein, 120 aa, Triticum aestivum
  unsure (1)..(120): unsure at all Xaa locations
  Clone ID: PAT_TA_96943.pep
NXTPTXSALPSGXNNGLNGGSCPPDGAPNAXGTXEEGXPPXRXGVPXWDXVXXXVTMVEHVHKQRDWVVTKSIXXSQRHXHQXASTRSXPCSPSGXVCFFPSXKGFXSXTSEVLQGGKGG

SEQ ID NO: 202526 - protein, 156 aa, Triticum aestivum
  unsure (1)..(156): unsure at all Xaa locations
  Clone ID: PAT_TA_96944.pep
QGQRGIXCFSXLXVPLXSLGLSGQXFLQYAPTXKGAPSGGRGTTTXDLLXRSTXNXMGTKRXXPXSVLPTXDXDEDNVYRRXXYTPKSFREDSVEVXCLNNVPPLPGXLSSPSLSKFKTNGVTWEGDNSQGVRAKWSWGNPCLFXPGFYENPXLQY

SEQ ID NO: 202527 - protein, 57 aa, Triticum aestivum
  unsure (1)..(57): unsure at all Xaa locations
  Clone ID: PAT_TA_96945.pep
CSXNXLLTCSFXNLXPPGAXFGIXISXSDNSXPPPFAGXXAAFQPXXQHKRTXSRSH

SEQ ID NO: 202528 - protein, 64 aa, Triticum aestivum
  unsure (1)..(64): unsure at all Xaa locations
  Clone ID: PAT_TA_96946.pep
LQXSXRGCLHPVRXLWAXGXGSXTKKNPXKXSCCSAXVTNXEXKAXTVANSKQDEEGXIXNQLF

SEQ ID NO: 202529 - protein, 124 aa, Triticum aestivum
  unsure (1)..(124): unsure at all Xaa locations
  Clone ID: PAT_TA_96947.pep
XXYFXSXRRXKLLCPLKTDLLVKMQKKKKKNSXGGGPVTKFXPKXGVVXRAAHWAVVFXNVXEXGEKPXGVTPXLXPPLXEKTPLSXXXGVXXXKKGXPXDXXLPQKILXNLNXEWGPPLXPXX

SEQ ID NO: 202530 - protein, 91 aa, Triticum aestivum
  unsure (1)..(91): unsure at all Xaa locations
  Clone ID: PAT_TA_96948.pep
RRXGLFGLXXGRHPPHXYHHPXXYISCSXSENPGXXKXXPNXXXSXLXFSIXFXFXSPLEKPXXQLPVXXLDXQAXAHSFGGXTQKFAKIF

SEQ ID NO: 202531 - protein, 124 aa, Triticum aestivum
  unsure (1)..(124): unsure at all Xaa locations
  Clone ID: PAT_TA_96949.pep
MGRLXNKGVVSAXVLAGVXLMMXGXEXTGLXCGXVDSKLXAPCVSYVTGKXPXIXKECCSXVQGVNGLGPNNPDRKITCKCXKNLXNNIKFINNXXKASRXXRXSAGVKRCPFPSXMSTXWEMN

SEQ ID NO: 202532 - protein, 189 aa, Triticum aestivum
  unsure (1)..(189): unsure at all Xaa locations
  Clone ID: PAT_TA_96950.pep
TILRETVRPKQKRKKDIQVASYXKSGXXGEKFSTIRTNFGSKIFPKPRXKAALGGVTLHKLQGLFLSXSQTMXPPGXPPPLNGLWGGNKWESXWLSKWXSLRSXVLGXDKVLKPTSNXXFLVAXXLPAFSFKQHNWQGXLDKLXANXTPQSGWGLNPNNRLRFRWXXPNNPXTLXPFXASGPXANSXXL

SEQ ID NO: 202533 - protein, 88 aa, Triticum aestivum
  unsure (1)..(88): unsure at all Xaa locations
  Clone ID: PAT_TA_96951.pep
GKXAXPGLXPLGRYLLFPEGXFWFFSPRSPKEXEPLMXKRITCXXDXPQKVNLRPFVLFFPGSVPQSXWXKLGPPDVVWRPPXRFXXX

SEQ ID NO: 202534 - protein, 159 aa, Triticum aestivum
  unsure (1)..(159): unsure at all Xaa locations
  Clone ID: PAT_TA_96952.pep
AKKEAXPGXGXPXQIXVPPPRNKMGGXXMRKXPRELTRARAPXRRRRXGGPRSXXASXKPXVSXMEXKGEGRPLQXLLLNLRNGVEXKAXXRKGNXFVXIQKLXKXFRFXPXYQTGAWDGCLXFSVKXGXPKRXKEXGGKKXKKXFSPRLKXYFXXPXX

SEQ ID NO: 202535 - protein, 118 aa, Triticum aestivum
  unsure (1)..(118): unsure at all Xaa locations
  Clone ID: PAT_TA_96953.pep
KKNGEPQXIXMLISNXKXWANGVSESLXKNNTXDGXKNLXIXYXQEKTLXGSSXYYAKYLXTRFNKGGXKLNWGLXNFXXGPTSXLEIGDXVQPXMXLCSINTPKEPSLSXKKLPLKT

SEQ ID NO: 202536 - protein, 155 aa, Triticum aestivum
  unsure (1)..(155): unsure at all Xaa locations
  Clone ID: PAT_TA_96954.pep
MGTVXXSLXWELXRKNXCXLXXQFXNXNAKVQFXXXPNNLYNXHSYKXSGLANKXXVTVXPTADXEMNVVLSTXKSKKQNKPAGFTHKTVMRKXFRKMGXXIKKXVSGNYYKXDXDKPXLQXWSAVYRXLQXXQSPVSKXKKKGTGGGQMSFWVC

SEQ ID NO: 202537 - protein, 146 aa, Triticum aestivum
  unsure (1)..(146): unsure at all Xaa locations
  Clone ID: PAT_TA_96955.pep
KXALPXXSXMGRGPLQRXPLXPXPRXXNXRGXKXAGPTXNWKPXATXSXSMRASXQIKLKENCNGIGLIEXERIINYCNESXSRVXFXFKIXNPKXKTRFIXSYPSLXLWXFKKKKKKKSXGGXPVPXFPPKMNSXNPPXKXPSXL

SEQ ID NO: 202538 - protein, 122 aa, Triticum aestivum
  unsure (1)..(122): unsure at all Xaa locations
  Clone ID: PAT_TA_96956.pep
LFLPFFPLFXAFXGRPRLRXAVWEVXFCXVVGGXGXFPXNXSGXYPXGGXPLGQVEFXRLANRAFXWXAPKLFGLGVGXXKXRXXSGTGXXITSFFCPMXERRGRXXFVHHCXCAAPFPXPP

SEQ ID NO: 202539 - protein, 60 aa, Triticum aestivum
  unsure (1)..(60): unsure at all Xaa locations
  Clone ID: PAT_TA_96957.pep
QSPXAXKPKXXSPSTXQCLNLXSSFPFGGNNRPXGXTXNQEXXXDXNNRCFXAAXSVQPS

SEQ ID NO: 202540 - protein, 64 aa, Triticum aestivum
  unsure (1)..(64): unsure at all Xaa locations
  Clone ID: PAT_TA_96958.pep
SRVXPRGPGVXXKYGEXGXFXXXRGVNXGSPRVKXPNDXPKXXSKXGERWXKXXKIWXSPPGFT

SEQ ID NO: 202541 - protein, 201 aa, Triticum aestivum
  unsure (1)..(201): unsure at all Xaa locations
  Clone ID: PAT_TA_96959.pep
XLPFPIGFHFXXQLKXLXPXIRDXCPNXKXGISLFFFWDXLTSPIXKFXXSRFQHXPCFRXITXXFEGLPSKFEKFDCXXXCPIXXAIGXXGXELLTPDPLDGETRXTPXNQNLPGPAAIWXSXXVCCFEEEGXRRRPNLQXRLPGANELPGXRKAXAVSXLXXSCRWIPXKKSPXSEFLXPGEPXFXXAPPAGAXFXXXL

SEQ ID NO: 202542 - protein, 61 aa, Triticum aestivum
  unsure (1)..(61): unsure at all Xaa locations
  Clone ID: PAT_TA_96960.pep
EAPGTLWTHIEXQFXGGXLVAXAFSSXLGQXXRXDGYIXEGKEXEFYMRKLQKKKGKGXTA

SEQ ID NO: 202543 - protein, 163 aa, Triticum aestivum
  unsure (1)..(163): unsure at all Xaa locations
  Clone ID: PAT_TA_96961.pep
ESPSPXPSPXPSKXGGGFXRRRLNXFPLLPAIXXLRXRXXFPSXSQTSQQVSSLPPFXIXGVRXXXEPWGKKXGXXKXPPMEEXGAKLXTSSPXXSXKHXXNVECRVXFEKSGXVRVNXXICQEKXSXXMANXLXWNXLVVYXXNXXDXXRSAVNTGXKXNXG

SEQ ID NO: 202544 - protein, 112 aa, Triticum aestivum
  unsure (1)..(112): unsure at all Xaa locations
  Clone ID: PAT_TA_96962.pep
VFLGINXXHVVTXRELSPXPSXRKGKSTKRVHFVXNXFMEXAGFXPXXKXITELLXGGKDXRALXXPQKKXWFSXESXEXXRGGCPSLKSPLVGGVLVTKKKKRGPIEIPKP

SEQ ID NO: 202545 - protein, 124 aa, Triticum aestivum
  unsure (1)..(124): unsure at all Xaa locations
  Clone ID: PAT_TA_96963.pep
PMHXSTAKQXXXYXFXGSVTPXNQIILKLXYWRPGFLPMPGXLPQIAXKDGXSKXCNKDXKGXXPSVTTQIFPKIWECXNKXXQSIXXLKKKKKKKTPRGGGXVPKFXPXXEXLXTXPPXGRSF

SEQ ID NO: 202546 - protein, 48 aa, Triticum aestivum
  unsure (1)..(48): unsure at all Xaa locations
  Clone ID: PAT_TA_96964.pep
NQNKIFPQXVKLIXKSNLSKNXXXTNXNQILWRGLHPHTRXICLPNGG

SEQ ID NO: 202547 - protein, 123 aa, Triticum aestivum
  unsure (1)..(123): unsure at all Xaa locations
  Clone ID: PAT_TA_96965.pep
CGTGANGRAINXXGKPTNKRGEVMGGGENNFCYLDKGEIWPNNXITGYWXPQLTTXGNKGWDCWDKXISFSNRXGVPXVPDWGPLPREGXSQRNFQXSCLIQNSXKGVXXCXEVXLEWRHNKG

SEQ ID NO: 202548 - protein, 133 aa, Triticum aestivum
  Clone ID: PAT_TA_96966.pep
PSRRWHRRRRRRRSGRPRRGRRWWRGKPGFGLPTACPTCLPVLLYLRMSQVPFDIHVDYRFPDADHIPYVEFGECVAFNNENGGVIEYLREEKIVDLTSKHPKRFLLLMYYPQRAMISTWLADALQYELWGGK

SEQ ID NO: 202549 - protein, 104 aa, Triticum aestivum
  unsure (1)..(104): unsure at all Xaa locations
  Clone ID: PAT_TA_96967.pep
GAXELLAGTRRPAXXSHGWRVXXAXSGDXPXNYRLPRXRRPRXGMQQXQAPAPSGGDGATTAXAAGGRGRXLSARAQNYGEWAWRTRRXXGILSAGKNAGYHLX

SEQ ID NO: 202550 - protein, 105 aa, Triticum aestivum
  unsure (1)..(105): unsure at all Xaa locations
  Clone ID: PAT_TA_96968.pep
ERSTTHLSVFLHSHARARKRGREGIPGSVALGDVMAQPRQQXRQGXLVAALLVLLSLCCLARLGAAXSAASADPHRKDGAATALGQGRATGGGGSARCSRXTTXA

SEQ ID NO: 202551 - protein, 78 aa, Triticum aestivum
  unsure (1)..(78): unsure at all Xaa locations
  Clone ID: PAT_TA_96969.pep
LQRPPXFGGLRHRGSRPRGGEAAIGARGNVAVAVXVPCRRRSGFRRPRSXAAAAKSIAERSAXNQLXRLEEGPGGERS

SEQ ID NO: 202552 - protein, 84 aa, Triticum aestivum
  unsure (1)..(84): unsure at all Xaa locations
  Clone ID: PAT_TA_96970.pep
RVGXKPTGIXIEMLLXSLGGHTDPXXXKQNKXTLGTHSSNXXXHLLSFGXTXFXEPXGXLXVVXKKXPLIXXQISPQXXGEKRX

SEQ ID NO: 202553 - protein, 167 aa, Triticum aestivum
  unsure (1)..(167): unsure at all Xaa locations
  Clone ID: PAT_TA_96971.pep
XQXPFSQQRPXFSQXQSXNQVLPQQXPFSQQXHHQPILPQQXPFSXHQQPXVLPQQXIPYVQPSILQQLNPCXVFLQQQCSPVAMPQSXLLRSHMLWQSSCHVMQQQCXQXLPRIPXQSXYDAIRAIIXSIVPTXNNQHGPGFSIQTSAANQPPTSRSKGCSPPQAT

SEQ ID NO: 202554 - protein, 143 aa, Triticum aestivum
  unsure (1)..(143): unsure at all Xaa locations
  Clone ID: PAT_TA_96972.pep
MKTFLILALLAIVATTATTAVRVPVPQLQPQHPSQXQQPQEQVPLVQQQQFXGKQXPFPPQQPYPQPQPFPSQQPYLQLQPFPQPQLPYXQPQPFRPQQPYPQXQPQYSQPQQPISQAAASKQQQTTTXKXXQQILQQILQQT

SEQ ID NO: 202555 - protein, 180 aa, Triticum aestivum
  unsure (1)..(180): unsure at all Xaa locations
  Clone ID: PAT_TA_96973.pep
XYXXFLFXFXWXSXXVXGXSRTKWXPRGCMFFLNFXPRLXPGPPLLXGSLKPRXXXGXXDLPPXVKRRSTXEAGPKKAKXXSSAPXIAGERTAPPLMLRLRVGHSAGTFDVSSKDKAARXGDRLKXTPGGXQRWQXXPNGGALGQSXVXGXAPXPNQXEGXIPXTNPXKXLXLPXQNLPG

SEQ ID NO: 202556 - protein, 86 aa, Triticum aestivum
  unsure (1)..(86): unsure at all Xaa locations
  Clone ID: PAT_TA_96974.pep
ALFXVGGEDPXVPXRHLTWPSMTLTNSXVVDVAVAVQRPPSRNHLGPPSSSVSFLPGGLVIHVXAAPAAEMNPVLGPLSNTAERLL

SEQ ID NO: 202557 - protein, 148 aa, Triticum aestivum
  unsure (1)..(148): unsure at all Xaa locations
  Clone ID: PAT_TA_96975.pep
MAPKADKNPXAESKVEKAAEXTPAGKKPKAXKRVPAGTTAAXEGAGGEGQXRGRKKGSKAKKGVEXYKIYIFKVLKQGAPGTVGISSKAMSIMNSFINDIFEESSPGSPKPEGTTKKPTITSRGRFKTSVPPRPPREKLAKRSEHQKG

SEQ ID NO: 202558 - protein, 141 aa, Triticum aestivum
  unsure (1)..(141): unsure at all Xaa locations
  Clone ID: PAT_TA_96976.pep
AKMSTMFVLQXGNTLDPRMGRLLXDPAASLSIFDTIAVIVWALAYDRLIVXAARRITGHPRGFTQXLQRMGIGLVISIFSMVAAGVLEVVRLHVAAQHTACWTPRSTCPMSNLLGKVPQVTSSWGAAGCSTFRWGKIEVSF

SEQ ID NO: 202559 - protein, 127 aa, Triticum aestivum
  unsure (1)..(127): unsure at all Xaa locations
  Clone ID: PAT_TA_96977.pep
XPGCCHXPTGXPLVSCSSDHGRXRRPSRFRARKLAWLRAPFVSSXSTACRRLLLGLLNLDGGRRLDFGLHRRGGFLRLRDLLGGDRLIHRGRLLRQRGRWVLGHQRWPLPSWMQENDRSGRGWLAEA

SEQ ID NO: 202560 - protein, 102 aa, Triticum aestivum
  unsure (1)..(102): unsure at all Xaa locations
  Clone ID: PAT_TA_96978.pep
ASFPRRHPPRKGGCLAAXAATAGAAPAASAANGCGGVQXCSPTWRPPPXAPPPWSCPPPPTKGGSSGRGFETPGGTGRCDLHHPASAGTAVPGLLPACKLAN

SEQ ID NO: 202561 - protein, 86 aa, Triticum aestivum
  unsure (1)..(86): unsure at all Xaa locations
  Clone ID: PAT_TA_96979.pep
FAAILFICGIKVPKXKILNLIMERKWISKXCWFYKGFLIFKSGERSLRVKGLSKGKTPPNGGKKXEVYFKGKEICWQIPSKSLNXK

SEQ ID NO: 202562 - protein, 58 aa, Triticum aestivum
  unsure (1)..(58): unsure at all Xaa locations
  Clone ID: PAT_TA_96980.pep
RGSLELSADLXENNRLXEELAVVLRPFGKAKVSPRETTIWXARSFQGMMNDEAXRSST

SEQ ID NO: 202563 - protein, 108 aa, Triticum aestivum
  unsure (1)..(108): unsure at all Xaa locations
  Clone ID: PAT_TA_96981.pep
PFLPRRRRRLLLGSLSFLRELQPWVRXKTHINILAIGHVDSGKSTTTGHLIYXLGGIXTRVIXRXEKEXXEMNXRSFKYXXXVLDKLXGRVTRGLSPSIPLGFEQPRY

SEQ ID NO: 202564 - protein, 150 aa, Triticum aestivum
  unsure (1)..(150): unsure at all Xaa locations
  Clone ID: PAT_TA_96982.pep
SSLSPSPAEFNTITTANXIRMXRGCXYSARAGSPXVXTXGGXVXXDACHLLRSXLTSALXPLASPMPRGQMGXQTRTAALLASRVSRKSGPGGKPRXHPPXQSKSGRCXVHQKKPLAGLGLKXLXQKARPXXPLQKLPXVKRPHNXKSKR

SEQ ID NO: 202565 - protein, 176 aa, Triticum aestivum
  unsure (1)..(176): unsure at all Xaa locations
  Clone ID: PAT_TA_96983.pep
RVARNGGRDHGALLPGDGGHPGEGLQGRRPSARAASPCARRRGKPKGGRASKQARGTGSDRRALPRPRSPGGPPGSYLTRAKFPGGLRLGDTAGASPPDPRXLRQRKPGEAWKGDPTCRLGPMARAALGXAVFPGSLLAPQTGXQXSGEGPVVGSKGPGSPKFFKXKGRGLRTNXR

SEQ ID NO: 202566 - protein, 149 aa, Triticum aestivum
  unsure (1)..(149): unsure at all Xaa locations
  Clone ID: PAT_TA_96984.pep
XTFXLHPLXIDQPXXRKPWSARRXAPFPPPRRAPPAXXGGASSXXQTSXRXXKLEXXRMGSSTTEVSXLRXHFXFMGGTSLRQIVLXGTXLLXXXAXTLNPCXPLRVNXQXXXPSPRXAQSTCSXMGPXLKXPFLKPTVXRGXXPIQXP

SEQ ID NO: 202567 - protein, 142 aa, Triticum aestivum
  unsure (1)..(142): unsure at all Xaa locations
  Clone ID: PAT_TA_96985.pep
MANPRVFFDMTVGGAPAGRIVMELYKDAVPRTVENFRALCTGEKGVXKSGKPLHYKGXSAFHRVIPDFMCQGXRLHPGANGTGGRSPSTAXKFADEKFRPTXXHQSPGFLSMANAGPNTXNGSQXFFICTVPCNWGPKKATW

SEQ ID NO: 202568 - protein, 154 aa, Triticum aestivum
  unsure (1)..(154): unsure at all Xaa locations
  Clone ID: PAT_TA_96986.pep
PSLQQRLNPCKNILLXQCKPASLVSSLWSIIWPQNDCQVMQQQCCQELAQIPQQLQCAAIHSVVQSIIMQQQEQEQEEQQQQQQGMRIFFPLSRQQQVGQGTLVQGQGIIQPQQPXAQLEAIRSLGVXKLLPXICNVLCPXLECSQQGAPICQQ

SEQ ID NO: 202569 - protein, 108 aa, Triticum aestivum
  unsure (1)..(108): unsure at all Xaa locations
  Clone ID: PAT_TA_96987.pep
LILSVPPGHXVXANIXKSCFGKWWXSKWFVKQXXKAYSPKXSPXNCVGAIXTXGXLXRXXLFFXIQAXXTNLGTXGYLQTPNLKXXXQQXKGQTKXXWVQGXLXPRPX

SEQ ID NO: 202570 - protein, 94 aa, Triticum aestivum
  unsure (1)..(94): unsure at all Xaa locations
  Clone ID: PAT_TA_96988.pep
MRECISXIHIGQAGIQVGNPCWEXLYCLEHGIQPDGXMPGDXTVGGGDDAFNTFFSRDWVLGKHVPRAVFVISSPLIDEVDWCLTASSSTLEQA

SEQ ID NO: 202571 - protein, 141 aa, Triticum aestivum
  unsure (1)..(141): unsure at all Xaa locations
  Clone ID: PAT_TA_96989.pep
MAPTVMXSSATSVAPFQGLKSTAGLPVSRRSNGASLGSVSNGGRIRCMQVWPIEGIKKFETLSYLPPLSTEALLKQVDYLIRSKWVPCLEFSKVXGFIFREAQMRLPGYYDGRXWTMLCLCFGVHRRPQQGDTGGGGSKGE

SEQ ID NO: 202572 - protein, 123 aa, Triticum aestivum
  unsure (1)..(123): unsure at all Xaa locations
  Clone ID: PAT_TA_96990.pep
IAGSDETHKKLKGGGKLERPLDGLMGKLGSLTACFRGELGWTVASLAGVQVSKSTGKFLGQLGLVLTFGQLXWAXNLGLXKLPKRTLYALVKHXXSKTKTPLXPTMXFWFNXQLRKGXWLGGA

SEQ ID NO: 202573 - protein, 145 aa, Triticum aestivum
  unsure (1)..(145): unsure at all Xaa locations
  Clone ID: PAT_TA_96991.pep
QXPPFSQQQQPILPXQPPFSQXXQQPVLPQQQIPFVHPSILQQLNPCKVFLQQXQCXPVAMPQSLAXSQMLQXSSCHXMXQHCCQQLXPQIPXXSRYXAIPCYHPTPSLARTNPGFRGFPSQLSKEAPPNGPKMFSPPQKASSQL

SEQ ID NO: 202574 - protein, 78 aa, Triticum aestivum
  unsure (1)..(78): unsure at all Xaa locations
  Clone ID: PAT_TA_96992.pep
NQTXGGKPTXSGCRSDXRKSXGKMVFXLXGGLXPPLRVEEVXXRERXXMDWRXDWKXGSFGWXEGKKGTRRGFAWCGI

SEQ ID NO: 202575 - protein, 89 aa, Triticum aestivum
  unsure (1)..(89): unsure at all Xaa locations
  Clone ID: PAT_TA_96993.pep
GNKELIAACHRGKQRKSNNVQRKLEKXQQGRXLXTSHLEEXFSGGRLLXCXSSXRPGQCGRADGYILEGKELEFYMRKLQKKKGKGXTA

SEQ ID NO: 202576 - protein, 145 aa, Triticum aestivum
  unsure (1)..(145): unsure at all Xaa locations
  Clone ID: PAT_TA_96994.pep
PXPXQPSRRPXAXXGXEDXSXLTSNXSATHSXGGXXFARLPXYSISTGKEXXTXLIFNXGKIVHLPRXXVPLPXKSIFXVPKXNVIPFVFQXILXFNXXQSYPQFLQSFKQKQHQXATXXEVLXNPIQXEXIXNXSXLCXWXFCX

SEQ ID NO: 202577 - protein, 86 aa, Triticum aestivum
  unsure (1)..(86): unsure at all Xaa locations
  Clone ID: PAT_TA_96995.pep
YFPDPLTLFRQPSGASWGGWKGXRWMDYLNPGSVDIEAAVPXGGEGTPTPDVGYPGGACWFDLGGKLGARLAGSPVNGAPATKGED

SEQ ID NO: 202578 - protein, 142 aa, Triticum aestivum
  unsure (1)..(142): unsure at all Xaa locations
  Clone ID: PAT_TA_96996.pep
AIKNVNGKVIAKRTVAVDWAVPKNVXAVAAKSDAKDDELEDISDKGSDKESSEDNLVGGDDSDDNCELDQETSNRLPVDDFKSEADISRKVLENLIKSSXKSERSGVENSDIDTDSETENDTPKKEATPSHLQLSSLAILED

SEQ ID NO: 202579 - protein, 70 aa, Triticum aestivum
  Clone ID: PAT_TA_96997.pep
LMLASSSWGTPPTWDSCSKILEQLGAEYLLPGVLPLHAQVQHAQIEITAMNLCYSGTVLSVMNVVTKGCS

SEQ ID NO: 202580 - protein, 186 aa, Triticum aestivum
  unsure (1)..(186): unsure at all Xaa locations
  Clone ID: PAT_TA_96998.pep
HQSTMKDLXRLCPPRRCGDKXQXRGGGXLHASLVWERPWXAXKPLPPQQXISTNXXLFSQHPTNYFLKQTIIFXXQTNHHFXKHTTTIFSXNKPNSXHKQPTIFRXQTNQPKFYPPXXPTNFPQXKPNXPSFTLPQTNHLFPTTKQTNHQTSLXGKQTXSPGLFQPIQFCQXSLKXNXKXIPSNQX

SEQ ID NO: 202581 - protein, 179 aa, Triticum aestivum
  unsure (1)..(179): unsure at all Xaa locations
  Clone ID: PAT_TA_96999.pep
XAFWPGGRRXIHAPRRTXLIWPRPSXPQAIRXTXSRGAAXPYHEARXGEDVSPAGCRRRRNRXAGLRRRXLCQTPDRPAPGKFSSACPRRASSPXPRSLPSVXQSGLGXXHXSPNPPNFPXRPPFRXLXQRGKXPLSLGLXSSEQXPXXPAPVLVSKWXGXXXGLASSXXLXFFQCLLY

SEQ ID NO: 202582 - protein, 107 aa, Triticum aestivum
  unsure (1)..(107): unsure at all Xaa locations
  Clone ID: PAT_TA_97000.pep
NAPTLYEFSCPSRCYLSKSPLDHLFQLWSRINRLXQTLARHTLFNQELGFSCRAFQEVYIFWNNQIHLSVHRSLSLRLSXNFPKSSWLSQMVKNSLVNLXQGRTRVA

SEQ ID NO: 202583 - protein, 76 aa, Triticum aestivum
  unsure (1)..(76): unsure at all Xaa locations
  Clone ID: PAT_TA_97001.pep
WTKPFRSKHLXMDXFXHXECCSRLHNXGXXEQXTNVANXXVVVXAVNGQQSNNLPXPGLLQASTSARRKCSSMSEX

SEQ ID NO: 202584 - protein, 98 aa, Triticum aestivum
  unsure (1)..(98): unsure at all Xaa locations
  Clone ID: PAT_TA_97002.pep
EELPLXSXPKXKMTTAVXSICPVRATPATRRIXNRFPSSPSXISPYLFDXXAXKXRRXHSNPXRRLXXGPVGXATGLQRATXVFQXLTXLRXXAXHDX

SEQ ID NO: 202585 - protein, 164 aa, Triticum aestivum
  unsure (1)..(164): unsure at all Xaa locations
  Clone ID: PAT_TA_97003.pep
FRNXAXLNKXGVKLEQFAFEILXXVRHLFIPPTRXPTLPLWQELGIGLSKVLSFVPRPQTTEFPRKLNFFPXVPTFYSRATGRXLSLGPTWLSPFNQLKXVSFIKEDGKDPSPXLILSQTLFAVDXSKVILSSLLXKVLSLGKSXKVFPLHSYRRRRIRSSPAX

SEQ ID NO: 202586 - protein, 118 aa, Triticum aestivum
  unsure (1)..(118): unsure at all Xaa locations
  Clone ID: PAT_TA_97004.pep
MXPTVMASSGTSVAPFQGLKSTAGLPVSRPSKGXXPRQASSNGGKGXRCMQXVWPIXXGIKXSSRTLSYLPPLKHGALLKARSNYPGSGSKGGGCLGLRSSSKGLGVQSSSHKTASWG

SEQ ID NO: 202587 - protein, 136 aa, Triticum aestivum
  unsure (1)..(136): unsure at all Xaa locations
  Clone ID: PAT_TA_97005.pep
XDKXFFVKRQVXLEDGKVSTMSTXFTSFGHQHLNHHHPPSAEGLAPMSTSXAPLKDPMAMDFPEHXVSPASLXXEGIRTGSSFAGKLCPWYXSIGAAXFEIXSXEKRRNXLTEXLGEAGESSFXNFXQPRGNPXSF

SEQ ID NO: 202588 - protein, 159 aa, Triticum aestivum
  unsure (1)..(159): unsure at all Xaa locations
  Clone ID: PAT_TA_97006.pep
IXTSIKXEIMQMILFMGVQXFWKPEALXDVLCTRHWLRALAHGVXFVGLRXITQSKPNFFKNHSQXLPGWYTNVRXGFPFANTWNGKQMDHRWIPQAPSTPGAKRXTTLFXGGGLATPXRVQWEATXGGWDKGSWXQXNGWIGXKHLLGNXAVXPGRDX

SEQ ID NO: 202589 - protein, 125 aa, Triticum aestivum
  unsure (1)..(125): unsure at all Xaa locations
  Clone ID: PAT_TA_97007.pep
FPSSPKHQARWPGRAGDRXKAVTRSVKAGLQFPVGRIGRHLKKGRYAQRVGSGAPVYLAAVLEYLAXAXVLXACRQXAGQGTTRRTRNHPAPTWLLAXSATTKELGRAXLAGVTXRPRGALIPKH

SEQ ID NO: 202590 - protein, 150 aa, Triticum aestivum
  unsure (1)..(150): unsure at all Xaa locations
  Clone ID: PAT_TA_97008.pep
PKXTQKGMGIQXLPXPLXXXFSRXNXPPGKKLRGSNXPGLWLFKGIXTFXGFKXAPLPGRGRGXXPPPGGRPXAFAQPPLGLGKXXNRLGQALGATTQRTGPXWRXAGNNKLVDXWKQAPGQPLTVPMKXKGVWGKNXGTXGRPFLXGGL

SEQ ID NO: 202591 - protein, 63 aa, Triticum aestivum
  Clone ID: PAT_TA_97009.pep
MARGLKKHLKRLNAPSHWMLDKLGGSFCPQSHHLGPHKGQGKCLPLILILEGNRLENYALNPN

SEQ ID NO: 202592 - protein, 114 aa, Triticum aestivum
  unsure (1)..(114): unsure at all Xaa locations
  Clone ID: PAT_TA_97010.pep
KGKRPFPTVWFEDXLKIPGVFXFGRRIXDRILPSRIGGSTXKGNFXVWNKXDXLPPTXHKASPPGAACINHXPTGGPPENFLLXGDLSAXAAIFGWWRRRAWAEEGRRWRMPMT

SEQ ID NO: 202593 - protein, 92 aa, Triticum aestivum
  unsure (1)..(92): unsure at all Xaa locations
  Clone ID: PAT_TA_97011.pep
EXEXXNLPESXVGXRNXXTLPXXHGTTTQHHHFRGGERKERGGERERRERERXEKRLGRTPLSHGLRAPRXQSKLVPXPPSIKRSLXHAKCS

SEQ ID NO: 202594 - protein, 149 aa, Triticum aestivum
  unsure (1)..(149): unsure at all Xaa locations
  Clone ID: PAT_TA_97012.pep
TXTXTPXRRNHSSLKXSREXRLSLHLRLPPXRXFELCXAXSGLAPXGRGDRXEPRGSXSSPEKAXVSPXXGGGTRXPTTXXRXTSXCARPLXXDECDRRRRGXPXQSXXXSXXQXTGGFSAPPVXSTXKDGPAXLXGXVKRPXKGXAPP

SEQ ID NO: 202595 - protein, 140 aa, Triticum aestivum
  unsure (1)..(140): unsure at all Xaa locations
  Clone ID: PAT_TA_97013.pep
MAPTVMXSSXTSVAPFQGLKSNAGLPVXSRRSNXAKXSAALSNGGXRIRGMQVWXIEGXSRKFETLSYFATGSSTXXPSLRQVXTTLIRSKVGVPCLXGSTRVGFHLPVKHNASPXGYYXGRVLDCGKLAYVPDAPDAAG

SEQ ID NO: 202596 - protein, 200 aa, Triticum aestivum
  unsure (1)..(200): unsure at all Xaa locations
  Clone ID: PAT_TA_97014.pep
GGTRGQXWGPXGANWVLTRPVAGRXFRCLXNRVXRVGSKLKTRGSGRTPIGHAFWQHXXNQEALXGISRGLXGALVCLPAXLPSGPGIPVXVTVGRLGPLPRVLERVANXTPEVPRAPXFFRLVAXSPNVRRGPVGLKNKQRAKASXGPLFGRXRVGWSRFWWAEPLPKSRPEXVEXXGEFGENPLSGTGAEQTXMGGRX

SEQ ID NO: 202597 - protein, 67 aa, Triticum aestivum
  unsure (1)..(67): unsure at all Xaa locations
  Clone ID: PAT_TA_97015.pep
TMXXXASCPXCXRXSEDXQIPIKIPRESGPLKIXPQPPGVMXLXFXRAXLFKKPWXPRIRRGGVQRA

SEQ ID NO: 202598 - protein, 199 aa, Triticum aestivum
  unsure (1)..(199): unsure at all Xaa locations
  Clone ID: PAT_TA_97016.pep
PQHFHHNNHCRNRNHFCHNYHIREATTISTTXTNIHKSXPQVSATTTTKFHSXGXTNMHNKQXTXKQSASXQQTXTKXAXKQQTNKXRSLQSXFLXTTKPTWISNARGWXXLGNKHNXLAAMXKPHKXICXNRXAXQTWXAKXFMVGQTVLXXQDPPEASSAGWPKANXXNWSFQWLIIXGNXQTXHXNQQAKXPTNQQ

SEQ ID NO: 202599 - protein, 117 aa, Triticum aestivum
  unsure (1)..(117): unsure at all Xaa locations
  Clone ID: PAT_TA_97017.pep
MSCCGGNCGCGSXCKXWXGCGGCKXYPEMDEGVNTTSETLIMGVAPSKGTXSFXAAARXRGRKRXGCKCRPNQPATPLQLQDSSNRWQREAWDLYERSTSCYAWCSCVVSFLICQPK

SEQ ID NO: 202600 - protein, 171 aa, Triticum aestivum
  unsure (1)..(171): unsure at all Xaa locations
  Clone ID: PAT_TA_97018.pep
SPHKHPLKSLASFPRRHPPRKGGCLAAAATAGAAPVASAATAAAGAXCSPTWRPPPVPPPWSCPPPPTRGXAXAGSRPAGGRPAAATAPPCXVPAPRAAAPXAXAAXEAGRSXRPAGXRAKQRXMRRTXXAKRPSPPSSPTNPGVIINPAALRLRGARPEKIKNHRFRGSG

SEQ ID NO: 202601 - protein, 192 aa, Triticum aestivum
  unsure (1)..(192): unsure at all Xaa locations
  Clone ID: PAT_TA_97019.pep
NSXTTTTTIFAXTTTXVYRNNHHFRSNNNXXFYRNXKYHLFIHLSXGGXKPMQGIPPSXQMQALWXMPQSLAKGRXMLQARRXLPCECNNXCCQASCRXIPXXKFPAYXXANPVLIILPQSIPAKXTNKXGFKGXPSKTSLKQANPKQAXGPXWFFPKPPXKQVXXQSXLXANXPSNKQTNXAXKGXLFCKX

SEQ ID NO: 202602 - protein, 135 aa, Triticum aestivum
  unsure (1)..(135): unsure at all Xaa locations
  Clone ID: PAT_TA_97020.pep
MYTARKKIQKDKGVEPSEFEDTVAQAFFDLENGNQXELKSDLKDLYINTAXKMDVVGNRKAVVIHVPYRLRKPFRKINVRLVRELEKKXFSGKDVVFVATXRICEXPPKKGSAVQRPRTKTLTXVHDGYLGGMSV

SEQ ID NO: 202603 - protein, 72 aa, Triticum aestivum
  unsure (1)..(72): unsure at all Xaa locations
  Clone ID: PAT_TA_97021.pep
QVLTEEKKEARXMSGXXKGGKWSGQGRAPMRHRKVLRDNIQGITKPXAIRRLXRXRGGVXRISGASSTKEDP

SEQ ID NO: 202604 - protein, 210 aa, Triticum aestivum
  unsure (1)..(210): unsure at all Xaa locations
  Clone ID: PAT_TA_97022.pep
XLSXPTPXTTFKEQRDXGLRDRRSRPXQQWEGTGDCALGFXRVQSNXRXLQRDXGWDIGGFPEPIPQFSELSFGXLLGGPLXFQARXQPSIQFGPXNRVXPQSKXQSKGFPEGASELTKLLQTGKPNNQIRXSRAPXGPSIAILPFKXDLPPXPXGLPGLQWXLPKKXTLPXFTXSXRTNXLSXGQRXPILGKKDNQXASLXQXXIXXTS

SEQ ID NO: 202605 - protein, 95 aa, Triticum aestivum
  unsure (1)..(95): unsure at all Xaa locations
  Clone ID: PAT_TA_97023.pep
PGLQARSQFLNRLAIEEGISITTAVLAQYEKRKGRFFEEIDYVLTDTIRGSVVDFFTXVWLPAXPTISLLSXADNGSWVRSLEPWLKDWLRXLPR

SEQ ID NO: 202606 - protein, 81 aa, Triticum aestivum
  unsure (1)..(81): unsure at all Xaa locations
  Clone ID: PAT_TA_97024.pep
MAAIRRLIPSFNRVLVEKVVQPKKSAGGILLPETSKAAXNSGKVIAVGPWAARDKGRGKLNPCCSQREGXPWCSCLEYGGL

SEQ ID NO: 202607 - protein, 103 aa, Triticum aestivum
  unsure (1)..(103): unsure at all Xaa locations
  Clone ID: PAT_TA_97025.pep
LEVXGESHLGXSLGSLXIAXALXHDXLATFASEVVQXESMQCNSLGTWMFMXLLVGLEXXLPIAAXSXFXEDSFSLTIXGXTAXCRRPWLXIXSTRRDETXXF

SEQ ID NO: 202608 - protein, 50 aa, Triticum aestivum
  unsure (1)..(50): unsure at all Xaa locations
  Clone ID: PAT_TA_97026.pep
CXXFXXLXXFFCDKERQTYELASMAIRLTXTQCQYEHCLDTTLFLFYFRI

SEQ ID NO: 202609 - protein, 162 aa, Triticum aestivum
  unsure (1)..(162): unsure at all Xaa locations
  Clone ID: PAT_TA_97027.pep
QPTNLVSNRPERRILLPHRLKMQIFVKTLTGKTITLEVESSDTIDNVKAKIQDKEGIPPXTKQRLIFPGEAAWXMAVTLADYNIQXKESTLHLCPXVLRGGQCXIFRERTLTGXRLXTLLRXESSTNRMVKGPSKKGVGISPGDKAWNLWLKTDQPSARTKK

SEQ ID NO: 202610 - protein, 92 aa, Triticum aestivum
  unsure (1)..(92): unsure at all Xaa locations
  Clone ID: PAT_TA_97028.pep
FGEAVWFKAGAQXIFSEGGLDYLGNPNLVHAQSILAIWAXVQVVLMGFIEGYRVGGGAPRAEGLEXIYPGAGAFDPLGLARTTPTPPPDAQG

SEQ ID NO: 202611 - protein, 151 aa, Triticum aestivum
  unsure (1)..(151): unsure at all Xaa locations
  Clone ID: PAT_TA_97029.pep
PLHTPAAPKSLHPPPYSRSRCHTAAPNTSFRRTPAPMGGASVTVSSVSGEGGSLVSSLPSGVVVAAPPVVSRASDRRPXTFSFRXPASLDELVGARDGCRGWVVQRVXAQRLFGXXWRKKXXXSXPXKVGQLEGELSDYXFPGXVKXKVAN

SEQ ID NO: 202612 - protein, 65 aa, Triticum aestivum
  unsure (1)..(65): unsure at all Xaa locations
  Clone ID: PAT_TA_97030.pep
LPPSIHPHKQRRRXLXVSRASVXGPNPXTATHPISRRRPISASXLPPLLSALPPTPLPXXXNSCP

SEQ ID NO: 202613 - protein, 200 aa, Triticum aestivum
  unsure (1)..(200): unsure at all Xaa locations
  Clone ID: PAT_TA_97031.pep
DQVAGQRALSAVATLQXGRSMASKVRAGGGGEVARPXXXVGRXXAESDGSCSPXIFPRSKYKXHXXTRGKGRRAKSAXHRPALIKVHRXGVSXMVTVSAQREKGWVGWXXRXEERKVGVPTSXXWDGXNLGSXFLQKETFXGVERVAXXDPNXXAGRXGRRGXRXGENWXRPAFXSVPVPXPIQSNGLXGXSVNXSXGGG

SEQ ID NO: 202614 - protein, 127 aa, Triticum aestivum
  unsure (1)..(127): unsure at all Xaa locations
  Clone ID: PAT_TA_97032.pep
RXNNPQXATTAEEKPTAAGRKKASHGVSTSSAGRGGTXRDQKRVAAQSPTMSNLKAPSSKLYRFXWVKGRDQRASFNXRSSSKKGSSIXARTKXAPPALHAXGPLPNFQLKGKXGGRXEXFAGGLVW

SEQ ID NO: 202615 - protein, 168 aa, Triticum aestivum
  unsure (1)..(168): unsure at all Xaa locations
  Clone ID: PAT_TA_97033.pep
PKLLASYXVAGRGWGAQQMPCKRQKLNSCKELPAKNXCSTXERDFPGSPXXLXGKWWKXEXXSKXLLGGSCLQXXLGPKMXXANGPLAKQSIQXGSNSXGXNLRVGNLPXFFXRWXRGQSQXVXYKEKPKXTLAXPKGGKPXGPSXWQTIPRGTNWXNXLGGMXPFQF

SEQ ID NO: 202616 - protein, 167 aa, Triticum aestivum
  unsure (1)..(167): unsure at all Xaa locations
  Clone ID: PAT_TA_97034.pep
ILLAXGKFXQPXLVVXWSXPXSTXXPDXSLKGPNAHGXLXPIXQPSXGGXAPXQLXPPXRRAGPFPKRFKXXEXXILGSRPLSTXXACVEGRNVGXFXLYXPGFQRGTCIRGGXSYGETPGTXGRAXPGALAPEVPPQSGGFPLPAXDALGPEGRQGRTAWPDDAPA

SEQ ID NO: 202617 - protein, 131 aa, Triticum aestivum
  unsure (1)..(131): unsure at all Xaa locations
  Clone ID: PAT_TA_97035.pep
AFLRAQAMGVESPQANPXRHXRAGPRISSDAARYDEAGKDVCRPLLRRXPPRTPARFAKGPKRALHMGFCQMGHLAVXWEVTLIQEWEAEMVKLCKTWGERNTPPPTGGMPSMGQYKEGNQXAFEYGGXGG

SEQ ID NO: 202618 - protein, 145 aa, Triticum aestivum
  unsure (1)..(145): unsure at all Xaa locations
  Clone ID: PAT_TA_97036.pep
WPRPXTSVAPFQGXLKSTAGLPVKPPAPTGLASXGVSNGGRIRCMQVXWPIEGIKKFETLSYLPPLXSTEALLKXXSDYLIRSXWGAXPSEFSKGLGFIFREAQTQSPGVLTMGRVLQMWELALCFGADGHGESERWAEGKGSNP

SEQ ID NO: 202619 - protein, 186 aa, Triticum aestivum
  unsure (1)..(186): unsure at all Xaa locations
  Clone ID: PAT_TA_97037.pep
TXINIEAXLVAXQHEDHVDPRSHCPRRRLASFAQLDTTCRPRAMGNANSSHNNKVNTCAALLQQLXXPDTICPSHKMVGKAKRVCQVGLPGNKLLPNRWXQESSGRQGSGWPIARSCRVVGPRFXQCRGSKQXGXTXFRVKPSSNXXTGAKVFGPXPXNXXGFPIXGXRKGWGAFXTPFXSECWNR

SEQ ID NO: 202620 - protein, 81 aa, Triticum aestivum
  unsure (1)..(81): unsure at all Xaa locations
  Clone ID: PAT_TA_97038.pep
FFRGRKFGVTPGPPPPSEVCIGRXXPRFENKRLGQPPLKIWXEGPNQKRPPKVXXVYCLEFSNKAPGPHHXYWXFHPKVIG

SEQ ID NO: 202621 - protein, 85 aa, Triticum aestivum
  unsure (1)..(85): unsure at all Xaa locations
  Clone ID: PAT_TA_97039.pep
PGRGRPPSVGTFPGPTGPRLXGWPSLSSPXLNFXPSAXPPKGAKPPXXGKXRXQGKGXTGGXXFSRWARAGGQIRELSFRQRNKP

SEQ ID NO: 202622 - protein, 91 aa, Triticum aestivum
  unsure (1)..(91): unsure at all Xaa locations
  Clone ID: PAT_TA_97040.pep
GGCLXGTGAFXRAPRRRXPRXPTALHSSTAPASNAPCSGQEPSKXVPVSXGTTFGVVAGAKTDTXXIARVRVRXPVAGRSXKAHHRSTSIT

SEQ ID NO: 202623 - protein, 173 aa, Triticum aestivum
  unsure (1)..(173): unsure at all Xaa locations
  Clone ID: PAT_TA_97041.pep
PFPNQKXCFXSFFFLVTIEXHPFEGKIHPFXASLSREPXLNSXTGXSLFYPKSXIEQLXARAGPLTSGSFRAFQAXTELLEFLLVQAPXPGNPFRGGQXTIREQGQAPIFLPSGKRATACPRGXDAGVRGRDLGRRLRRVLXRMGADGEVIGXRRRGRRRRYXXLCCVVLYRV

SEQ ID NO: 202624 - protein, 53 aa, Triticum aestivum
  unsure (1)..(53): unsure at all Xaa locations
  Clone ID: PAT_TA_97042.pep
FWXFXFFFFFFFFFCDKERQTYELASMAIRLTSTQCQYEHCLDTTLFLFYFRI

SEQ ID NO: 202625 - protein, 131 aa, Triticum aestivum
  unsure (1)..(131): unsure at all Xaa locations
  Clone ID: PAT_TA_97043.pep
PEFXLNPTSLRSCXAFFHPKVWFIEHWREXSSLXGGLKTQFLGSPCPNHRGKGXPFXGSPPXREFXVVPFILXGGHSRFEEXQEKFNXXPXCXVQQANXQFDPYPLKLPALQWGXCPQAERHSQFQASLWW

SEQ ID NO: 202626 - protein, 101 aa, Triticum aestivum
  unsure (1)..(101): unsure at all Xaa locations
  Clone ID: PAT_TA_97044.pep
PTXXIITHSQAQIVSRTXQXRPXGVAXHDGVPLRXRXXRPARXXPRXRGLGVGRAAXVQGXXXPAXXMATRGARQPKXAVPXVFXGRRCGXVXPIXGGGVS

SEQ ID NO: 202627 - protein, 104 aa, Triticum aestivum
  Clone ID: PAT_TA_97045.pep
LEPFTSVRRIREDLALLDIPHSHAVVLPGHGWRPPDSGVVKINTDAALSMDSDKVGVGGVARSNTTLLGAWSKPHIGVTDPFIGEDARASRWSYFCKSYGVCHM

SEQ ID NO: 202628 - protein, 59 aa, Triticum aestivum
  unsure (1)..(59): unsure at all Xaa locations
  Clone ID: PAT_TA_97046.pep
GRNLNDASPARRPCDPSSYHXIIGSASRARVSLLSNKCAPPRSRGLLHVLALELLRLSE

SEQ ID NO: 202629 - protein, 44 aa, Triticum aestivum
  Clone ID: PAT_TA_97047.pep
FFFFFFKQGPRERVPPLSQITTSTLPLGEMVGQRIHQVQCGPLA

SEQ ID NO: 202630 - protein, 151 aa, Triticum aestivum
  unsure (1)..(151): unsure at all Xaa locations
  Clone ID: PAT_TA_97048.pep
RTXXGCPXXGXPFFESRXQLRXSPQIFXENLLLGFEPXGVFHPPXXQIFVLSRPLLASYCIRGRAPTNSGGXDQELARRXGVAEXHRISAGATEVRSDLNGPVRRQLPPRCLRWVAPLLEYCTILLDLGHAITRSGPEMPVGRAEQRQLFQ

SEQ ID NO: 202631 - protein, 146 aa, Triticum aestivum
  unsure (1)..(146): unsure at all Xaa locations
  Clone ID: PAT_TA_97049.pep
MANPRVFFDMTVGGAPAGRIVMELYKDAVPRTVENFRALCTGEKGVGKSGKPLHYKGXSAFHRVIPDFMCQGXDFTKGNGTGGESIYGEKFADEKFVXXHTKARDLSMGNAXAQHNGSXXFIWNVXAXWLXGKXLSSGRVXQGQPP

SEQ ID NO: 202632 - protein, 137 aa, Triticum aestivum
  unsure (1)..(137): unsure at all Xaa locations
  Clone ID: PAT_TA_97050.pep
ARKNLWFDKLTQPIPVHFXCFSAVQFPIWIPHXHGHRLTRERSRCCSRXSLGAWSSXVHDVAAGRRPRQRRRQQQRQHHRRHHRIELSLLPSRAVAGGGAGVEMNECRGEGEGEAGGSPVRRSPGWWAAAAAAWDGR

SEQ ID NO: 202633 - protein, 107 aa, Triticum aestivum
  unsure (1)..(107): unsure at all Xaa locations
  Clone ID: PAT_TA_97051.pep
PLXXCXTCRLCXPSSPISPPLXXPXELPLXXPLHMTXPQQPHRALHFCXHLTPXASVAALSSXRLTXXYRXQQDIXXCDRERXXXREREXERXRXRVRERERERERE

SEQ ID NO: 202634 - protein, 128 aa, Triticum aestivum
  unsure (1)..(128): unsure at all Xaa locations
  Clone ID: PAT_TA_97052.pep
YVRLPGEEDKSWQEAIRRKPRXTQKPSGRGSGRQAACSFSSSFMYDAWPNRLLARPSPCRRSQSDXTARPTTLKKVLGGLAYGAGEKSGEKKESGTRSXPCRNSATIQFGVLFEENXIXRGGGPXPQX

SEQ ID NO: 202635 - protein, 147 aa, Triticum aestivum
  unsure (1)..(147): unsure at all Xaa locations
  Clone ID: PAT_TA_97053.pep
LQQHNIAQGRSQVLQQSTYQLLQELCCQHLWQIPEQSQCQAIHNVVHAIILHQQQQKQQQQQQQQPSSQVSFQQPQQQYPLGXGSFRPSQQNPQAQGSVQXPQQLPQFEEIRNLALQTLPAICNVYIPPYCTIAPFGILGTNWRKEK

SEQ ID NO: 202636 - protein, 61 aa, Triticum aestivum
  unsure (1)..(61): unsure at all Xaa locations
  Clone ID: PAT_TA_97054.pep
EXQMRXKRXXXGRXRXDXRXXXEXEXRXXEKGAHAPLFSSHAKKRPSFSSGWFSFSFFLSP

SEQ ID NO: 202637 - protein, 172 aa, Triticum aestivum
  unsure (1)..(172): unsure at all Xaa locations
  Clone ID: PAT_TA_97055.pep
QQQQQPQQPISQQQQQQQQQQQQQQQQQQKQILQQILQQQLIPCMDVVLQQHNIAHGRSQVLQQSTYQLLQELCCQHLWQIPEQSQCQAIQNVVHAIILHQQQKQQQQPSSQVSFQQPLQQYPLGQGSFRASQXQNPQDQGSVQPQQLPQXFEEIRXLALQXLPAMCNVYIP

SEQ ID NO: 202638 - protein, 139 aa, Triticum aestivum
  unsure (1)..(139): unsure at all Xaa locations
  Clone ID: PAT_TA_97056.pep
MAPKAEKKPVAEKAEKTTAAKKTKAEKRPPASKEGGEKKGKKKSKKSVETYKIYIFKVLKQVHPDIGISSKAMSIMNSFINDIFEKLAGESAKLARYNKKPTITSREIQTSVRLVLPGELAKHAVSXEGNKAVTKFXSS

SEQ ID NO: 202639 - protein, 161 aa, Triticum aestivum
  unsure (1)..(161): unsure at all Xaa locations
  Clone ID: PAT_TA_97057.pep
MKTFLILALLAIVXTTATTAVRVPVPQLQPQNPSQQQPQEQVPLVQQQQFLGQQQPFPPQQPYPQPQPFPSQQPYLQLQPFPQPQLPYSQXPQPFRXQQXYPQPQPQYSQPQQPISQQXKQASKQQQQQQQQQQQQKASLNKILTTTGFHAWVGLQAQHKR

SEQ ID NO: 202640 - protein, 66 aa, Triticum aestivum
  Clone ID: PAT_TA_97058.pep
ALRLEALSLRMDYRFELSCSSIPSRYTIYPPAELLHSFKTVMAACVLERRGQLLVYTLDILPPFRS

SEQ ID NO: 202641 - protein, 172 aa, Triticum aestivum
  unsure (1)..(172): unsure at all Xaa locations
  Clone ID: PAT_TA_97059.pep
PPASRWLXPKPGXSPXGXFKILAPAAAXSVXNLYLXGVGHGXPXELXWTRARXXRPXXVFDPSWGLEMNTHLDRLXCPXCRPPCWPPCRPCLPELXPLRGLGLRCCFRCSIXSAQLASGWAGRKGSGEAIWLVSAGSKESEGFCCGWSWPCTNKGYWHCGGFLASTRGGRGP

SEQ ID NO: 202642 - protein, 175 aa, Triticum aestivum
  unsure (1)..(175): unsure at all Xaa locations
  Clone ID: PAT_TA_97060.pep
XQQGYYPTSLQXPRTXAXKGTTXASLQQPXXGQPXQRQQPVQGQHPQQGKQPGQGQQGYYPTSPQQXQGQGXQLGQGQQXGYYPTSPQQPGXQGQQPGQGXNXGXCPTSPAAVRDXRNXPLTXGQQYXDXLQXPXXGNKGYYPNFCCALEQRATNQWTKGNVGQDPRMGKQIVKE

SEQ ID NO: 202643 - protein, 74 aa, Triticum aestivum
  unsure (1)..(74): unsure at all Xaa locations
  Clone ID: PAT_TA_97061.pep
RAPFPTLTSKGVAILDVVNLFGQILEXRRGXWWLXXMANTXNRXMXLSAGSTXLXEQAPDPCYXTGXIXMNFXR

SEQ ID NO: 202644 - protein, 85 aa, Triticum aestivum
  unsure (1)..(85): unsure at all Xaa locations
  Clone ID: PAT_TA_97062.pep
QVXSHPXWLCTSQFXMXGXSHLIPXFWDXLEFGVAKETTFXLLPMQSRLAASSIGNLPYLCNKRKNVNFFEINYYLHSKIIVLLN

SEQ ID NO: 202645 - protein, 147 aa, Triticum aestivum
  unsure (1)..(147): unsure at all Xaa locations
  Clone ID: PAT_TA_97063.pep
MARLNSKAVVAAVVLAAVVLMMAGREASAALSCGQVDSKLAPCVAYVTGRASSISKECCSGVQGLNGMGRSSSDRKITCRCLKKPRHQASKSINMGKVSGVPGKXCXVSCALPIKQCPTNLRLVQTSFNIINPFLRGNAGPLVVLMS

SEQ ID NO: 202646 - protein, 128 aa, Triticum aestivum
  unsure (1)..(128): unsure at all Xaa locations
  Clone ID: PAT_TA_97064.pep
ATARRREGVNNGVAAGRRPHRLRAPPRGEHPPQRXHPRLPPPQXRRSSRPPSSPRLNEDEDAPTIKPRKKPAAKKKPXEAPPXPSXLXSPPSXPRTPSPSPGPLRLPRNNXFSPRSRSPILKSPRLGP

SEQ ID NO: 202647 - protein, 63 aa, Triticum aestivum
  unsure (1)..(63): unsure at all Xaa locations
  Clone ID: PAT_TA_97065.pep
XAWIHXXXPQXHFXAPCXXGXIXELXXSPGCXKSGTRXSPPLXXFGVWFGXGPKVSSXXLGFP

SEQ ID NO: 202648 - protein, 165 aa, Triticum aestivum
  unsure (1)..(165): unsure at all Xaa locations
  Clone ID: PAT_TA_97066.pep
SSPLNPNSNPNPRTHRRWXAXXAPKKXAAGAGGAAWGSCSSSXPSCRXSPXSPPSSXPXPSSPGGXATMSSTSXXSSXXYGSRAPSWAPGSSTXPSSSRXXSPPRSSKGWCLCFKRLGNGDDAARAPWAGRILLNEHWVQRSGRMTAEKEKLVSFNGKPPLQNGG

SEQ ID NO: 202649 - protein, 153 aa, Triticum aestivum
  unsure (1)..(153): unsure at all Xaa locations
  Clone ID: PAT_TA_97067.pep
MKTFLILALLAIVATTATTAVRVPVPQLQLQNPSQQQPQEQVPLVQEQQFPGQQQPFPPQQPYPQPQPFPSQQPYLQLQPFPQPQLSYXKPQPFRPQQPYPQPQPQXYSQPQQPXFRKQQAGXSSXHQQQQXTYNKQTTDSKARDVVFGNNTT

SEQ ID NO: 202650 - protein, 161 aa, Triticum aestivum
  unsure (1)..(161): unsure at all Xaa locations
  Clone ID: PAT_TA_97068.pep
MADRGGYVXVQHGQYGGGQHGGQQQHGRQMGEXMKGMLQXRXAPSASXALTVATPVPRWAGCCLVLSGGWRWRGTVVGLAVGHXXLFLPLQPPLLGRARRSIRALRHRGSSPPGGGLGRASSAQPVFGTRAPPRFQRQPRDLRWKEGAPKPWPNGPDRRGK

SEQ ID NO: 202651 - protein, 132 aa, Triticum aestivum
  Clone ID: PAT_TA_97069.pep
QITPPPDGSGGHHRCGGEHPPHPFPPPHFHRPPLLPPLPSAGAPLPAPRRRPSPSTGAPPRRRRGRCRRWESLIASSHVHPISHLRIQVQICPRRFHLSSNFQDAPSTPACLLCSRLHSHAPLAQALQVSRC

SEQ ID NO: 202652 - protein, 144 aa, Triticum aestivum
  unsure (1)..(144): unsure at all Xaa locations
  Clone ID: PAT_TA_97070.pep
FFCPXRIINAQGLAFXPRXRNXGDWGWCIDHGFXPSIIGGGILQDNFCLGESRXQALTGFVNSLNNTHAPPMGSGQFPDDEDDKRSAYFKHIKIYDANGHARDPITTHMIKLVDRPDCYKETDFTVKINRGYIFYYGGPNGCIG

SEQ ID NO: 202653 - protein, 103 aa, Triticum aestivum
  unsure (1)..(103): unsure at all Xaa locations
  Clone ID: PAT_TA_97071.pep
MSCCGGNCGCGSGCKCGNXCGGCKMYPEMDEGVTTTSQTLIMGVAPSKGTPSFEGAAETGADNGGCKCGSNCTCNPVHLQSDPSKSRTRRWHGMGWDLNERKH

SEQ ID NO: 202654 - protein, 191 aa, Triticum aestivum
  unsure (1)..(191): unsure at all Xaa locations
  Clone ID: PAT_TA_97072.pep
KVSRNLCHLEKGIGLXFPSHQGNPXFHFAFGQXKPLRXSETKHFAGAIXPGIHWXAASAIPVAFLGARDKAXVXPQLRWYGGVEPCSSTSLYGLYSNVKGSLSGQFNKVXFRLSLERXFVHSTLLPLPVACTQGGALGLPCPCSLIVRKLNLSFVWKIKAHRYCIVLYNLIXSHFMGYIXCLXAEIXAARX

SEQ ID NO: 202655 - protein, 71 aa, Triticum aestivum
  unsure (1)..(71): unsure at all Xaa locations
  Clone ID: PAT_TA_97073.pep
MTGKLDGVRARHLSFSWLLTGEVPPQQTXVPRALXTLXPPPPPPPPGSPAPAXRPGGXPPGPXPPSPSENT

SEQ ID NO: 202656 - protein, 87 aa, Triticum aestivum
  unsure (1)..(87): unsure at all Xaa locations
  Clone ID: PAT_TA_97074.pep
ALQAGHSRTGRGXPAHHRTAGXLIIHLREXNPPEHRSXHRGRGGDGGRXFSXPPXCCASVGXNSXRXGXRXAXXPSXSRDSFFSXTL

SEQ ID NO: 202657 - protein, 114 aa, Triticum aestivum
  unsure (1)..(114): unsure at all Xaa locations
  Clone ID: PAT_TA_97075.pep
MATSSSSYAVAVALLCLLAANXCCXCPGPAPAPXXXPKRAPAXPSPVPVTPPTXPAPPXPVSVXPPTVPAXPKPXXPGXGSGXXNXSSXGWVYXXGTWYGAXXWAGGGTKNWGG

SEQ ID NO: 202658 - protein, 141 aa, Triticum aestivum
  unsure (1)..(141): unsure at all Xaa locations
  Clone ID: PAT_TA_97076.pep
MSGRGKGGKGLGKGGAKRHRKVLRDNIQGITKPAIRRLARRGGVKRISGLIYEETRGVLKIFLXNVIRDAVTYTEHARRKTVTAMDVVYALKRQGRTLYXFGGVRVVLALPASDVLVRNVRSLVKNLEMKSPCLSPLVPSE

SEQ ID NO: 202659 - protein, 103 aa, Triticum aestivum
  Clone ID: PAT_TA_97077.pep
PPLAFIRDNLLVVGLIDPLALVGVYNSRMDGRSSTACFLVMLVLFRSTTPAENCFIQRYLTVFCTKDECKLECLFHWNDKWIHEHWCDGKIFGKCNCNICPSG

SEQ ID NO: 202660 - protein, 158 aa, Triticum aestivum
  unsure (1)..(158): unsure at all Xaa locations
  Clone ID: PAT_TA_97078.pep
MAPTVMASSATSVAPFQGXLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKXLPMFGCNRXPTQVXXXVXEVKERSNLDAYVPHHRDFDKC

SEQ ID NO: 202661 - protein, 64 aa, Triticum aestivum
  unsure (1)..(64): unsure at all Xaa locations
  Clone ID: PAT_TA_97079.pep
MSDLXVKVPXAFDPFXEAXXEDSGAXXGSKXXVHVRVQHXNGXKXLTTVQXXXKDYRXNXIPTI

SEQ ID NO: 202662 - protein, 163 aa, Triticum aestivum
  unsure (1)..(163): unsure at all Xaa locations
  Clone ID: PAT_TA_97080.pep
SFPQQQPFPPQQPYPQPQPFPSQQPYPQPQPFLPQLPYPRPQPFLPQQPYPQXXPQYPQPQQPISQQXXQQQXXQQQXLQQILQQQLXIPCRDXILQQHTISACXAQQSFAKSYQLVNKLLSRQAWWRSEARRVAKANPTVWFMLISCSQTQQPTNKSPRLST

SEQ ID NO: 202663 - protein, 143 aa, Triticum aestivum
  unsure (1)..(143): unsure at all Xaa locations
  Clone ID: PAT_TA_97081.pep
EGGINTAKELLHWVGSLSLLLLLLTTITTHGKLFHQSITQRNARTHRPSPPCARRRAADIYVCNVNPVRWYTGRLHGKDTEKLRKTNSKMKKKQGSLLLSFPPDKASRAKNFRLLYNLQQPRKARDKPPTIRXPRXXXATXRP

SEQ ID NO: 202664 - protein, 137 aa, Triticum aestivum
  unsure (1)..(137): unsure at all Xaa locations
  Clone ID: PAT_TA_97082.pep
MQIFVKTLTGKTITLEVESSDTIDNVKXKIQDKEGIPPDQXQRLIFAGKQLEDGRTLADYNIQKESTLHLVLRLRGGXRKRKKKTYTKPKKQKXKHKEGESSPVLQFYKGRRTPPGKGDQGSRKGVAQTPNLGPFMG

SEQ ID NO: 202665 - protein, 106 aa, Triticum aestivum
  Clone ID: PAT_TA_97083.pep
STKCCTLFIHEIQLHVPAGAESPWPLPPARIAAASISACSFVSPPVISPGAAFPCRHRDRAPSPTSADLPAQPQIQQMHIGDHLLVLGVVGPNFGQANQLNGPLAN

SEQ ID NO: 202666 - protein, 140 aa, Triticum aestivum
  unsure (1)..(140): unsure at all Xaa locations
  Clone ID: PAT_TA_97084.pep
MAVTFSDLHTADGLKALEAHLAGKTYISGDGITKDDVKVFAAVPVKPSAEFPNAARWYDTVAAAVASRFPGQXSGVSASSAPAAXAAPAASKDEDDDDDMDLFGDXTEEXDKKLQLKREAAKACKRRKESGKXSSVLMDI

SEQ ID NO: 202667 - protein, 143 aa, Triticum aestivum
  unsure (1)..(143): unsure at all Xaa locations
  Clone ID: PAT_TA_97085.pep
MSRGGSAGGGQSSLGYLFGDGEPAKACCSTXAAKPAPAEKPAXAAADVTKQIPAGIPGSRANXNYYRADGQEHGATSLRDRPSTKVXHAAPGXWLRPWGYFVWAGKVNLLVKWMAAQNWACYLLSNVVKNWECLGFKFYPAVF

SEQ ID NO: 202668 - protein, 125 aa, Triticum aestivum
  unsure (1)..(125): unsure at all Xaa locations
  Clone ID: PAT_TA_97086.pep
GXXXXXGRVPXXDQKXGCQLIGVSXLFNXXFGKPPLCPKVSQNPTLPFSXQSXIRPPVDAPVGNSGPWRRFHLSSTHQPXRWGXRGLSKIWRPLTDWIVAAMAGALVFAWLGEEAEIESRGGREG

SEQ ID NO: 202669 - protein, 163 aa, Triticum aestivum
  unsure (1)..(163): unsure at all Xaa locations
  Clone ID: PAT_TA_97087.pep
LLPGRHHLRRPLSAATSGALCPARSIWIDPLQPSDSTTHPPPLWIPIPASSTLSRATLPTPRRNPSLRPLPPRWATPPWRPAAGCRWRRGSAPSGPXSATASASSSSLSCRLRTERQTSNLSRCGASGAGMESPTSAASGVGLLTXFLDRHGAAQXGAGPLPA

SEQ ID NO: 202670 - protein, 144 aa, Triticum aestivum
  unsure (1)..(144): unsure at all Xaa locations
  Clone ID: PAT_TA_97088.pep
MANPRVFFDMTVGGAPAGRIVMELYKDAVPRTVENFRALCTGEKGVGKSGKPLHYKGNXFHRVIPDFMXCQGGDXTGATGTGGESIYGEKFADEKFVHKHTKPGILSMGNAGPNNKXSQFFXIAPFPANWLDGKQVVFGEVVXG

SEQ ID NO: 202671 - protein, 72 aa, Triticum aestivum
  Clone ID: PAT_TA_97089.pep
DHLMKVSMTAWSTLKYYYKNECSRETSSRKNTSSCYQTYHLPCVGWKGKEISTKCFTTNRTGLGSNLTEYGT

SEQ ID NO: 202672 - protein, 107 aa, Triticum aestivum
  unsure (1)..(107): unsure at all Xaa locations
  Clone ID: PAT_TA_97090.pep
DSPSHRWHWNSLLQGLAVQHCRCRRRSVGAAAVCHTLAWRCLWRRRALSLTGSLRMNLDVSRAWQGAAYECDSQDCHGWXHGRRGRSHHMNTFSFSNSNWLYDDNGR

SEQ ID NO: 202673 - protein, 124 aa, Triticum aestivum
  unsure (1)..(124): unsure at all Xaa locations
  Clone ID: PAT_TA_97091.pep
MLEANEGAHGDGEQCDKVQSSDVMSFFSEYGDASRYKIEEIIGKGSYGVVCSXAIDRQTGDRVAIKKVSNIFEHITDAARMLREIKLLRLLXHPDIVQIKHIMLPPSRRDXKDIFVVFELMHGS

SEQ ID NO: 202674 - protein, 172 aa, Triticum aestivum
  unsure (1)..(172): unsure at all Xaa locations
  Clone ID: PAT_TA_97092.pep
RTPRXSCASXTPRPCSRLGRPAGGDRPVRPPPEIAAGEGLXRGRGFDLRFGSCGCAXXGCCRGXRRCRRCSXSSWAVGGGIKAPXSXPRXHWXFALXHAPAGSPAASAARSSXNFGXQKAPXNAGGXGSFXPRXLXGPPXXTRSEXTEXPPIPLNXXVXXLPXSXLGNFLPG

SEQ ID NO: 202675 - protein, 87 aa, Triticum aestivum
  unsure (1)..(87): unsure at all Xaa locations
  Clone ID: PAT_TA_97093.pep
AAXRQPAPRRRGRSHGAVILPLQXPTLXGGGXGHVXXLPLXLPPCRAHXLPRXNGSXXXNPPARGSSXSXFLYRQSXXRXNGXPRLG

SEQ ID NO: 202676 - protein, 101 aa, Triticum aestivum
  unsure (1)..(101): unsure at all Xaa locations
  Clone ID: PAT_TA_97094.pep
MAPTVMASSATSVAPFQGLKSTAGLPVSRRSNGASLGSVSNGGRIRCMQVWPIEGIKKFETLSYLPPLSTXALLKQVDYLIXRXKWVPCLEVQAKVGFIFR

SEQ ID NO: 202677 - protein, 117 aa, Triticum aestivum
  unsure (1)..(117): unsure at all Xaa locations
  Clone ID: PAT_TA_97095.pep
APWKPPRPSRAPSPSSPAPAAPPAPPSPRTCPPSPRRRASSRSAAPGRTPTSSGPSPPRRQPPPXPSSSARPAHGATMRTRRWRTCFHARRQRGNNSGRGRGAGGRRREGQRWGGSN

SEQ ID NO: 202678 - protein, 59 aa, Triticum aestivum
  unsure (1)..(59): unsure at all Xaa locations
  Clone ID: PAT_TA_97096.pep
PHSXILSLXNNCIWGGGGRSITXXXGXVXXXSWXEPLSPXTFPFFSXGGXNQLTPKXFY

SEQ ID NO: 202679 - protein, 168 aa, Triticum aestivum
  unsure (1)..(168): unsure at all Xaa locations
  Clone ID: PAT_TA_97097.pep
GSPGLEIAPKVAVAKXGHAKAQAAKVAKAVKSGSIXXTAKKIRTSVTFHRPKTLSKARDPKYPRISTPGRNKLDQYQILKYPLTTESAMXKIEDNNTLVFXVDLKADKKKIKGAVKKMYDXXAKKVNTLIKAXDXKKKAXVKADTXTTXALDVXQXGFGINIPREPWQ

SEQ ID NO: 202680 - protein, 144 aa, Triticum aestivum
  unsure (1)..(144): unsure at all Xaa locations
  Clone ID: PAT_TA_97098.pep
LAXAARGXPSTGASSASSGSXAGSASAAGAASXXTSSAAAGFXXATASLXXXSDXRRAXSASGSAAAAXSGSFVXSASXAAGAXSLVSSTSTGAGASTSASTGAGASSVFXTSSAATGXSTAGXSSVSAADGFWTSAVILVDAR

SEQ ID NO: 202681 - protein, 116 aa, Triticum aestivum
  unsure (1)..(116): unsure at all Xaa locations
  Clone ID: PAT_TA_97099.pep
QPSFSQQPLFSQKQQXVLPQQPAFSQXQQQTVLPQQPAFSQXQHQQLLQQQIPIVHPSILQQXNPXCKVFLQXQQCSPXVAXPQHLAMSXDXGSKKQLQCXAXXQCCQQLPXIPRP

SEQ ID NO: 202682 - protein, 178 aa, Triticum aestivum
  unsure (1)..(178): unsure at all Xaa locations
  Clone ID: PAT_TA_97100.pep
SSPGLVLQQQPSFSQXQPLXSXKQQPVLPQQPXAFSQQXQTVLPQQPXAFSQQXHQQLLQQQIPIVHPSILQQLNPCKVFLQQQCSPVAMPQHLARSQMWQXRSSCNVMQQQCCQXLPRIPEQSPLWRAXRAIIFSXIILQEQQQGFVXPQQQQXXXSRXQXVYQTQQQVASKQLRTF

SEQ ID NO: 202683 - protein, 143 aa, Triticum aestivum
  unsure (1)..(143): unsure at all Xaa locations
  Clone ID: PAT_TA_97101.pep
MLPPQLPGPAGHLPLALAVTASFAIKLQRWLRQRXLXRRRRAKPKPIVFPPPPLRRLVSSSLRRLLPRPRPLXGGWLGPRGRRKAPAEDVVLLVLSLGLGDXLAVLAEGWXGVRAWGKALXIWGGGVGGTRKRGLPEGRGCGI

SEQ ID NO: 202684 - protein, 98 aa, Triticum aestivum
  Clone ID: PAT_TA_97102.pep
TPVFLQNIHSEFQVSQRLPLTIADKVQRSKALVECDGDSIDLSGDIGAVGRIVISNGPTGNHDLLLDLKGTVYKSTIVPSRTFCVVSVGQTEAKVCRP

SEQ ID NO: 202685 - protein, 87 aa, Triticum aestivum
  unsure (1)..(87): unsure at all Xaa locations
  Clone ID: PAT_TA_97103.pep
MAAKEPMRVLVTGAXGQIXYALVPMIAXRGVMLXADQPVILHILXDIEFAAESLKGVXMEVDLMPHFHFSRGVVXTTXDVVEACTWW

SEQ ID NO: 202686 - protein, 122 aa, Triticum aestivum
  unsure (1)..(122): unsure at all Xaa locations
  Clone ID: PAT_TA_97104.pep
RXXTXXXQKXXWAKREXXXPXAXRXLXQSKTXXLPRPFVXGFXKSXGDPPXPPXPLRGVNQXHLCNVXWXREPWLPXHLAXRXARXRPXRAXGPTAGRRLAXTARKGEGARXGSVRXPLLAT

SEQ ID NO: 202687 - protein, 92 aa, Triticum aestivum
  unsure (1)..(92): unsure at all Xaa locations
  Clone ID: PAT_TA_97105.pep
MVXDAAALAVVKXARPVFRGAHDGVAFAANAAFLAXGYSLCAVGPARARRPPPPQVDXXGGKLMGWNTMXTNCYALSGTXKEEGGAKKKHFK

SEQ ID NO: 202688 - protein, 70 aa, Triticum aestivum
  unsure (1)..(70): unsure at all Xaa locations
  Clone ID: PAT_TA_97106.pep
HXXVHXVXIAILCLNFAHGTPLCFPAGIXRRXAGGXKPELXNTDQLQGVDSKCTRXPAXTILNFPRXFRG

SEQ ID NO: 202689 - protein, 122 aa, Triticum aestivum
  unsure (1)..(122): unsure at all Xaa locations
  Clone ID: PAT_TA_97107.pep
MKTFLIFVLLAMAMNIATAARQLNPSNXELQSPQESFSHQQQPFPQKPXPQQPYPSXQPYPLQQPFPTPQXXFPRPQQPXPLXPXQPFPQXSHXXPFPQXXHSFPWEXXQPFPKTQXSVPSG

SEQ ID NO: 202690 - protein, 105 aa, Triticum aestivum
  unsure (1)..(105): unsure at all Xaa locations
  Clone ID: PAT_TA_97108.pep
MSCCGGNCXCGXGCKCXNGCGGCKMYPXMDEGVTTNSQTLIMGVPPSKGTPSFEGAAETGAXQRAGAKCGSNCTCNPVAPAKLIHQIKDKGDQWQWNGTLNERST

SEQ ID NO: 202691 - protein, 146 aa, Triticum aestivum
  unsure (1)..(146): unsure at all Xaa locations
  Clone ID: PAT_TA_97109.pep
MGKEKTHINIVVIGHVDSGKSTTTGHLIYKLGGIDKRVIERFEKEXAEMNXRSFKYAWVLDKLKAERERGITIDIALWKFETTKYYCTVIDAPGHRXDFIKNMITGTSQAXCAVLIIXXNTGXVFEAXIXKGRPVEQRPAFHSLGV

SEQ ID NO: 202692 - protein, 170 aa, Triticum aestivum
  unsure (1)..(170): unsure at all Xaa locations
  Clone ID: PAT_TA_97110.pep
GSEGVKGTIFFTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVXHGDADDLGKGGHELSKXSTGNAGARXVACGNIXPPAKMSSSPDQTSLQIWGTFSKMQICNP

SEQ ID NO: 202693 - protein, 84 aa, Triticum aestivum
  unsure (1)..(84): unsure at all Xaa locations
  Clone ID: PAT_TA_97111.pep
MTPEGSGGRGGGGEMALRPGPPQAAAPLEDEDVLGEILVRLPPLPSSLVRAAAVSRLWGRLAADRAFLRRFRNXXRXAPVLXXF

SEQ ID NO: 202694 - protein, 126 aa, Triticum aestivum
  unsure (1)..(126): unsure at all Xaa locations
  Clone ID: PAT_TA_97112.pep
MSSSEVACTLAALILHDDGIPITSEKIATVVKAAGIKVEAYWPALFAKLLEKRSVDDLILSVGSGGXGGAPXAAAAAPAAGGAAAAEEKXEKXKEXGKGKRXDDDMGLQAFEPKAVQIPSSPCGFF

SEQ ID NO: 202695 - protein, 128 aa, Triticum aestivum
  unsure (1)..(128): unsure at all Xaa locations
  Clone ID: PAT_TA_97113.pep
MKTFLVFALLALAAASAVAQISQQQAXPPFSQXXQPPFSQXQXQPPFSQQQXSPFSQXQQQPPXAQQQQPPFSQQPPXSQQHQPPFSXQXQPQFSQQQXPPYSQQHQPPYSQXQXQPPFSQQXTILQA

SEQ ID NO: 202696 - protein, 114 aa, Triticum aestivum
  unsure (1)..(114): unsure at all Xaa locations
  Clone ID: PAT_TA_97114.pep
FXPHLSKXIDMTSARSGLPCXXLLVFVTVSFFPNHTWASKSQAAIEKDEVMEHCKFNIRKGVHWPFEPSQACLPSSDAFSEPPGNLQCVYRRRFGSDQSTKVGCHHSLVRQRVA

SEQ ID NO: 202697 - protein, 109 aa, Triticum aestivum
  unsure (1)..(109): unsure at all Xaa locations
  Clone ID: PAT_TA_97115.pep
NVITEGPSITSKVLGNAQGMYVRHSKRWVXILMAIDVEITTGPFNGSFVXLFSRNPLRSTRELPVIGGRGVFRMAEGYGMLRTVCVHCLNSVNPASGDVIEYNVTLWHH

SEQ ID NO: 202698 - protein, 163 aa, Triticum aestivum
  unsure (1)..(163): unsure at all Xaa locations
  Clone ID: PAT_TA_97116.pep
VHPSILQQLNPCKVFLQQQCSPVAMPQSLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRSLXRMCRVNVPLYRNNTSVAIRWR

SEQ ID NO: 202699 - protein, 108 aa, Triticum aestivum
  unsure (1)..(108): unsure at all Xaa locations
  Clone ID: PAT_TA_97117.pep
SXXYXXXQGEWGGGXNXXXGXPSTKKWXSXSPPPXXRXPYPPPAFNAGXSTRSVAFPXPGADXAGXAAXPXRPXPXPVXSXEACVXVGVRXRQPPSFTXQSPTRRXSG

SEQ ID NO: 202700 - protein, 161 aa, Triticum aestivum
  unsure (1)..(161): unsure at all Xaa locations
  Clone ID: PAT_TA_97118.pep
LSPESQQGASKPGRWTPSKLKKVAGKKFGGPRKKSVTRSVKAGLQFPVGRIGRYLKXGRYAQXRVGSGRPPSNSPPVLEXXLAAEVLXLGRERRQGKKXXPASLPXNLLLXXRKRTRKREGWLSGNNPPQRGGHSPKITRVGWPQRTGGPRPPQKGKVPPQ

SEQ ID NO: 202701 - protein, 170 aa, Triticum aestivum
  unsure (1)..(170): unsure at all Xaa locations
  Clone ID: PAT_TA_97119.pep
XMNAPKSTEGAXFQHGPAPAHHVRIIYYCHSCFLPASTRCGAHXAGDGVXTGRDGSHXVYYRSLCLSXXTEISAIHPKSSRRSANWPTSPRKEXPQLPTPKPQPSPAPAXTVPNXPPXGRGDRTEGCPAXNGPKAGLFXPSSLLPRGRGXGPXLSNXKXPWNXRRAXGVP

SEQ ID NO: 202702 - protein, 141 aa, Triticum aestivum
  unsure (1)..(141): unsure at all Xaa locations
  Clone ID: PAT_TA_97120.pep
MARTKXXAXKSTGGKAPRKQLATKAARKSAPATGGVKKPHRFRPGTVALREIRXYXKSTALLDPQSCPSSGLVREIAQDFXXRPSASNKLPPVVRRLQRAARRLPRGRPFGGTNNLLAITAKAQQSMAQRESAARREFGGR

SEQ ID NO: 202703 - protein, 127 aa, Triticum aestivum
  unsure (1)..(127): unsure at all Xaa locations
  Clone ID: PAT_TA_97121.pep
KSTMKTFLIXALLATGXNQPPQLQLEFQCHNCSHKXPSQQQPXRASSIGXXQXVIXXGXXXPISTXXTISAAXXHFPSQXNXSAXXXISXXRXLTYPQXXAINIPXGXXHFLXTXNXYXTTANXKXF

SEQ ID NO: 202704 - protein, 68 aa, Triticum aestivum
  unsure (1)..(68): unsure at all Xaa locations
  Clone ID: PAT_TA_97122.pep
MFELGXTKTDPXXXIYFXPXSVAKLAASSXXRXLXAXSLLXSIAARXXYGFGDWGRGRLEMGLGSWDC

SEQ ID NO: 202705 - protein, 47 aa, Triticum aestivum
  Clone ID: PAT_TA_97123.pep
YECQASNNYVLCAPRMPCSYIYMIISLVFSLVQKLVYFTSQNTHELR

SEQ ID NO: 202706 - protein, 70 aa, Triticum aestivum
  unsure (1)..(70): unsure at all Xaa locations
  Clone ID: PAT_TA_97124.pep
LAEIFLLGKMGPNWXXXLMXXYQXLIRYKGXNAITSXPVXWGKTANGICYXGLXIKTYLXEGFRYXTCLL

SEQ ID NO: 202707 - protein, 160 aa, Triticum aestivum
  unsure (1)..(160): unsure at all Xaa locations
  Clone ID: PAT_TA_97125.pep
AIRRVSSIFSIPRESACILLRQYKWNISKLSDEWFADEERVRHFVGLPTNGAVLPDCQELTCGICFEGYSTTALSSAGCVHLYCHECWEGYITXSINDGPGCLSLRCPXPSCTAMVLEETINRLAKDEEKVNVQTIFIMLIPLXXTXRIKWGSPLCTPGV

SEQ ID NO: 202708 - protein, 167 aa, Triticum aestivum
  unsure (1)..(167): unsure at all Xaa locations
  Clone ID: PAT_TA_97126.pep
XNXPHQXVGPTXTLLLGPGEAGVXXGPAFXCLQXRRASPXWRTLPASDSADGEQHGGADADPRGRPVTAVNLDGEGDVGRCPHGEQRERVHGVHHLAVAGPGCTTGEGQRRVGRRRRRELHPADDQPDEEPLREHEPYERPGGDLQIQRRQCHLSSRSLAGSVQERA

SEQ ID NO: 202709 - protein, 81 aa, Triticum aestivum
  Clone ID: PAT_TA_97127.pep
LLIRETWTSIRSRGRACACCCSWHSCCFLQGLKVKVKVGLAQRSARPTPTLFVCLYLATGAEPENLVDGFIHYLIVRIWSN

SEQ ID NO: 202710 - protein, 59 aa, Triticum aestivum
  Clone ID: PAT_TA_97128.pep
IYALTGALPRSRPRHRPPVVQNQLNCYFPARGYRRSTRSPTGCRMITESLNSPSIVAQQ

SEQ ID NO: 202711 - protein, 74 aa, Triticum aestivum
  unsure (1)..(74): unsure at all Xaa locations
  Clone ID: PAT_TA_97129.pep
AXVXPLXXGDEXXPQGXGEEGXSFQXPXGGGTTGGSPXTARRXXXRQXAVRAGLARPXTXDVRXQTXGSXGVGL

SEQ ID NO: 202712 - protein, 143 aa, Triticum aestivum
  unsure (1)..(143): unsure at all Xaa locations
  Clone ID: PAT_TA_97130.pep
EVKSVEMHHESLLEALPGDNVGFNVKNVAVKDLKRGFVASNSKDDPAKEAANFTSQVIIMNHPGQIGNGYAPVLDCHTSHIAVKFAELVTKIDKXSGKEIEAAPKFLKNGDAGIVKMIPTKAHGLWRTLPLTPPPWVFAVPLT

SEQ ID NO: 202713 - protein, 140 aa, Triticum aestivum
  unsure (1)..(140): unsure at all Xaa locations
  Clone ID: PAT_TA_97131.pep
PLPGILAVSXQIASPLLSSPPDLRPATRRPQSGAIRPEPPRSGLSLPAVMPRTAGLLLLLAFSGAAVAAAAEDSTAGILPAGGNNGTGIKDXXVGRTXQNGEADXTTQQKVQLXGGAQRXSFPRTLTRGNSMGGXXHREK

SEQ ID NO: 202714 - protein, 147 aa, Triticum aestivum
  unsure (1)..(147): unsure at all Xaa locations
  Clone ID: PAT_TA_97132.pep
MAPTVMASSATSVAPFQGLKSTAGLPVSRRSNXAKXLAASANGGRIRCMQVWPIXGIKKFETLSYLPPLXTEALLKQVDYLIXSXWVPCLEFSXVGFIFREHNAXSPGYYDGRYWTNXWKLXMFGCTDATQVIKXGGRRSKKEYPDX

SEQ ID NO: 202715 - protein, 53 aa, Triticum aestivum
  Clone ID: PAT_TA_97133.pep
LIKFTKKYHAPNHYVYYTRSRLIRVRLLPSSMTIITICKHYKRVIVLLVGAQL

SEQ ID NO: 202716 - protein, 162 aa, Triticum aestivum
  unsure (1)..(162): unsure at all Xaa locations
  Clone ID: PAT_TA_97134.pep
PQQPFPQPQQPQQPFPQSQQPQQPFPQPQQQFPQPQQPQQSFPQQQQWMIQSFLQQQMNPCKNFLLQQCNPVSLVSSLVSIILPRSDXQAXCKQQCCQRLAQIPQQXSKCAGIHNVAHSIIMQARNNNEGVQXLRPLFQLAQGXGIIQPQQPAQXGGGSGWY

SEQ ID NO: 202717 - protein, 115 aa, Triticum aestivum
  unsure (1)..(115): unsure at all Xaa locations
  Clone ID: PAT_TA_97135.pep
PKGXQXGLLHCPXDXERAEVXHGPAXGXXVVGXXRHGXHGXHXHXVSVXXPGXIFVXIRRSRXRGXRMLLDLILQARRSAESSKXXEIXRXXAEAQGRKPNRXEEAGQMERXGDX

SEQ ID NO: 202718 - protein, 145 aa, Triticum aestivum
  unsure (1)..(145): unsure at all Xaa locations
  Clone ID: PAT_TA_97136.pep
MARTKQTARKSTGGKAPRKQLATKAARKSAPATGGVKKPHRFRPGTVALREIRKYQKSTELLIRKLPFQXRLVREIAQDFKTDLRFQXSSAVSALXEXAEAYLVGLFEDTNLCAIHAKARHHHAQGTSKLARXRIRGERGYASKS

SEQ ID NO: 202719 - protein, 161 aa, Triticum aestivum
  unsure (1)..(161): unsure at all Xaa locations
  Clone ID: PAT_TA_97137.pep
XQPFRPQQPYPQPXXQYSQLQQPISQQQEQQQQQQQQQQQQQQQQXQQQQQQXXAXTXXTTXQQILQXXLQQQLIPCMDVVLQXHNIAHGRSQVLQQSTYQLLQXLCCXHLXAXFLSSPQCPGPSNXVVHAIILXQQPSKQPSEPGSPSRLNKPIRAQGRP

SEQ ID NO: 202720 - protein, 142 aa, Triticum aestivum
  unsure (1)..(142): unsure at all Xaa locations
  Clone ID: PAT_TA_97138.pep
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKEGXKLAVLQFYKXVDDPPGKVTKLKEGVAPTPSGGAXTFMGKHFQP

SEQ ID NO: 202721 - protein, 139 aa, Triticum aestivum
  unsure (1)..(139): unsure at all Xaa locations
  Clone ID: PAT_TA_97139.pep
PPPPSPSPPPPLPSPPPPSPPPASPPPXSPPPPVHHSPPPPKPVHSPPPPKPVHSPPPXKAKFXSPPPPKPVHHSPAPPKPVQHSPXPXKAVXXXPPPPPAPHPHPXCXPPPXALCCPPPAINRRNLFTRENCQVSVNM

SEQ ID NO: 202722 - protein, 139 aa, Triticum aestivum
  unsure (1)..(139): unsure at all Xaa locations
  Clone ID: PAT_TA_97140.pep
LEVESSDTIDNVKAKIQDKEGIPPDQQRLIFAGKQLEDGRTLADYNIQKESTLHLVLRLRGGMQIFVKTLTGKTITLEVESSDTIDNVKAKIQXDKEGIPPDQQRLIFAGKQLEDGRTLAGYNIQKESTLHLVLRLRGG

SEQ ID NO: 202723 - protein, 124 aa, Triticum aestivum
  unsure (1)..(124): unsure at all Xaa locations
  Clone ID: PAT_TA_97141.pep
AGLXXGIXPLRXRXIPYTKKKFAPFENXVELIXKHAVPVPKGECSKSSQLGNNFAGXXLPGVXCXAIVSXPXEKLGLFPQKMPRGATXGDAVKQXGMLGLFTKXGYPFRIVKIGTPNGXSSGGI

SEQ ID NO: 202724 - protein, 131 aa, Triticum aestivum
  unsure (1)..(131): unsure at all Xaa locations
  Clone ID: PAT_TA_97142.pep
EESGNARRIILPHNRXLRLPLQRMRPPPWRSGDARPARPPQYPRGASLRSLLEKMRARLSGGHFKMLNEKLYTCKWAXMHLTTLKTKPEAFLTCIMQGYQEQMSHLAXAXKFNVIIKVGXRSHNKSXGRLL

SEQ ID NO: 202725 - protein, 119 aa, Triticum aestivum
  unsure (1)..(119): unsure at all Xaa locations
  Clone ID: PAT_TA_97143.pep
MNPYADNRYADPSSYRDRRSDLAAAPILAPPVPVAPAQNPYAAPYTPMAAPVGGFGQGGXGYGGGMGYGGXKAKXGGXRPVGPWLPGGGKAGRGRGSTSLSPGPKGGLSGGLIVSRKKF

SEQ ID NO: 202726 - protein, 152 aa, Triticum aestivum
  unsure (1)..(152): unsure at all Xaa locations
  Clone ID: PAT_TA_97144.pep
MGRRTHAVPAAAAAALLLAFLHLHVAAAADPPFSCGAASAAPYCDRKLPIEQRAADLVSKLSLEEKISQLGDESPAVARLGVPAYXWWSEALHGVAWSKGMHLDXPLRAATXFPQVILTAXASFNPHLWYRIGQMXXTEARGVYNNXQAEGV

SEQ ID NO: 202727 - protein, 62 aa, Triticum aestivum
  unsure (1)..(62): unsure at all Xaa locations
  Clone ID: PAT_TA_97145.pep
PHPRLAFLERETRAPHNPIXXRXPTEVXERXTSXXLSPXLXRVEEERXHXXGPXPXRXSXHT

SEQ ID NO: 202728 - protein, 127 aa, Triticum aestivum
  unsure (1)..(127): unsure at all Xaa locations
  Clone ID: PAT_TA_97146.pep
VPLGGXPXTPXPWGEXRXGXXXPKREGXRNPPGGPVLGAERGKFAIXEXCSXGXSSPGXXQGRQAIAGPVEQGTPVPLPAVPPARRPXTTTGTRPXRVTPPAAQTASLLGRRLPXIFFFGGGDVGGW

SEQ ID NO: 202729 - protein, 154 aa, Triticum aestivum
  unsure (1)..(154): unsure at all Xaa locations
  Clone ID: PAT_TA_97147.pep
MQQQQQFPGEQEQFPPQQPYPHQATISIXQPYPQPQPFPPQLPYPQXNQQPQQPFPQQPQQQFPQPQQXQQPFPQPQQPQLPFPQQPQQPFPQPQQPQQPFPQXLQQPQQPLPQAQQXXQPFPKXXQTLXQPYLXQQXEXPGRXXSXXXWQPWC

SEQ ID NO: 202730 - protein, 105 aa, Triticum aestivum
  unsure (1)..(105): unsure at all Xaa locations
  Clone ID: PAT_TA_97148.pep
DLERLLPAEVKEVILFNTVANDSSVETMDIVHEXXLVTSSEKRKLXDQXVVADEPIXRQRHVDTLKIPKQQTSKLXSSDSPKVVVRXAXKHXLXRXDSTAKWEVL

SEQ ID NO: 202731 - protein, 144 aa, Triticum aestivum
  unsure (1)..(144): unsure at all Xaa locations
  Clone ID: PAT_TA_97149.pep
TSNNGRAEXXGGRSGPFPKPRSKGHXXIDSSARPNVPTSGNQRNWRTFXNWSAXVLKKXPHLNRXFXNQSNLWXKXLGXKTXKWGRQXGHLFANXKKPXKIINWWQILAXGPNWTXGACPSXVXAPIXTWVAXRQFAGKGTLPG

SEQ ID NO: 202732 - protein, 95 aa, Triticum aestivum
  unsure (1)..(95): unsure at all Xaa locations
  Clone ID: PAT_TA_97150.pep
XGSPXKESRRRASSYQFKSKANGXXRRTGLPSXXKGSPIXLRSITAGFFGQXXGNXXXMLXQXAKXGEMXRIXPKXXRPKXGXPPPFSKXNXXKG

SEQ ID NO: 202733 - protein, 51 aa, Triticum aestivum
  Clone ID: PAT_TA_97151.pep
SLLTRWRQRHQGPRQLATRSSGRPLIDLPWRRAREATGARAPRRATMTARG

SEQ ID NO: 202734 - protein, 106 aa, Triticum aestivum
  unsure (1)..(106): unsure at all Xaa locations
  Clone ID: PAT_TA_97152.pep
MDASXTGAGAKAXXGAAGRKGGGPXKKSVTKSVKGGLXFPVGRIGRYLKXGXYAKRVGTGAPFTRXVLXVLPAGACWELXREPXPKDKKXIPAILPKATLLVPLRE

SEQ ID NO: 202735 - protein, 158 aa, Triticum aestivum
  unsure (1)..(158): unsure at all Xaa locations
  Clone ID: PAT_TA_97153.pep
KLRHHQGRTPKGPSQAFGFEPHQRGTAVASLSRRHNPGPGTERVHNAAPRALGCTRFAIQRASYARFVHPHXRAQXRQPEESPRTCVXARASAEATGPRQPATDGGGERPRRRRAARALPGXCHRRRRVLEETLVGXLAAAVRFSSRPARGSDRGALS

SEQ ID NO: 202736 - protein, 73 aa, Triticum aestivum
  unsure (1)..(73): unsure at all Xaa locations
  Clone ID: PAT_TA_97154.pep
MAAXAXTXTATATAAAVGAXEVISVHXLXQXXMQXIRRPTAAXKLXVIDFXASXCGPCRIXAPIFXDLXXKFP

SEQ ID NO: 202737 - protein, 148 aa, Triticum aestivum
  unsure (1)..(148): unsure at all Xaa locations
  Clone ID: PAT_TA_97155.pep
EQQTVSFPKPAAVEEQQSVSFPKPAPVEKQQTVRSPKPAPMKKEQTVSSLKSALVKKEQTVSSLKPALVKKEQTASFLKPAPAENQQTASSPKPAPVEKEXTVSSPKPAPVXKEQTSKLPEACFGEERTDSKLPEACFGEERADSKAP

SEQ ID NO: 202738 - protein, 90 aa, Triticum aestivum
  unsure (1)..(90): unsure at all Xaa locations
  Clone ID: PAT_TA_97156.pep
XIQQQVXSELTRSALAMAASTAARRFLLLLAGVTVVSVGRRGAGCRRHPRRSRNGCYSRSGTRSRXTGQXRHSXHRVLTXYRVNGLQTXP

SEQ ID NO: 202739 - protein, 117 aa, Triticum aestivum
  unsure (1)..(117): unsure at all Xaa locations
  Clone ID: PAT_TA_97157.pep
MARGLKKHLKRLNAPSHWMLDKLGGAFAPKPSSGPHKAXECLPLILILRNXLKYALTYREVQSILXXRHIMGDXKGPTDNTYPAGFKDIISIPKTGXNYRXLYDTKGVVSPFLRERC

SEQ ID NO: 202740 - protein, 115 aa, Triticum aestivum
  unsure (1)..(115): unsure at all Xaa locations
  Clone ID: PAT_TA_97158.pep
KGFLSPKSGQPRCXAXPPRGGARLRRTKADEEXAKKPRLDMXDARVKQEXIAGGXEGXXIIXEAAEGXXIPXXXLXVRIXKRXAYRSXLQHPSSXXPSXTXKXXASLPSGXCVPP

SEQ ID NO: 202741 - protein, 135 aa, Triticum aestivum
  unsure (1)..(135): unsure at all Xaa locations
  Clone ID: PAT_TA_97159.pep
MPAGHGLRSRTRDLFARPFRKKGXIPLTTYLRTYKVGEHVHVKVNGAVHKGMPHKFYHXRTGRVWNVTKPAIGVEXNKXVXNKDXQKRGFMFRCWSTLQPSKVATREFLQGSSNNKKGPKALEGHQPKGKPNGPK

SEQ ID NO: 202742 - protein, 135 aa, Triticum aestivum
  Clone ID: PAT_TA_97160.pep
WRRLPWSAAATSRRPRRTPSPTPPSSAPATPPPPRRRGGPRTTPRRSSPPLPSSPNKTPSPCAASPSPPVPLSPSRPRHLPPTTTTPPNLAGSLGFAPGRSGAPSSSTPAPDPEPQASKQQQAKSNRPVAVVDPL

SEQ ID NO: 202743 - protein, 106 aa, Triticum aestivum
  Clone ID: PAT_TA_97161.pep
LIWVDQHRQMCGIVDQLTIIQLVHANPHARDEFQGWSFSAASRRPHGSRRTGVIHPQDEKHMPRDSAATMQPRCAQPRAPPSRPCCPEATTPQTLGDFPRLTKFHL

SEQ ID NO: 202744 - protein, 110 aa, Triticum aestivum
  unsure (1)..(110): unsure at all Xaa locations
  Clone ID: PAT_TA_97162.pep
MSNSSWTAPGSSALETVETKISPSILFIVAVLAIVFFVCGLLHLLARHLLRXRRRRRAARDDAEGSVTAFQGQXCKQLXHLHDAGVEQXFXDALPVFLYRNXLLGRGLGP

SEQ ID NO: 202745 - protein, 169 aa, Triticum aestivum
  unsure (1)..(169): unsure at all Xaa locations
  Clone ID: PAT_TA_97163.pep
LTTESVVASPDAEGGAAATQADDEAESGAPGSPSPPRPPPSISGRRDPLRAACFRRLAASCEARRLREAELLRASKPPAEKAEDPEEPIWPPKSRHWWRFVELKTMGSNPANPVPNPDEEFIISYQRSQDMFXLTXVCGTNGIDKLTLKNSSGKVHHIKFVPLQXXPXG

SEQ ID NO: 202746 - protein, 146 aa, Triticum aestivum
  unsure (1)..(146): unsure at all Xaa locations
  Clone ID: PAT_TA_97164.pep
QHSTMVISSRTCCYLLFSGFYRXCAXXRXIXLCLDPISAAVAPFPGEVAGGELRGGQMGRPAARSXKMSRTSRMAALQKRAAAAAGEELAGAGAAXGVAARDERPRPLVPPPCNTQAXSPAPPPRXRQLRVRPPXTRRVLXRRAPD

SEQ ID NO: 202747 - protein, 161 aa, Triticum aestivum
  unsure (1)..(161): unsure at all Xaa locations
  Clone ID: PAT_TA_97165.pep
LIQLPRSRSSPECDQDILNVFERSLNEQVRSNELKELEIGLNMRKLQLKQSHLALSSYSHMLEKIKISMGFQKAAFREEKLKTQMQDTRHAELLKRLIDMLLTAVVFMSACFGYXTYIYSYQRITAVTAACAAASRESKSWXVPNSGINFQLKDCCFSNVN

SEQ ID NO: 202748 - protein, 87 aa, Triticum aestivum
  unsure (1)..(87): unsure at all Xaa locations
  Clone ID: PAT_TA_97166.pep
MASSALNFXTRAXVTDPGAXIDAADXVXSXXILHRRXPVRQGRVQHLXGXGSVSPVXRXPPARXSHXSRRRXLXPHLLXQELXNXRN

SEQ ID NO: 202749 - protein, 72 aa, Triticum aestivum
  unsure (1)..(72): unsure at all Xaa locations
  Clone ID: PAT_TA_97167.pep
QQSQQSXQPFPGPQQLFPEXQQPXPQQSQXPFPLQAQQXFPQQXQXPFPQQAXQPFPLXPQQPFPXTTNHSP

SEQ ID NO: 202750 - protein, 137 aa, Triticum aestivum
  unsure (1)..(137): unsure at all Xaa locations
  Clone ID: PAT_TA_97168.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIXNMITGTSXADCAVLIXDSXTGGFXXGYXQRMGKTLEQ

SEQ ID NO: 202751 - protein, 127 aa, Triticum aestivum
  unsure (1)..(127): unsure at all Xaa locations
  Clone ID: PAT_TA_97169.pep
IGILGVGGFGCVAHGTDTRFIPXRHRNGRPNAYPRFDGSLAMASSSLTSGRFSGSSAHRSSRVGVGGRFSSRRIRLFLVRDLILRRSGLVVFAPPTFSLPRLRQPTPSLLWIFNPASALLIASTSIA

SEQ ID NO: 202752 - protein, 32 aa, Triticum aestivum
  unsure (1)..(32): unsure at all Xaa locations
  Clone ID: PAT_TA_97170.pep
HALSCKNPNYTSSNLGIKDKHRSCLXXKKKXK

SEQ ID NO: 202753 - protein, 76 aa, Triticum aestivum
  unsure (1)..(76): unsure at all Xaa locations
  Clone ID: PAT_TA_97171.pep
MAVTFSDLHTADGLKALEAHLAGKTYISGDGITKDDVKVFAAVPVKPXAEFLNAARWYDSVAAGVSSKVPGQGLWG

SEQ ID NO: 202754 - protein, 66 aa, Triticum aestivum
  unsure (1)..(66): unsure at all Xaa locations
  Clone ID: PAT_TA_97172.pep
CMVMSVMLVVEALYNCVVXIGVKAVGWRPEWRFKWEPLAGDDEENGGPHYXVVLXXXPXYNXVXGV

SEQ ID NO: 202755 - protein, 51 aa, Triticum aestivum
  unsure (1)..(51): unsure at all Xaa locations
  Clone ID: PAT_TA_97173.pep
WLLGLXGWVFFVAXVRXXLXSTSIFASXEXXCHRQGPLPMNKXXHVGHAHK

SEQ ID NO: 202756 - protein, 109 aa, Triticum aestivum
  unsure (1)..(109): unsure at all Xaa locations
  Clone ID: PAT_TA_97174.pep
VXLVXXXTXQIKXEXXLDQNSRVTGPXSXKXGLSPRRVGKGELAKLKEGSAARELQQPPSXXLGRNSFPSSXAEAPDXQLRKHAGLKVPQPATNPFGLMFXQLAGXQSX

SEQ ID NO: 202757 - protein, 121 aa, Triticum aestivum
  unsure (1)..(121): unsure at all Xaa locations
  Clone ID: PAT_TA_97175.pep
MARLNSKAVAAAVVLAAVVLMMAGREASAALSCGQVDSKLAPCVAYVTGRASSISKECCSGVQGLNGLARNSPDRKIACRCLKSLATSIKSINMGKVSGVPGXCXVSVPFPSXXNNCNNVN

SEQ ID NO: 202758 - protein, 155 aa, Triticum aestivum
  unsure (1)..(155): unsure at all Xaa locations
  Clone ID: PAT_TA_97176.pep
AAEKTKVLITALKKQGASEVGVGGYCWGAKVXVXELSKSEKIQVIVISHPSLVTVDDMKEVKHPIEILGGELDQAXPPPIVXXFEQPLVQKNKFAHFVNXFPGVPHGFXCRXNASDAFAVKTAEEARANMLSWFDKXLXKHKESPTTLKNPFQSC

SEQ ID NO: 202759 - protein, 63 aa, Triticum aestivum
  unsure (1)..(63): unsure at all Xaa locations
  Clone ID: PAT_TA_97177.pep
AFFSSXRVFLLFSDLSXXILLERCRSRSCNTNRNGGXXAXHLRGXXGXHDHSHRHVXRRCRQG

SEQ ID NO: 202760 - protein, 89 aa, Triticum aestivum
  Clone ID: PAT_TA_97178.pep
HCQLDALHPISVIRLDVACVCFVRFCMHSHKNYDPTILEYVKLLSYHDVKHTTIMSMLSENEDGSYFLSMTGRDLLTSKYSKMHILQCT

SEQ ID NO: 202761 - protein, 153 aa, Triticum aestivum
  unsure (1)..(153): unsure at all Xaa locations
  Clone ID: PAT_TA_97179.pep
PHPISPGNLRSKRSQGSLVLLLKMQIFVKTLTGKTITLEVESSDTIDNVKAKIQDKEGIPPDQQRLIFAGKQLEDGRTLADYNIQXKESTLHLVLRLRGGMQIFVKTLTGQDHHPSXVESSGTIDNVXAKIQGQXRAXPRDQQRLNXLLGKXL

SEQ ID NO: 202762 - protein, 132 aa, Triticum aestivum
  Clone ID: PAT_TA_97180.pep
KSNNRHKNCCRHTQDYSSTTCSVHHFKLLGKPSIIFSIRPQKFRKTIHVPVYLLLEPFAVCFQGFYFFRIYGSPSEMICPPGPPLDKSRAAGGGESAWTGPRDLRPRAGTFVSRERSAIRSCEFVGGGGGGG

SEQ ID NO: 202763 - protein, 50 aa, Triticum aestivum
  unsure (1)..(50): unsure at all Xaa locations
  Clone ID: PAT_TA_97181.pep
ETKWDSPGAXKEFXATKXGANVKTNNPNVWGNLEIKPILIQGLLIQWGLK

SEQ ID NO: 202764 - protein, 129 aa, Triticum aestivum
  unsure (1)..(129): unsure at all Xaa locations
  Clone ID: PAT_TA_97182.pep
EEGGKVXRIELPGELPXRRLEGTKDFELPPGLRKSGXGGRXSLVSXXVXXAGPPFAXXRPGWAXPLPSNLVGAQPATFLPPFPSPLFLFPSLASAXFGLLPGRGSLRASRXXXWLLFVELVXLVEVCWS

SEQ ID NO: 202765 - protein, 128 aa, Triticum aestivum
  unsure (1)..(128): unsure at all Xaa locations
  Clone ID: PAT_TA_97183.pep
XGKPVTLSSPPTFVSXXPARFWYSLRVAQSPVVVALRACRGGACNDSGPPPLPACRPAGNAGLPPSARRIVSFXETGTARLPPFVAAAPVFRQRTFGGRQAFFGCSAVATPAASCRISLQAPGESNNF

SEQ ID NO: 202766 - protein, 90 aa, Triticum aestivum
  unsure (1)..(90): unsure at all Xaa locations
  Clone ID: PAT_TA_97184.pep
MPTETRRPAPDLXCTRPAATWPPLGMRPTPRSTIPPRATPRTERPAPPCXTPRRPGPPRARTPXEVIGPRRSPRRRKRAPPPPSRAGFAR

SEQ ID NO: 202767 - protein, 158 aa, Triticum aestivum
  Clone ID: PAT_TA_97185.pep
GNKRRRSNPAAPPPLDVPAPSGDSNSHGYNGIGSSTPGAAFPDENGAEDVMYLEQESGHHLYFDEGAAFVADGNLDGITLDGIAPDQAETMAVLTDVGDNGVVAGDNGVVGNDAAPQNAVNNGGNPQNAVNNGGNPQNAVNNGGNSQNGNCNVLLPRS

SEQ ID NO: 202768 - protein, 105 aa, Triticum aestivum
  unsure (1)..(105): unsure at all Xaa locations
  Clone ID: PAT_TA_97186.pep
EYNKSRFIPIKREPLSHLFRLPRTAVLGVAVDVAFFLLTVAGLLVATMSPHVEGSKSHGQMAGSVIMEVGLFGMLVTACFVTIPAFILHAWRNDQAXWXARSQCC

SEQ ID NO: 202769 - protein, 109 aa, Triticum aestivum
  unsure (1)..(109): unsure at all Xaa locations
  Clone ID: PAT_TA_97187.pep
MGKIKIGXNGFGRIGRLXARVALQSDDVELVAVNDPFITTEYMTYMFKYDTVHGHWXKHSDIKLKDDKTLLFGEXKPVTVFGVRNPXEEIPXGXEAGADYVVESTGCLH

SEQ ID NO: 202770 - protein, 137 aa, Triticum aestivum
  unsure (1)..(137): unsure at all Xaa locations
  Clone ID: PAT_TA_97188.pep
CEMARGAAAAAXVXKGKKKGSVSFVIXCTKPVEDXXHGDRVAGXLPPXXHQXRRACKAQXPPATPSPSTRXQEQXSPVTSGGAPFSKVGXLKXTWTKRVLERKHKXCXXLGFGXDXPAXKXSRTXXKXXPXYXQTXX

SEQ ID NO: 202771 - protein, 114 aa, Triticum aestivum
  unsure (1)..(114): unsure at all Xaa locations
  Clone ID: PAT_TA_97189.pep
MGKEKTHINIVVIGHVDSGKSTTTGHLIYKLGGIDKRVIERFEXEXAEMNXRSFKYAWVLDKLXAXRERGITIDIALWKFETTXYYCTVIEAPGHLDFIXHELLGTLPRTVPVH

SEQ ID NO: 202772 - protein, 87 aa, Triticum aestivum
  unsure (1)..(87): unsure at all Xaa locations
  Clone ID: PAT_TA_97190.pep
LXVNGDHTHDDHAQXPPRSXPGRCLRRRXPXPRWRXRASRCXXCXRTRPRMEPWSCPRRXRPWRCXFFXLXXLVGXXDGXAYGXXDV

SEQ ID NO: 202773 - protein, 86 aa, Triticum aestivum
  Clone ID: PAT_TA_97191.pep
YSPLILRKLHGAEDHYNFLFQIGNEQNMILPTSHVVYMYLFHKVHRFKYKFATHDDESRSERSLELTQVSYSHDQIRLRRQVFMRT

SEQ ID NO: 202774 - protein, 127 aa, Triticum aestivum
  unsure (1)..(127): unsure at all Xaa locations
  Clone ID: PAT_TA_97192.pep
MPAGHGLRSRTRDLFARPFRKKGYIPLTTYLRTYKVXEHVDVKVNGAVHKGMPHKFYHGRTGRVCNXTXRAIGVEINKQVGNRIIKKRIHVRVXEHVQPSRCNRGVSSTGXLNNDQLACCPSASVIH

SEQ ID NO: 202775 - protein, 146 aa, Triticum aestivum
  unsure (1)..(146): unsure at all Xaa locations
  Clone ID: PAT_TA_97193.pep
HTLIADKTDFSALRISVIDEQQRFGVIQRGRFNNKLYTSSSKLSDENTSEDAASDSETFMAPHVLAMSATPIPRTLALALYGDMSLTQXITDLPPGRQPIETLALEGNDAGFETVFQMMRDELMDGGKVYLVYPIIRKNQRHLPQL

SEQ ID NO: 202776 - protein, 78 aa, Triticum aestivum
  Clone ID: PAT_TA_97194.pep
SYEFRVHVFVPLWTGTVYQHNLHDHSALSLPHLTRINTTPSLSLPLHKMSRPRGSITAWFHDSLISTRIYIMSQVTKL

SEQ ID NO: 202777 - protein, 126 aa, Triticum aestivum
  unsure (1)..(126): unsure at all Xaa locations
  Clone ID: PAT_TA_97195.pep
MAXKRTKAEKKIAYDQKLCQLLEEYTKVLIAVADNVGSKQLQEXRKGLRGDSIVLMGKXNXLIRRCIKVHSEKTGNKDFLELXXLLVGNVGLNFTKGDLKGGFXKEVAKVTKGRLAPCLGLICTLF

SEQ ID NO: 202778 - protein, 132 aa, Triticum aestivum
  unsure (1)..(132): unsure at all Xaa locations
  Clone ID: PAT_TA_97196.pep
MPKAAEKKPVATAEKTTAGKKPKAEKRAPASKEAGGEGXXRGRKKGSKAKKGVETYKIYIFKVLKQVHPDVGISSKAMSIMNSFINDIFEKXLAGESAKLARYNKXKPXITSREIXNSVRLXLPGGSSPKQR

SEQ ID NO: 202779 - protein, 124 aa, Triticum aestivum
  unsure (1)..(124): unsure at all Xaa locations
  Clone ID: PAT_TA_97197.pep
MARLNSKAVAAAVVLAAVVLMMAGREASAALSCGQVDSKLAPCVAYVTGRASSISKECCSGVQGLNGLARSSPDRKIACRCLKSLATXSIKSINMGKVSGVPGKCGVSXVPFPINIPQLAXNVN

SEQ ID NO: 202780 - protein, 59 aa, Triticum aestivum
  Clone ID: PAT_TA_97198.pep
KSLCYACYPVALPASSTKSSGFSPYLSIYSISTQYCVIGPGCIIVLKLLCTLQLGDHVF

SEQ ID NO: 202781 - protein, 53 aa, Triticum aestivum
  unsure (1)..(53): unsure at all Xaa locations
  Clone ID: PAT_TA_97199.pep
LEGXARXXRXKLETGXGGPXNXXXPXIRXXWPYXLPLRRTRTARNAAGGCGGG

SEQ ID NO: 202782 - protein, 130 aa, Triticum aestivum
  unsure (1)..(130): unsure at all Xaa locations
  Clone ID: PAT_TA_97200.pep
MADQLTDEQIAEFKEAFSLFDKDGDGCITTKELGTVMRSLGQXNPTEAELQDMINEVDADGNGTIDFPEFLNLMAKXKXXDXDSEXEELKEAFPRVLTXDQERLQSRAXGAATVYEPTSGGNLTGPKDQE

SEQ ID NO: 202783 - protein, 74 aa, Triticum aestivum
  unsure (1)..(74): unsure at all Xaa locations
  Clone ID: PAT_TA_97201.pep
SXVRXEXEEXEGXXWXAXGLERXARMEXSCGGXASPXGLAXMGRRGSEEEKGLXRGTPSGXCGGSGGQSDPTRR

SEQ ID NO: 202784 - protein, 131 aa, Triticum aestivum
  unsure (1)..(131): unsure at all Xaa locations
  Clone ID: PAT_TA_97202.pep
MXRTKQTARKSTGGKAPRKQLATKAARKSAPATGGVKKPHRFRPGTVALREIRKYXKSTELLIRKLPFQRLVREIAQDFKTDLRFQSSAVSALQEAAEAYLVGLFXDTNLXXAIHAKSRSPSXPXDIQARP

SEQ ID NO: 202785 - protein, 152 aa, Triticum aestivum
  unsure (1)..(152): unsure at all Xaa locations
  Clone ID: PAT_TA_97203.pep
FPPSXRGGGKASPVXGIRPSRXXSPPLCFFAPSXVXWLPXXPTRPEPDEDGWDWPRPLPPKRAHETGGGIKRRLSLRRPHHWLSPPAYMQPPPPGRTRGNSNGGHGSAPTRQTRRLGGGAARRDAIFGAWFGDWEGEGGGGRAPKISVPCGV

SEQ ID NO: 202786 - protein, 125 aa, Triticum aestivum
  unsure (1)..(125): unsure at all Xaa locations
  Clone ID: PAT_TA_97204.pep
GDMILLPNGAEVVIINGAMDGTAGWEXANTPAYAPVVYRPDHAPGDRFEEQKXTDIXRLXHSSAILLRDGRVLVGGSNPHIYYNFKQRAVXPTELSLEAFSPEYLDKXNDALRPKITNPRRPNRG

SEQ ID NO: 202787 - protein, 122 aa, Triticum aestivum
  unsure (1)..(122): unsure at all Xaa locations
  Clone ID: PAT_TA_97205.pep
XRPVPSXSFKSTVGSENSNEDSTGDVAFPSTSXSLKKVFEKHHHXPPTVLSPGILAIRLNAMLEAVELPARVPRPGCRPGRCGSRCTPSWRRVGVVGGLRRWRNGEDEGEGFGCAERGEYED

SEQ ID NO: 202788 - protein, 149 aa, Triticum aestivum
  unsure (1)..(149): unsure at all Xaa locations
  Clone ID: PAT_TA_97206.pep
ATGRAALDWETRVKISLGMARGLAHLHAEGSGKFIHGNLKSSNILLSQNLDGCVSEFGLAQLMTTLPAPARLIGYRAPEVLETKKPTQKSDVYSFGVLLLEMLTGKXPLRSPXRXDSVXQLPRGXXXRGPXXEXTPGGVPLDLVGKPKK

SEQ ID NO: 202789 - protein, 114 aa, Triticum aestivum
  unsure (1)..(114): unsure at all Xaa locations
  Clone ID: PAT_TA_97207.pep
PRXRXFPHFXPIXRXLXAXLFWGKGXXFGLRXPFFSXYLXPMXXXKRGGMLLAKGGFKFGLNRPGFFPQVHGXFLKTDRPQLSXAVITDFNLLGAEFGYXGPPPFGGXPVSIIG

SEQ ID NO: 202790 - protein, 92 aa, Triticum aestivum
  unsure (1)..(92): unsure at all Xaa locations
  Clone ID: PAT_TA_97208.pep
PVGXQRXCATRAACDSSQGRLVPGVPARRQAPXFLLTQHFQLSPQVDGACXRQKEXVFIRGXHXLDAAAAAAGPGPGVTVKPEXMFHDYGIC

SEQ ID NO: 202791 - protein, 110 aa, Triticum aestivum
  unsure (1)..(110): unsure at all Xaa locations
  Clone ID: PAT_TA_97209.pep
MAEQTFIMIKPDGVQRGLIGEVIXSRFEKKGFYLKGLKLQNVEKSFAEQHYSDLSSKPFFAGLVXYIVSXGPVVAMVWEGKERPXPTGTQRXIWGPXNPWASEAPXTIPW

SEQ ID NO: 202792 - protein, 101 aa, Triticum aestivum
  unsure (1)..(101): unsure at all Xaa locations
  Clone ID: PAT_TA_97210.pep
PXXKPDHRHXHXFPVFRXEVGHHPHXGXHHXDARLVGRRAHHRQGRPLTTCRRREGHPATARGEEXQCXADARARHGHXLMDSSEISAAGALTLLLLAVLF

SEQ ID NO: 202793 - protein, 97 aa, Triticum aestivum
  unsure (1)..(97): unsure at all Xaa locations
  Clone ID: PAT_TA_97211.pep
AKXSSXQHKSTMKTFLVLAXLVVVATIETXNSXILRSDQPQQSFPQQPQPXKPFXPFLXQQXDFMQGCPVGCQXXHNRGPVLSXVNKNXCXXKXVLW

SEQ ID NO: 202794 - protein, 112 aa, Triticum aestivum
  unsure (1)..(112): unsure at all Xaa locations
  Clone ID: PAT_TA_97212.pep
MKTLFILTILAMXTTIAXANMQVDPSGQVQWSQQXXFXQPQQXFYQXPQQTFPQPQQAFPHXXQQQFPQPQAXXXXQFPQSQAYPQXPFPQXPQQAQLPFPQTXTGIPFPQP

SEQ ID NO: 202795 - protein, 145 aa, Triticum aestivum
  unsure (1)..(145): unsure at all Xaa locations
  Clone ID: PAT_TA_97213.pep
EKKXRWGSGGAINGEQGGGAKTSGLDFXSLHEPPXAXTSRLGGLLXRXLNXELPPTLPREVPNAGNKDXQRREQRQDKNCCSAKAKEGNPKEAPCCCXLXTNIPFSIFFLXLLFVASASMFGYXQXQXNYLKHLHPXPTSXEFGS

SEQ ID NO: 202796 - protein, 133 aa, Triticum aestivum
  unsure (1)..(133): unsure at all Xaa locations
  Clone ID: PAT_TA_97214.pep
MFGFGHHHKDXAPXXSGPNQIFKIYCRASEXYCLAVRDGEVVLAPVNPKDRXTQHWLKDMRFSTTVKDXEGHAGLPRSVKQGQPGLRPFKATPSGQVPPPFKAGCPFQPAVTGRVAVGSDRWGQRGFSLAQVK

SEQ ID NO: 202797 - protein, 147 aa, Triticum aestivum
  unsure (1)..(147): unsure at all Xaa locations
  Clone ID: PAT_TA_97215.pep
QKPRPLKREVLQRRKHGDPRLXKKKKFVSDXVFYAELNEMLTRELAEDXYSGVXVXVTPMRTEXIIKGTRTQXNVLGEXXRXXXEXLXSVVQKRFNFPXXXVELYSEKXSNVGLWAXAQAESLRYKLLXGLPSARECXGVPPLCLWK

SEQ ID NO: 202798 - protein, 55 aa, Triticum aestivum
  unsure (1)..(55): unsure at all Xaa locations
  Clone ID: PAT_TA_97216.pep
RPFXVXGLISSYLSIXXIXTMGFXXSLKRGPPXKHTSAAXXXQIXIHLITEDTHG

SEQ ID NO: 202799 - protein, 143 aa, Triticum aestivum
  unsure (1)..(143): unsure at all Xaa locations
  Clone ID: PAT_TA_97217.pep
FIIPETTKPCLHEKENRHPLHSSHPSHGQGEESSSPSAAASLQMFFLVKMEXPLSASGVAAAAEAGGSKAFLHLWARGRRGRRPIDPHSVLAQXQRQRKKRRGTXAPRDARTALGLSLREMSPGGWICLGKGGGIWGGADKTG

SEQ ID NO: 202800 - protein, 155 aa, Triticum aestivum
  unsure (1)..(155): unsure at all Xaa locations
  Clone ID: PAT_TA_97218.pep
PQSTNPSLQRCGLASPTHPHHHRRKRRSRASGDRCKDAVCAAGGVTRRGRVPVVVGGRRAGGRXQRHGVPVHGPAVRXALPRPGDDVRRRRRPMQFPLSARKRAAARSGPFPVGXQQXRPAXPEVRGLGVPLRDXGAFLLGXXXXQSPXXGXXGG

SEQ ID NO: 202801 - protein, 141 aa, Triticum aestivum
  unsure (1)..(141): unsure at all Xaa locations
  Clone ID: PAT_TA_97219.pep
GIRILVTSDAADGCAAEWRSLASLLPRPFGPHDLLPKDAPLVLEPHDNRLGDPVDAAANGFAAGDLEGRLKDAAEAAARAAHAPYSGCPSGFAVADGEGKVYAGGCLESAAYNPTLGPVQXAIIAMIAASGGSAGRCWWRR

SEQ ID NO: 202802 - protein, 141 aa, Triticum aestivum
  Clone ID: PAT_TA_97220.pep
ADQETEQGSLTIDKSWEDYASREFTMVLSKTLKNGAKIMLEAKIKISMEYPLRPPLFRLQLVSEKTEDLKWHNDLRAMEAEVNLHILRILPRSNEDYILTHQVLCLAMLFDMHLDEDHEKRKVTSVIDVGLCKPVKWNHAH

SEQ ID NO: 202803 - protein, 113 aa, Triticum aestivum
  unsure (1)..(113): unsure at all Xaa locations
  Clone ID: PAT_TA_97221.pep
MKLIAAYLLAYLGGNSSPSAADVKNILDSVGAEADEEKLEFLLAELKGKDITEVIASGREKFAAVPSGGGAIAVGAPAAASGGAAAPAAESKKEEKVEEKEESDEDMGFXLFD

SEQ ID NO: 202804 - protein, 138 aa, Triticum aestivum
  unsure (1)..(138): unsure at all Xaa locations
  Clone ID: PAT_TA_97222.pep
MGSXSCFLXXSNARLAASXRPAPAVGRXQLFXCKXQKSDEXASDAAVVTNRXAALSLLXGAGGVAVKVSPAAAAYGEATNVFGKXKKNXDFVXYSGEGFKLMXPAKWXPXXEREFPVQVLRXKDKXXSNXKLSVLNXP

SEQ ID NO: 202805 - protein, 91 aa, Triticum aestivum
  unsure (1)..(91): unsure at all Xaa locations
  Clone ID: PAT_TA_97223.pep
LKHXPWXSTXVXAXVRHPERGKXQGXGLHHXSPEHRPXXGXGDGGRXEXGGRGARERGXXAAGRPAGXAXSRERXKGEYPNPSTHSLXSRI

SEQ ID NO: 202806 - protein, 95 aa, Triticum aestivum
  unsure (1)..(95): unsure at all Xaa locations
  Clone ID: PAT_TA_97224.pep
FXWFXGWQDXXSFSPSFFWELPFCQRLRTSXSQLKTHQILFHHHHHWVFPSHVDLNSHLLKFSLSSCTRIVSGDLRLVVSPELTSAACSASISGH

SEQ ID NO: 202807 - protein, 93 aa, Triticum aestivum
  unsure (1)..(93): unsure at all Xaa locations
  Clone ID: PAT_TA_97225.pep
MLVYQDKLSGDELLSDSFPYRELENGVLWEVDGHWVVQGAVDVDIXANPXAEGGGDDEGVXDHXVXVVDXVDTXRLQEXXAFXKKQFXSXKKR

SEQ ID NO: 202808 - protein, 92 aa, Triticum aestivum
  Clone ID: PAT_TA_97226.pep
MLAEGQESEVACLLATEEAKKSNNVQRKLEKRQQGRTLDSHIEEQFSGGRLLACISSRPGQCGRADGYILEGKELEFYMRKLQKKKGKGATA

SEQ ID NO: 202809 - protein, 114 aa, Triticum aestivum
  unsure (1)..(114): unsure at all Xaa locations
  Clone ID: PAT_TA_97227.pep
MGSRYEVEVTVGAARDLKNVNWRNGDLKPYAVLWIXAGARCSTRVDLDSNENPAWDEKVVVPLPPASRLQDAVLYLDVVHANAAEXSKPLVGSARLPLRDVXDDAGVXGQSVET

SEQ ID NO: 202810 - protein, 81 aa, Triticum aestivum
  unsure (1)..(81): unsure at all Xaa locations
  Clone ID: PAT_TA_97228.pep
QETXXSPDGRPXXRTXAGEQXAFPGGPXLPAAASEAGXHXWGXRGASEMDMLSDXXXAGRXXRRXKPRRWMMVSVSXSXSN

SEQ ID NO: 202811 - protein, 75 aa, Triticum aestivum; identical to SEQ ID NO: 106874
  Clone ID: PAT_TA_97229.pep

SEQ ID NO: 202812 - protein, 161 aa, Triticum aestivum
  unsure (1)..(161): unsure at all Xaa locations
  Clone ID: PAT_TA_97230.pep
EXPXXAKGASQPAAESRTDTGQXRTGQIRRAGHFHXRDPTRXRVRTGRTRGSPTPXRPPGEETPATREGRDGAGVATPKKITPRSKGAELPPPRAVGAAAPPGRPNGGSSRHRHEDRGRRPEIHAPPRPSLWPEVPPPLRGMGPAATAAGQRQRRQVGAGG

SEQ ID NO: 202813 - protein, 96 aa, Triticum aestivum
  Clone ID: PAT_TA_97231.pep
AARACCCTAIAAAAAAAAGLPCPAHRCSRPSVQGTASLGLRYEWTWPLGCAPWMIQWLHHGYSIAGTYIMLIPSYIAVNLSSCTLRPLIRSDYIMI

SEQ ID NO: 202814 - protein, 152 aa, Triticum aestivum
  unsure (1)..(152): unsure at all Xaa locations
  Clone ID: PAT_TA_97232.pep
PPFSQXQPPFSQQQQQPLSQQQQPPFSQQQPPFSQQQQPPFSXQQPPFSQQQQPVLPQQPSFSQQQLPPFSQQXXPFSQQQQIVLQQHPPFLXQQQPSLPQHPPFSQQQXQLVLPQQQIPFVHPXILQQVXPCKVFLQXQCKPLGAMPXSLA

SEQ ID NO: 202815 - protein, 131 aa, Triticum aestivum
  unsure (1)..(131): unsure at all Xaa locations
  Clone ID: PAT_TA_97233.pep
MQIFVKTLTGKTITLEVESSDTIDNVKAKIQDKEGIPPDQQRLIFAGKQLEDGRTLADYNIQXKESTLHLVLRLRGGMQXIFVKXLTGKXTITLEVESSDTIDNVXGXDSRTRRGIPPXDQXRLIFRWLGG

SEQ ID NO: 202816 - protein, 84 aa, Triticum aestivum
  unsure (1)..(84): unsure at all Xaa locations
  Clone ID: PAT_TA_97234.pep
LIVQNSKFKHIFSVSSSSLPISSREAVNGVPVLLAVWPAPVGAAGGEAGALLPRPPTPGERLLGPGSSDGYETGPVLGQPPXRR

SEQ ID NO: 202817 - protein, 77 aa, Triticum aestivum
  unsure (1)..(77): unsure at all Xaa locations
  Clone ID: PAT_TA_97235.pep
ICNATXWSGHSXIHVGAALPNKSYIFPLLPFPRLPVDLIRRRRRRARFDSDAXHHADTSPXSTRTQAXNPFLSSQRQ

SEQ ID NO: 202818 - protein, 77 aa, Triticum aestivum
  unsure (1)..(77): unsure at all Xaa locations
  Clone ID: PAT_TA_97236.pep
ASXPSPGARPRRXPRXSXRTPRLRPRXVXTASAXADQRTTKCAWXESVLGWRETXSXVLXTRAARXXMGSNGXERTE

SEQ ID NO: 202819 - protein, 134 aa, Triticum aestivum
  unsure (1)..(134): unsure at all Xaa locations
  Clone ID: PAT_TA_97237.pep
MANPRVFFDMTVGGAPAGRIVMELYKDAVPRTVENFRALCTGEKGVGKSGKPLHYKGSAFHRVIPDFMCQXXDFTRGNGTGGESIYGEKFADEKFSTSTPKPGILSMXKRRGPXTXRGXSSLIXTVPLANWVDG

SEQ ID NO: 202820 - protein, 56 aa, Triticum aestivum
  unsure (1)..(56): unsure at all Xaa locations
  Clone ID: PAT_TA_97238.pep
DKAYKPFSLSNHNPGKWVSFXPILCFLGMFSHHYYDSLGGSXVTTTKTFTFFKYHC

SEQ ID NO: 202821 - protein, 136 aa, Triticum aestivum
  unsure (1)..(136): unsure at all Xaa locations
  Clone ID: PAT_TA_97239.pep
AERGQEGXXTGTSWXLSASRSHGXXPXXGAXSRPGRVSSSSMMAXAARXVPQHXPXQXHRGXISRLPIHRRSLCLGEGMGKTLVGVRACAPGDFGFSEGSGEGVDXGGGLLGGMGLWQCGLGRRLGWSGSCRRGAG

SEQ ID NO: 202822 - protein, 180 aa, Triticum aestivum
  unsure (1)..(180): unsure at all Xaa locations
  Clone ID: PAT_TA_97240.pep
KPGPENXWXRQXSEEXTXGASQEXRRXHSHQIRRWLFDPRPNPQXXARRXQELXSLLGSNDLHXQLLQMLEGQRELRVRGKETRKGRRAWXVRWECGVGGRWARTDASTGRWRQEAATGRRIGGDGPAAPGRRRAGSTQRRRWATRLATPGPTGVGAGRARGYWRQGRRLSARQLPAPAV

SEQ ID NO: 202823 - protein, 119 aa, Triticum aestivum
  unsure (1)..(119): unsure at all Xaa locations
  Clone ID: PAT_TA_97241.pep
PLWSCHHAMLHKILLLKGLRVQGSATRSCRARTIRAKSTARSWGSRTPRLNAGLGTRRKASSTTPAAVFSQRRASTYDDILIGINSGVLAMASPESVVLVVETLIRSVSILRVXTKNKG

SEQ ID NO: 202824 - protein, 134 aa, Triticum aestivum
  unsure (1)..(134): unsure at all Xaa locations
  Clone ID: PAT_TA_97242.pep
PQQPFPQQSQQSQQPFPGPQQLFPELQQPIPQQAQQPFPLQPQQPFPQQSQQPFPQQPQQPFPLQPQQPFPQQPQXPFPXQPQQPFPLHPXQPFPLRXXQPFSQXPQQSQQXFPQXQPQXAXXPSIXXPQXPFC

SEQ ID NO: 202825 - protein, 162 aa, Triticum aestivum
  unsure (1)..(162): unsure at all Xaa locations
  Clone ID: PAT_TA_97243.pep
MGKEKTHINIVVIGHVDSGKSTTTGHLIYKLGGIDKRVIERFEKEAAEMNKRSFKYAWVLDKLXAXRERGITIDIALWKFETTKYYCTVIDAPGHRXFIKNMXTGTSXADCAVVXNQSTXGGGXGVXXPKXGKTXGETXPGFKPXVXQMXCCXNKXXXTXPS

SEQ ID NO: 202826 - protein, 163 aa, Triticum aestivum
  unsure (1)..(163): unsure at all Xaa locations
  Clone ID: PAT_TA_97244.pep
MPAGHGLRSRXRDLFXRPFRKKGXIPLTTYLRTXKVXEHVXVKVNGAVHXGMPHKFYHXRTGRVWNVTXRAIXVEXNKQVXNRIIKXRXHVRVEHVQPSXCNEEFLQRKLNNDKXKXXRXKVPGEXSSTNXXXRQQGXXPXFMVGGXHQSKGHPHPRVVQIFG

SEQ ID NO: 202827 - protein, 102 aa, Triticum aestivum
  unsure (1)..(102): unsure at all Xaa locations
  Clone ID: PAT_TA_97245.pep
MGKENTHINIVVIXHVDSGKSTTTGHLIYXLXGIXKRVIXRFEKEAADMNXRSFKYAWVLDKLKAERERGITIDIALWKFEXTTKYYCTVIDAPXHRDFXXX

SEQ ID NO: 202828 - protein, 141 aa, Triticum aestivum
  unsure (1)..(141): unsure at all Xaa locations
  Clone ID: PAT_TA_97246.pep
PASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPKRPAGXGEHQDEEDKASKAPSTTVHQQPTYH

SEQ ID NO: 202829 - protein, 176 aa, Triticum aestivum
  unsure (1)..(176): unsure at all Xaa locations
  Clone ID: PAT_TA_97247.pep
SNGTNKSPPNLVSDRPEARRIPTASRCKIFVKTLTGKTITLEVESSDTIDNVKAKIQDKEGIPPDQQRLIFAGKQLEDGRTLADYNIQKESTLHLVLRLRGGMXIFVKTLTGKXTITLEXVEALTPXDNVKGKDXRQRRGIPRXQQAALIFCLGNGWATGNKKFHPPNLVPPVGGK

SEQ ID NO: 202830 - protein, 163 aa, Triticum aestivum
  unsure (1)..(163): unsure at all Xaa locations
  Clone ID: PAT_TA_97248.pep
MGEQTFIMIKPDXVQRXLIGEVINRFXKXGFYLKGLKLQNVEKSFAEXHYSDXSSKPFFAGLVEYIVSGPVVAMVWEGKSVXATGRKXIGAXXPLXSEPXXXRGDFAVDIXRNVIMXSDSIXEXPXXGIPCGSXRAIQXWGGXQQNWFIXXCHWGLICNYKIL

SEQ ID NO: 202831 - protein, 88 aa, Triticum aestivum
  unsure (1)..(88): unsure at all Xaa locations
  Clone ID: PAT_TA_97249.pep
CXDXXIXVDSPFXLLGXPQRDLXFFLITXGHXIESQFFFDXQXXXWXRXSPXVGGGVXQQSXLFVEXRNPPPRCARRRREXGGGGVSC

SEQ ID NO: 202832 - protein, 130 aa, Triticum aestivum
  unsure (1)..(130): unsure at all Xaa locations
  Clone ID: PAT_TA_97250.pep
IRXEPXRKXGRPRPXTXVTTSKXXSAXXAXXAGXACSRRXGRNRKSPLTASXLAAXDVVGRPVRGARRRHRHLPXRRPTTAAGSPXPEHDXLLRXRRRRLLACAAACRTRXPAVAXSWHERASGLRSHXS

SEQ ID NO: 202833 - protein, 135 aa, Triticum aestivum
  unsure (1)..(135): unsure at all Xaa locations
  Clone ID: PAT_TA_97251.pep
MXRTKQTARKSTGGKAPRKXLATKAGRKSAPATGGREEAXRFRPGTVGLREXRKYQKSKELLIRKLPFQRLVREXAQDFKTDLXFQSSXVSXLQEXXXAXLVGVFXDXKLCAXHAKRVIXMPKXIQAXKXXQGGR

SEQ ID NO: 202834 - protein, 99 aa, Triticum aestivum
  Clone ID: PAT_TA_97252.pep
QHNIAHESSQVLQQSSYQVLQQLCCQQLRQIPEQSRCQAINNVVHAIILHQQQQQQGQHQQSSQVSYQQPQQQYPSGQGSFQPSQQNPQAQGFVQPQHL

SEQ ID NO: 202835 - protein, 114 aa, Triticum aestivum
  unsure (1)..(114): unsure at all Xaa locations
  Clone ID: PAT_TA_97253.pep
MSVAALRSQLNEHISYMYATGILDEYYQQLQSPQDEGFVPEVINIFLGDADRMLNDIXSLLNLPVVDFEMVCELVHQLKACNCSVGAKKVNLACEALSPVLQRQKAKEGCLNGN

SEQ ID NO: 202836 - protein, 81 aa, Triticum aestivum
  unsure (1)..(81): unsure at all Xaa locations
  Clone ID: PAT_TA_97254.pep
MSCCGGNCGCGAGCKCGNGCGGCKMFPDVEATAGAAAMVMPTASHKXSSGGFEMAGGETGGCDCTTCKCGTACGCSCCSCN

SEQ ID NO: 202837 - protein, 160 aa, Triticum aestivum
  unsure (1)..(160): unsure at all Xaa locations
  Clone ID: PAT_TA_97255.pep
NXXGXSSSTAPPXRXTPSARASPXXXPXSXPRRXPPPXPPXASPKLPMWPXXDMSXXIQLTAGVYSXHVQKXXTTNHNYXXXTXSXGFWYXNSXFPXXXEFLSTXNSXINPVXPIXNXLXXLPFXGLITXXQLLIXPPKSFNXTXPPFLLKTQKXNXXRR

SEQ ID NO: 202838 - protein, 102 aa, Triticum aestivum
  unsure (1)..(102): unsure at all Xaa locations
  Clone ID: PAT_TA_97256.pep
LRRRRPTARSPPPAAANRHRSVLLHLRPGFLAMVFGGGFKFLVGVGCGVYVAQKYNVPNVXKAVQKVCFPGKAXXGXKTLARRRRKTMTDYNXXXKKKYXLT

SEQ ID NO: 202839 - protein, 109 aa, Triticum aestivum
  unsure (1)..(109): unsure at all Xaa locations
  Clone ID: PAT_TA_97257.pep
SRQPFPQQPQXPFPLQPQQPFPQQSAQIIPQQPQQPFPLQPQXSFLRQSQQPFLQQPQXPSPQPQHVVQXIPXQPQQPFPLLAXQPXAXLSTXXTIRNWYRHRGPKSKP

SEQ ID NO: 202840 - protein, 100 aa, Triticum aestivum
  unsure (1)..(100): unsure at all Xaa locations
  Clone ID: PAT_TA_97258.pep
MAPTVMASSATSVAPFQGLKSTAGLPVSRRSNGASLGSVSNGGRIRCMXVWPIEGIKKFETLSYLPPLKXXALLKQVDYLIRSXWVPLPRVQARXGFIXR

SEQ ID NO: 202841 - protein, 125 aa, Triticum aestivum
  unsure (1)..(125): unsure at all Xaa locations
  Clone ID: PAT_TA_97259.pep
GKSKXXERXRVKEGRRTLVEDREXXQPAAXWDEATTRRENGGEMCRRCXAQGFGEGASGSYQVRHEGTCHYQPLAEIKHFFTGEGAVGSAEGWEVESTVVGGCGRRWRARSREEVVGGGDDGVGW

SEQ ID NO: 202842 - protein, 137 aa, Triticum aestivum
  unsure (1)..(137): unsure at all Xaa locations
  Clone ID: PAT_TA_97260.pep
HTSSAPIPPAPPPPLPREPAVVPPPVPNPVAVPLSPRDSTAAPXPPPDPAXAPPPSMNPTAAPPFPPDPISPPASLRVGVEARCRHADCSKSHLFEDSPAPSPRSSPSVLKHRGRPPPIKLFDSPYQMSLFSQTPGT

SEQ ID NO: 202843 - protein, 76 aa, Triticum aestivum; identical to SEQ ID NO: 185994
  Clone ID: PAT_TA_97261.pep

SEQ ID NO: 202844 - protein, 95 aa, Triticum aestivum
  unsure (1)..(95): unsure at all Xaa locations
  Clone ID: PAT_TA_97262.pep
IRNISIQAXXXTSRXXRWXLRHTVRMDAXXKXGIGRGRXDAGXGRASEXEEATETRERRRXGGXMGRRGLRRRGGAXARXWPGGGGRSPGEGGGR

SEQ ID NO: 202845 - protein, 127 aa, Triticum aestivum
  unsure (1)..(127): unsure at all Xaa locations
  Clone ID: PAT_TA_97263.pep
PQPQQPQQSFPQQQRXFIQPSLQQQLNPCKNILLQQCKPASLVSSLWSIIWPQSDCQVMRQQCCQQLAQIPQQLQCAAIHSVVHSIIMQQXQQXQXQQXGMHIFLPLSQAGTRWGQRFSKSKRGIIQ

SEQ ID NO: 202846 - protein, 127 aa, Triticum aestivum
  unsure (1)..(127): unsure at all Xaa locations
  Clone ID: PAT_TA_97264.pep
LEVESSDTIDNVKAKIQDKEGIPPDQHRLIFAXXQLEDGRTLADYNIXKESTLHLVLRXRGGMXIFVKTLIXXTXTLEVXSSDTIXHRQRSXXXGQGGHXPGTXXRLIFGAXXKPXDXRTLVXFNXS

SEQ ID NO: 202847 - protein, 89 aa, Triticum aestivum
  unsure (1)..(89): unsure at all Xaa locations
  Clone ID: PAT_TA_97265.pep
IDSVLSKQTHAPMEGRSALCFLVVLTLLAAXPALAAERCEQEQFFSRICMDWLCXQECXSQNPDMRVKGXPLHRQXGXRAIXTCTMCYT

SEQ ID NO: 202848 - protein, 59 aa, Triticum aestivum
  unsure (1)..(59): unsure at all Xaa locations
  Clone ID: PAT_TA_97266.pep
SRARXSLCPGLIRAGLPEEEXNMXYXSSLXXVGXSVMXQIPXCHXLGXXAXNIPRFRXP

SEQ ID NO: 202849 - protein, 41 aa, Triticum aestivum
  unsure (1)..(41): unsure at all Xaa locations
  Clone ID: PAT_TA_97267.pep
SVARTRMRXAGVSNPVXVXCLGHSCSESTPLCXLHDDXFLX

SEQ ID NO: 202850 - protein, 132 aa, Triticum aestivum
  unsure (1)..(132): unsure at all Xaa locations
  Clone ID: PAT_TA_97268.pep
MANPRVFFDMTVGGAPAGRIVMELYKDAVPRTVENFRALCTGEKGVGKSGKPLHYKGXSAFHRVIPDFMCQGGDFTRGNGTGXQKSIXXEKFADEXFVPQGTPKXXGILSMAQTAQTKAPKFFLTVPLWAFF

SEQ ID NO: 202851 - protein, 74 aa, Triticum aestivum
  unsure (1)..(74): unsure at all Xaa locations
  Clone ID: PAT_TA_97269.pep
QQQSPQXQXFPXXXFPQQQQLXXQQFPXPQQIPXAXRIPPATXTPLXSIFPNSTSPNXSMLPQXHFPXATTXSP

SEQ ID NO: 202852 - protein, 85 aa, Triticum aestivum
  unsure (1)..(85): unsure at all Xaa locations
  Clone ID: PAT_TA_97270.pep
MATELAYAPPMKSGKLGFEGTQEVQHRIRITLSSXSVKNLEKVCSDLVKGPKEKQLXVXGPVRMTTXVLNITTXXVPPRTTLPVR

SEQ ID NO: 202853 - protein, 109 aa, Triticum aestivum
  unsure (1)..(109): unsure at all Xaa locations
  Clone ID: PAT_TA_97271.pep
XRXYHXXXRXHLPXXPXPXAXSYQSDRXXATYFXEXMLKQXWGSGGVAGDAGRGRASXAXEKTEXXGRRSXGRGLGSESAXGEAGLGHGXDRAXVVXRQGRGEGDEEES

SEQ ID NO: 202854 - protein, 95 aa, Triticum aestivum
  unsure (1)..(95): unsure at all Xaa locations
  Clone ID: PAT_TA_97272.pep
MVKAVAVLTGSEGVKGTIFFTQEGDGPTTVTGSVTGLKEGLHGFHVHALGDTTXGCMSTGPHFNPAGHVXGAPDDEXRHAGWILXNVTXGXDGVC

SEQ ID NO: 202855 - protein, 113 aa, Triticum aestivum
  unsure (1)..(113): unsure at all Xaa locations
  Clone ID: PAT_TA_97273.pep
LRKHGSETRKKNRRSISSARGETDQQGGRMTPKVVVTGDSTSLSLQQRSFADLMLLPPATFPVPLFFLTHALTGCXXQHEXXWRGTXAKNTWXXLMXXPHGXVGGNXGPRSVG

SEQ ID NO: 202856 - protein, 146 aa, Triticum aestivum
  unsure (1)..(146): unsure at all Xaa locations
  Clone ID: PAT_TA_97274.pep
MITSPIVAPTSVPSLSRRGSSFAVVCSGGKKIKVDKPLGLGGGLTVDIDANGRKVGKKGVYQFVDKYGANVDGYSPIYTPEEWSESGDRYXGGTTGLLIWAVTLAGLLGGGXLLVXKHQALLARRIYVNRAGVFDTPNPKITYPSR

SEQ ID NO: 202857 - protein, 87 aa, Triticum aestivum
  unsure (1)..(87): unsure at all Xaa locations
  Clone ID: PAT_TA_97275.pep
LNKYQQMPNGDPKFKLHMICVVNDRVRGPAPWPPHRHGHSHVNFVATSKSPGGEAPTLFFAEINXDNRSMSFCCPVDLPPPCATYKP

SEQ ID NO: 202858 - protein, 101 aa, Triticum aestivum
  unsure (1)..(101): unsure at all Xaa locations
  Clone ID: PAT_TA_97276.pep
FFFFFFFQXKILVXYLLRSXGSSDLHXKYXMKLDFRSNLLXXSTTXHSNNLQYIXFNXAXFPQAQAXMGLGGNSLPAXKVSXEPAGLXRXVTXRHXMXGAA

SEQ ID NO: 202859 - protein, 76 aa, Triticum aestivum
  unsure (1)..(76): unsure at all Xaa locations
  Clone ID: PAT_TA_97277.pep
MTEAEWRDWAELPRDVLLAVLSRLDHIEILMGPDMVCXPWRRAGTDDPELWXRIDMRFHYAWLLPQLEEIASDGLP

SEQ ID NO: 202860 - protein, 80 aa, Triticum aestivum
  unsure (1)..(80): unsure at all Xaa locations
  Clone ID: PAT_TA_97278.pep
FIFREHNASPGYYDGRYWTMWKLPMFGCTDATQVINEVEEVKKEYPDAYVRIIXFDNMRQVQCVSFIAFKPPGCEESGKA

SEQ ID NO: 202861 - protein, 149 aa, Triticum aestivum
  unsure (1)..(149): unsure at all Xaa locations
  Clone ID: PAT_TA_97279.pep
RRSAHVPAGGAAPARDHQALPVRRLLAPAAISGKQCPGRHRCGVHQRPPAAARPCRAARHGQPAGAVPRPDALLRAVFPVGEAVVRTQRALLPVSAFIARVADDAGSSRWATACPVANRXPGSLSLSVSXGPRGXAPFNAKFAARAVTG

SEQ ID NO: 202862 - protein, 148 aa, Triticum aestivum
  unsure (1)..(148): unsure at all Xaa locations
  Clone ID: PAT_TA_97280.pep
ERXXTPXKLXHLDGTAQIXAFSRYXNSCAPLGSVGKIXEXLDXPXKHDTWQSXCXQEEXLMKHLGLVLNRRSGEEGAAAERSTASSTARAAPARSASGAARRAGAASATRAAKRKTTRRSPVSSAEEDAMGGAGEPDPGGEGGREGSG

SEQ ID NO: 202863 - protein, 152 aa, Triticum aestivum
  unsure (1)..(152): unsure at all Xaa locations
  Clone ID: PAT_TA_97281.pep
EWLRXEAQXGEAVRRASXXRXRXRKPLPXSVXXRRAPLTCSWXRPMSVFDGVGVVGEGVVVARDALHPHRRHQPQPPPPRRXRHRVQRRRHHRRRPNGSRAYIPTTAPSTLFALAASACLGVGGRRYGREGGSGGGGGALLSARVASVSGTG

SEQ ID NO: 202864 - protein, 138 aa, Triticum aestivum
  unsure (1)..(138): unsure at all Xaa locations
  Clone ID: PAT_TA_97282.pep
EAEVRQVAPELLLLAGFPVKAASFFLRAGQGWLDLGRVDLATACFDKATPLVSALATEDERRILLGLNLARARAASDAGDQSLAVALLGRSKSLASLASVAPQXXRSLAEGYLYVGEXKLFAEALRTRRSVSMAPHRR

SEQ ID NO: 202865 - protein, 125 aa, Triticum aestivum
  unsure (1)..(125): unsure at all Xaa locations
  Clone ID: PAT_TA_97283.pep
ISCHRSPFSLPAGGLAPPSLPNPPPPIFLLLRALHRPRRLSTRXXSSSSXMKPXXPLPPSLQRRLPPCFTSEXXGPALLRLRIKFRGQVGPAXXKCXQRXXAXFXTXXNLGXXVLILGPXXFQHS

SEQ ID NO: 202866 - protein, 90 aa, Triticum aestivum
  unsure (1)..(90): unsure at all Xaa locations
  Clone ID: PAT_TA_97284.pep
EXAPXQXRRPASLPRSRPSRSRRXXPPPSLPLHRFRGXALRRAXXTXQDNGCSSPLPSXWXKPLVVSRXGXRGXEQXFXELXFTHANCYL

SEQ ID NO: 202867 - protein, 147 aa, Triticum aestivum
  unsure (1)..(147): unsure at all Xaa locations
  Clone ID: PAT_TA_97285.pep
DVATLAIKGRAAHLNFPDLAHLLPRPASAAPKDVQAXAILAASADFPCGASANAKSPDSASDASAVSPPPPPAPHAEPVQDPEDALFDLPDLLLDLRYEASAGLXXASSWVVHEGHRRRGCSALRRTPCWGSWIQSSAGQERFPVSN

SEQ ID NO: 202868 - protein, 136 aa, Triticum aestivum
  unsure (1)..(136): unsure at all Xaa locations
  Clone ID: PAT_TA_97286.pep
MAPKAAXKKPAEKTXXGKKPKAEKRAPASKEAGGEGKTRGRKXGSKAKKSVEXYKIYIFMVLKQVXPGRWASSPKGQSIIELLHQDNLPKKAPPGGSAQCLGPATNKEPTNQRSPGIPSSSGSGPRSFPRGELPQL

SEQ ID NO: 202869 - protein, 139 aa, Triticum aestivum
  unsure (1)..(139): unsure at all Xaa locations
  Clone ID: PAT_TA_97287.pep
PLLRPLXXEXSPXXDGXTRXIVXXXGXXADVXQTXCRPPTAHRGNPSXXPFXSQXHRTXGDXXGAVDXPXSLRWHWCRGVGRRRRLXGVLLXGDRLRHPGLSRXGSXRALXRQIDAIHGAAVPAASKCGFFGRRRGGXR

SEQ ID NO: 202870 - protein, 142 aa, Triticum aestivum
  unsure (1)..(142): unsure at all Xaa locations
  Clone ID: PAT_TA_97288.pep
GEIIVAPAVARDGRGGVGSSSSGAAGASSLSQILSAKLRKCCKTPSPSLTCLRLDTEKSHIGVWQKRAGARADSSWVMTVELNKEPATAAAAPTPKXSTVSVTPCSSTSTSTTGSPPEAMEDEERIALQMIEXLLXRSPASP

SEQ ID NO: 202871 - protein, 140 aa, Triticum aestivum
  Clone ID: PAT_TA_97289.pep
MAAKEPMRVLVTGAAGQIGYALVPMIARGVMLGADQPVILHMLDIEFAAEALKGVKMELIDAAFPTSQGEVCFNNLIVVRGALGGEMLVWVGFPQGKGRGLGKGGMFMTKKFIQKKAILLLGQPPNLRVFGWLPTKPPNK

SEQ ID NO: 202872 - protein, 101 aa, Triticum aestivum
  Clone ID: PAT_TA_97290.pep
HHIQLRMRISSLTLLLTLAFLVLASNAKTKPGCTVVYLKKFGGYLIGGCEDDCHKKYKATIHCSDDMACAWQADIDGSRCKCSMCIFSSKAPAEETVMLTS

SEQ ID NO: 202873 - protein, 119 aa, Triticum aestivum
  Clone ID: PAT_TA_97291.pep
ISPGSTLSPSPSSAAAPATKGGRRPDREAWIGMASDPGWAPSRPPHPAGTIRRYLAVRTAKGGGQHLRQPLAKSTVTPPLEAAASVRKPPCAAGRTDSRRHFSRRPSGVSVTPFDGGRW

SEQ ID NO: 202874 - protein, 94 aa, Triticum aestivum
  unsure (1)..(94): unsure at all Xaa locations
  Clone ID: PAT_TA_97292.pep
AASSLXFPPAARPPHPSXWXAXXGGGRSSRPCSTCCSSEXPTKRPSPXKLLHXXPPTAXVAVIIDVXLGSXNCSMACAFXXVGKCHWXHXAWFA

SEQ ID NO: 202875 - protein, 102 aa, Triticum aestivum
  unsure (1)..(102): unsure at all Xaa locations
  Clone ID: PAT_TA_97293.pep
PXQPFPQQPQQPFPLQPQQPFPLRPQQPFSQQPQQSQXSFPQAPXPQXPQQPSILQPXQPFLQPQTTIIPATXNXQFPKQPQXPFPQANHNQQSKTTTMGSK

SEQ ID NO: 202876 - protein, 114 aa, Triticum aestivum
  unsure (1)..(114): unsure at all Xaa locations
  Clone ID: PAT_TA_97294.pep
MSDTDEHHFESKADSGASKTYPQQAGAIRKGGHIVIKARPCKVVEVSTSKTGKHGHAKVSTWLPIDIFNGKKLEXDIVPSSXNCXXPHXXRQDYQLXIEITDDGFSASNXRSGK

SEQ ID NO: 202877 - protein, 72 aa, Triticum aestivum
  unsure (1)..(72): unsure at all Xaa locations
  Clone ID: PAT_TA_97295.pep
MVLQXXIDXLNPPXELEKLXHXNNRLVXSPNSFFMDVXGAKGCFTHHYCIHATPTTXXVCPGCIPVLLSTGG

SEQ ID NO: 202878 - protein, 64 aa, Triticum aestivum
  unsure (1)..(64): unsure at all Xaa locations
  Clone ID: PAT_TA_97296.pep
HGECKPTMYLSPYYHPIHSWSDYGTKIKDQPQHATRXRSPQLGTTTDHQGKTHSNDASLRRTPT

SEQ ID NO: 202879 - protein, 126 aa, Triticum aestivum
  unsure (1)..(126): unsure at all Xaa locations
  Clone ID: PAT_TA_97297.pep
MAGRKAGDRKKAVTRSVKAGLQFPVGRIGRYLKKGRYAQRVGSXAPVYLAAVLEYLAAEVLELAGXAAKVNKXXRIIXRHLLLAVPQTTRKLGTLLXRRQSPNGGCSPTLPAAFPRPPRPKGGGPP

SEQ ID NO: 202880 - protein, 64 aa, Triticum aestivum
  unsure (1)..(64): unsure at all Xaa locations
  Clone ID: PAT_TA_97298.pep
MAMVHEARQGRRGRRVRHVRLGSLLRLRVRXFRLAGLVVRFMEELRCCPGIRRRPAPRSRPALR

SEQ ID NO: 202881 - protein, 55 aa, Triticum aestivum
  unsure (1)..(55): unsure at all Xaa locations
  Clone ID: PAT_TA_97299.pep
CWHRXHAPXKRAPXGPVIXLVMGGRNSRGEEKACXQGGRGEGWLLCLLVXMXEXS

SEQ ID NO: 202882 - protein, 52 aa, Triticum aestivum
  unsure (1)..(52): unsure at all Xaa locations
  Clone ID: PAT_TA_97300.pep
AAHXLICVTNDKVAHCLICVIXXTXISLHSTYAXSXXTXPSVXFGYSHTNQC

SEQ ID NO: 202883 - protein, 58 aa, Triticum aestivum
  Clone ID: PAT_TA_97301.pep
LPEQVGQAHHTYTSATLEYSKELTVHSRIRTHAYMSHKYICTHSVCARYRHGHRHTVT

SEQ ID NO: 202884 - protein, 147 aa, Triticum aestivum
  unsure (1)..(147): unsure at all Xaa locations
  Clone ID: PAT_TA_97302.pep
TILDLSGGTYSTPSALAPVAGDLVSHRRPSHPPSTHQRRLDAHTTGDQHHARSPLPSSKDSLPTSLAAASASPRSSSSSTATRSPWQQLTASLPMPCPPDSPTHADLANHAVALGCAQLVLRRRRGPQGKLNYNSAGNGERXLSGGS

SEQ ID NO: 202885 - protein, 142 aa, Triticum aestivum
  unsure (1)..(142): unsure at all Xaa locations
  Clone ID: PAT_TA_97303.pep
MAPTVMASSATSVAPFQGLKSTAGLPVSRRSNGASLGSVSNGGRIRCMQVWPIEGIKKFETLSYLPPLNTEALXLKQVDYLXRSKWVPCLXFNKXGFNFREQNATPGXXDGRYWTMLKLPMFGCNDATQVXNEXEXVKXRIT

SEQ ID NO: 202886 - protein, 174 aa, Triticum aestivum
  unsure (1)..(174): unsure at all Xaa locations
  Clone ID: PAT_TA_97304.pep
CSPVAMPQRLARSQMLQQSSCHVMQQQCCQQLPQIPQQSRYEAIRAIIYSIILQEQQQVQGSIQSQQQQPQQLGQCVSQPQQQSQQXQLGQQPQQQQLAQGNLFXKPHQIAQLXEVMXXSXALRFLPNDVQVVNVXFVQKXTNNGGSTVGNREFGLDKGKSNWHLFNPMGQSNR

SEQ ID NO: 202887 - protein, 192 aa, Triticum aestivum
  unsure (1)..(192): unsure at all Xaa locations
  Clone ID: PAT_TA_97305.pep
GYYPTSPQQIGQGQQPXQLXXPXHGQQGXQPGQGQQGQQPGEGQQGQQPGXGQQPGQGQPGYYPXSLQQSGXGQQPGQWXXPXGQGXPGXYPTSSXQPXQGQQGYXPTSQQATKDXGPQPXQWXQLKDKGNKGYYPTSPQXIRTXXTSQGQWXATKXXGLPSRXYPTSPXXLGQXQQAXQLLQXSQGXKGTP

SEQ ID NO: 202888 - protein, 86 aa, Triticum aestivum
  unsure (1)..(86): unsure at all Xaa locations
  Clone ID: PAT_TA_97306.pep
MASIAGSAVSFAKPVKAINTNSLSFSGPRRGNAFLRLQPVPMRFAVCCSAKXDTMDKVCEIVXKKQLAVPESTEXCGXTTKFSELW

SEQ ID NO: 202889 - protein, 100 aa, Triticum aestivum
  Clone ID: PAT_TA_97307.pep
MARRSGGGRSSRPAPRAAPVRNPPAPARPAPPPATTQSSGGGIMSGIGSTIAQGMAFRYWEVANGRKACIAGDSPFQFKHEDWLVRACNLMTPMEQWLAG

SEQ ID NO: 202890 - protein, 120 aa, Triticum aestivum
  unsure (1)..(120): unsure at all Xaa locations
  Clone ID: PAT_TA_97308.pep
KKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVXSFIAFKPPGCXESGKG

SEQ ID NO: 202891 - protein, 134 aa, Triticum aestivum
  unsure (1)..(134): unsure at all Xaa locations
  Clone ID: PAT_TA_97309.pep
LIRFPEXPXRXRTPSRXFPTVIIXEPLDXPAPXWRXGGGPARVGPXPRLRCLRRPPCCXLRRARAAVRRPSRKASWLYMVRTDSGDRKIRVAGAELAAGVDSRESENTAWGTLSTNDLRRQSREIASTLERSAL

SEQ ID NO: 202892 - protein, 192 aa, Triticum aestivum
  unsure (1)..(192): unsure at all Xaa locations
  Clone ID: PAT_TA_97310.pep
PQQQFPQPQQPQQPFPQPQQPQLPFPQQPQQPFPQPQQPQQPFPQLQQPQQPLPQPQQPQQPFPQQQQPLIQPYLQQQMNPCKNYLLQQCNPVSLVSSLVSMXILPRSDWKGDXGNNXCQTTSTRFLKQGPSAXAIQWGPWHSNQSLXXKDHHNQQXPTTXXXXVFGGXFXNSXQXVXGIIKPQXPIGGGGI

SEQ ID NO: 202893 - protein, 136 aa, Triticum aestivum
  unsure (1)..(136): unsure at all Xaa locations
  Clone ID: PAT_TA_97311.pep
MARTKQTARKSTGGKAPRKQLATKAARKSAPATGGVKKPHRFRPGTVALREIRKYQKSTELLIRKLPFQRLVREIAQDFKTDLRFQXSSAVSALQEAGEAYLVGLFEDNXLCAIXAKGVTXMPKDIQLARRIRGKG

SEQ ID NO: 202894 - protein, 95 aa, Triticum aestivum
  unsure (1)..(95): unsure at all Xaa locations
  Clone ID: PAT_TA_97312.pep
VWCAASRLTSPRDLLFLSVRCPIVPLQLIHPPTKASEPESYLGSLGGSGYIAGRFFSGFVVDERCXXARXEEKHSGRXXRWQSWSLLRXENKNGR

SEQ ID NO: 202895 - protein, 116 aa, Triticum aestivum
  Clone ID: PAT_TA_97313.pep
LSSLFSPQHATAAAVTIDALGRALSGLPAPWDRIRQHHQRLLLPLRPQVRARSPSTVGIELIPYLRSPPSTSTIQQPCKLLSFHRAIVRSSMLEPKSQENNFRTNELLTKTGRVPN

SEQ ID NO: 202896 - protein, 48 aa, Triticum aestivum
  Clone ID: PAT_TA_97314.pep
RDPDAPPKIPRPRGRPRKNPLPDGMAPVPRPGSAAAKPRPQFAEVGFV

SEQ ID NO: 202897 - protein, 56 aa, Triticum aestivum
  unsure (1)..(56): unsure at all Xaa locations
  Clone ID: PAT_TA_97315.pep
YDXXHRRRXRHXHXSEXHHQXHCRXPXSRHADXIEVSYXAASLAXEXMXVVXVAXX

SEQ ID NO: 202898 - protein, 60 aa, Triticum aestivum
  unsure (1)..(60): unsure at all Xaa locations
  Clone ID: PAT_TA_97316.pep
MAMEARXKGTVKWXXXTKGFXFISPDDGSEDLFVXXSSXKAHGFRSPAEGXVXEFASLGG

SEQ ID NO: 202899 - protein, 52 aa, Triticum aestivum
  unsure (1)..(52): unsure at all Xaa locations
  Clone ID: PAT_TA_97317.pep
THISSPNNFWXHLKNTITKITSYSTAEIILSNKXQLXFWLVXLITIDLGVHI

SEQ ID NO: 202900 - protein, 111 aa, Triticum aestivum
  unsure (1)..(111): unsure at all Xaa locations
  Clone ID: PAT_TA_97318.pep
RLLRKYREAKKIDKHMYHDMYLKVKGNMFKNKRVLMESIHKSKAEKAREKTLSDQFEAKRAKSKASRERKICQRXRKRLXQGPRDHAPAPAAAAPAQAAAGTKRKAKKVKV

SEQ ID NO: 202901 - protein, 143 aa, Triticum aestivum
  unsure (1)..(143): unsure at all Xaa locations
  Clone ID: PAT_TA_97319.pep
CPLGLEVDKIHACPNDCILYRGAYKDLNACPVCGALRYKIRRDDPGDVDGEPPRKRVSAKVMWYAPIIPRLKRLFKNEEHAKLMXWHSENXKKDGKLRAPDDGSQWRKIERKYWXMSFXKXPXNVWVALSTDGINPFGGSKSN

SEQ ID NO: 202902 - protein, 105 aa, Triticum aestivum
  unsure (1)..(105): unsure at all Xaa locations
  Clone ID: PAT_TA_97320.pep
MXXAVXVLTGSEGVKGTIFFTQEGDVXTTVTGSVTXLKEXXHGFHVHALXDTTXGCMSTGPHFNPAGHVNGAPEDEIRHAGXDLGNVTAGXDXVAHQFLAGISPL

SEQ ID NO: 202903 - protein, 142 aa, Triticum aestivum
  unsure (1)..(142): unsure at all Xaa locations
  Clone ID: PAT_TA_97321.pep
PDGGGGSDGAGTGAGRIKGSWSPEEDELLRDAVARHGARNWTVISAEIPGRTGKSCRLRWCNQLXPGVHRRAFTPDEDRLIFXLHSKHGNTWATIARKAPSCRTRQTPSRNHWNXQRLXKTPAWXAAGPATAGGRSSPSLAC

SEQ ID NO: 202904 - protein, 83 aa, Triticum aestivum
  unsure (1)..(83): unsure at all Xaa locations
  Clone ID: PAT_TA_97322.pep
PPFESPXCITRVPPASRRHWSHLAWSSTMICPARLHGRRVGANLPGCSSLWRCPSFSWSPAAAPLWFVQCXTPTGXAQXRLMP

SEQ ID NO: 202905 - protein, 56 aa, Triticum aestivum
  unsure (1)..(56): unsure at all Xaa locations
  Clone ID: PAT_TA_97323.pep
TKCRXQCXALXXPYAMVFIVVVAMXYGLRATHAXXNFIAXTCREXXLTLHCCMAXL

SEQ ID NO: 202906 - protein, 62 aa, Triticum aestivum
  unsure (1)..(62): unsure at all Xaa locations
  Clone ID: PAT_TA_97324.pep
QNDWILLANKYVASQVSTPALFKPQTVTLLCVSALNKIDSNWIILKIILCKSFSEKKXXNQT

SEQ ID NO: 202907 - protein, 121 aa, Triticum aestivum
  unsure (1)..(121): unsure at all Xaa locations
  Clone ID: PAT_TA_97325.pep
TPLNLIGXIEFYLXSSSPKSMSSIGCRCFALGIGFGAVXGSAIVGIMNSATGRDGRDSWLSSNLNRGRYDYYYLVLAALSVANLVYFVWCSWAYGEEGQIRVMALAAEEAEEEETKQEQHK

SEQ ID NO: 202908 - protein, 142 aa, Triticum aestivum
  unsure (1)..(142): unsure at all Xaa locations
  Clone ID: PAT_TA_97326.pep
TQIIHCPNGAPAFLPQLPFPQQPQQPFPQPQQPQQPFXQSQQPQXPFPQPQQXFPQPQQPQQSFPQQQQPXIQSFLQXQMNPCKNFLLQQCXNHVSLVSSLVSIILPRSDCQGECSQQXLPNXXAQIXQTSSSAIQWAQFHH

SEQ ID NO: 202909 - protein, 114 aa, Triticum aestivum
  Clone ID: PAT_TA_97327.pep
ILCYQEGKEQALYFDAHVLEVERRIHDIRGCLCSFLVRYDHDHSEELVPLRKVCHRPSAVVKINIVIDHSLAEQKAKKSRKRMDMNPDKVTMVPKPTKSRRAVRQAGCSLTYHA

SEQ ID NO: 202910 - protein, 147 aa, Triticum aestivum
  unsure (1)..(147): unsure at all Xaa locations
  Clone ID: PAT_TA_97328.pep
PLPLQQILWYQXXQPIXXEPQPFPQQPPCSQXXXPPLXQQXXXPFSXXQPPFLQQQQPVLPQXPPFSQXQXQFPQQHXPLLPXXPPFSQXQPPFSHQQQXPPFSQQXXNTPILXQQXPFSQDQQAVLPXQQXXILLPXYLRQLTHRS

SEQ ID NO: 202911 - protein, 89 aa, Triticum aestivum
  unsure (1)..(89): unsure at all Xaa locations
  Clone ID: PAT_TA_97329.pep
WCSRHRXTSASTXXAGXSALTGLPSSPPXVEEGHRRHLQXXRPRRGDXLSVRLYLPKAPXTLHKAPGLVYFTGXPSSIESXRLLQRNKN

SEQ ID NO: 202912 - protein, 109 aa, Triticum aestivum
  unsure (1)..(109): unsure at all Xaa locations
  Clone ID: PAT_TA_97330.pep
PXRSTXRXPPCXXPPXPDXPHEARRXRKXNGGKAXXXQLATKAGAQVSXXPPXGVKXPHGFLPXEXXPSVEIPHLXKRXXWLIIXQSXPSNQLVRGSPLXGLQXXXLRL

SEQ ID NO: 202913 - protein, 45 aa, Triticum aestivum
  unsure (1)..(45): unsure at all Xaa locations
  Clone ID: PAT_TA_97331.pep
FFFFFLANKNFVCLLFPSLNXHLAGVTHDGALHFICHRYIDWCIS

SEQ ID NO: 202914 - protein, 154 aa, Triticum aestivum
  unsure (1)..(154): unsure at all Xaa locations
  Clone ID: PAT_TA_97332.pep
ASPSLFPSPSFSTSGRRRGQAGVAARHRATSTLTTRHQIHPPSPATSTPRAPDQTRGSRASGPPRERPRAADLLLQLPLLLPSRLLLLLFPASASYALLLLLTCCSLLLLLHPQICCCTSLKXEILXGLXXSLFSVLXSGWLLCXXSRSPXRFX

SEQ ID NO: 202915 - protein, 95 aa, Triticum aestivum
  unsure (1)..(95): unsure at all Xaa locations
  Clone ID: PAT_TA_97333.pep
NAAAAVVVPEGEEVHPRGFVGGVELVVEQLXPPPLXRPRXAFATAPAPCGTTAASARSCTPWPPPSPPPRTTTAAPXPPLSXSPWPAAAPRPLPG

SEQ ID NO: 202916 - protein, 102 aa, Triticum aestivum
  Clone ID: PAT_TA_97334.pep
IPPRRPPLPWRPTSAAQPPPCPGTASPPAASLPIPLPPPSSHAYPSPPPPPASPRPRPIPELCFEHPVSIQICGESQSGLKNEWVKGGERFLNVKSWENRTK

SEQ ID NO: 202917 - protein, 106 aa, Triticum aestivum
  unsure (1)..(106): unsure at all Xaa locations
  Clone ID: PAT_TA_97335.pep
MGIDLVAGGRNKRTKRVAPKSDDVYLKLLVKLYRFLVRRTKSKFNAVILKEXLHXSKTNRPPLSMRRLSNXXXGXXXKNIAVVVGKITXDMXXQEVPTMKGXALRF

SEQ ID NO: 202918 - protein, 134 aa, Triticum aestivum
  unsure (1)..(134): unsure at all Xaa locations
  Clone ID: PAT_TA_97336.pep
MSLIAGEEFQHILRVLNTNVDGKQKIMFALTSIKGVGRRFSNIVCKKADIDMNKRAGELSSEEMDRLMAVVHNPRQFKVPDWFLNRKKDYKDGRFSQVVSNAXVDMKLKDDLXERLKERXGNHRGCVTNWGCPW

SEQ ID NO: 202919 - protein, 81 aa, Triticum aestivum
  unsure (1)..(81): unsure at all Xaa locations
  Clone ID: PAT_TA_97337.pep
MGRVIRAQRKGAGSVFKSHTHHRKGPARFRSLDFGERNGYLKGVVTDVIHDPGRGAPLAKVTFRHPFRYKHKKGLXXPGEG

SEQ ID NO: 202920 - protein, 141 aa, Triticum aestivum
  unsure (1)..(141): unsure at all Xaa locations
  Clone ID: PAT_TA_97338.pep
PPPPPRQRPLEEPEAEPLPPPVQLGEVDEEELRQYDGSXPKKPSLXASRVKXYDVNARARMFXGPGGPXALFXGKDAXRALTKMSFXEPQDLNGDTSXLXPFELXALQDWEXKFMNKYXKVXNIXKGTPRKKEQKAKSQTN

SEQ ID NO: 202921 - protein, 136 aa, Triticum aestivum
  unsure (1)..(136): unsure at all Xaa locations
  Clone ID: PAT_TA_97339.pep
MKGAKSKGAAKADAKLAVKSKGAEKPAAKGKKGKAGKDPNKPKRAPSAFFVFMGEFREEFKQEEPQRTKSVAAVAKRPVXKWKSXXESEKGPYVGKGNKXSKGELNKGIAAXNKGPKXLAAAAPKXKXAKGGKREI

SEQ ID NO: 202922 - protein, 113 aa, Triticum aestivum
  unsure (1)..(113): unsure at all Xaa locations
  Clone ID: PAT_TA_97340.pep
XQIXSKIYXFXQHIFILRPPRLRFIPSKIGELIELLCCCCCSFAINLAGTVDEAFSEIWPTQLIYLTAELSKDFLVFITRGSSYMTYFGHHVASLYGFTICASKTSQTHHKKK

SEQ ID NO: 202923 - protein, 69 aa, Triticum aestivum
  unsure (1)..(69): unsure at all Xaa locations
  Clone ID: PAT_TA_97341.pep
MPRAGLSAVXXXVDVAIDLGNPLLNRTVDGFLKIGAVGAFXVXXPEDAFXCLQXWXVSRPAXLNNTLXK

SEQ ID NO: 202924 - protein, 134 aa, Triticum aestivum
  unsure (1)..(134): unsure at all Xaa locations
  Clone ID: PAT_TA_97342.pep
MLVYQDKLSGDELLSDSFPYRELENGVLWEVDGHWVVQGAVDVDIGANPSAEGGGDDEGVDDQXAVKVVDIVDTFRLQEQPAFDKKQXFISHMKRXHXEPHCQALKGDDLNVFXEXMFESAPNIFLTSSRDLXF

SEQ ID NO: 202925 - protein, 101 aa, Triticum aestivum
  unsure (1)..(101): unsure at all Xaa locations
  Clone ID: PAT_TA_97343.pep
MSRGGSAGGGQSSLGYLFGDGEPAKPAAAPAAKPAPAEKPAPAAADVAKQIPAGIPGSRANNXLTVADGQKHGQXFXTDRXXTKVNXAPGGWRPWGNVWRE

SEQ ID NO: 202926 - protein, 128 aa, Triticum aestivum
  unsure (1)..(128): unsure at all Xaa locations
  Clone ID: PAT_TA_97344.pep
MLVYQDKLSGDELLSDSFPYRELENGVLWEVDGHWVVQGAVDVDIGANPSAEGGGDDXGXVDEQAVKVVDIVDTFRLQXQPAFDKXXFNXQMKRYIKKLSAKLEREDLNXFKKNVXVPTKYLLTNSRA

SEQ ID NO: 202927 - protein, 153 aa, Triticum aestivum
  unsure (1)..(153): unsure at all Xaa locations
  Clone ID: PAT_TA_97345.pep
PAEMDVNHMMRSQRINPDSLADGGVSGASRNPAAPAPAPKPSKDERAPGRRRRHLTPRALLPPHLARESSGVLIRCPPEPLSLQRRHGHVPLPRNPTSAAAVAGGIXLSDCPLALXWWGQGKXSRXPFRKXGGXNXXDPXQVPXKNPSNXRRR

SEQ ID NO: 202928 - protein, 127 aa, Triticum aestivum
  unsure (1)..(127): unsure at all Xaa locations
  Clone ID: PAT_TA_97346.pep
ASPFPSPPPPTCRXXRSXGXXXASPFLTXCPLSLHVPLPAGRRAXPRXRPRGARXRLDTQATXLXRPXRRAAPXAXWSPTXLGRGKXTAXXRRLSXPCYATYXTRRPGFLRTPWCEGIXXXXALSSC

SEQ ID NO: 202929 - protein, 68 aa, Triticum aestivum
  unsure (1)..(68): unsure at all Xaa locations
  Clone ID: PAT_TA_97347.pep
TLSHSSSSLSLSLFSAFDSWSVFFRREWGXTWTFLAGFXVTGALITKMTAGFTEEDLKNSKFVQXHKN

SEQ ID NO: 202930 - protein, 137 aa, Triticum aestivum
  unsure (1)..(137): unsure at all Xaa locations
  Clone ID: PAT_TA_97348.pep
AKXNISLXYHXTNQKXAKVXFXSGTHCPAGGXXFPFPKQLAXTPCTSNFLDFKRQRMXPCIRTQPVSRFRQPGXGFGGAYMMPAAPDPGFGGAYMLPGPXWSLLELLMVRRRQLRPRQLLVVPRATHLLSMHRQQPA

SEQ ID NO: 202931 - protein, 143 aa, Triticum aestivum
  unsure (1)..(143): unsure at all Xaa locations
  Clone ID: PAT_TA_97349.pep
MKTFLVFALLAVAATSAIAQMETRCIPGLERPWQQQPLPPQQTFPQQPLFSQQQXLFPQQPSFSQQQPPFWQXQQPPFSQXQQPILPQXPPFSQXQQLVLPXQQPPFSQQQQPXVXPPQQXPFPQQQQXXQGCNKPGSIQFAL

SEQ ID NO: 202932 - protein, 57 aa, Triticum aestivum; identical to SEQ ID NO: 187774
  Clone ID: PAT_TA_97350.pep

SEQ ID NO: 202933 - protein, 34 aa, Triticum aestivum
  unsure (1)..(34): unsure at all Xaa locations
  Clone ID: PAT_TA_97351.pep
RICXILYPVARXTVTNPXXVXVVKXXSSXXRNXC

SEQ ID NO: 202934 - protein, 146 aa, Triticum aestivum
  unsure (1)..(146): unsure at all Xaa locations
  Clone ID: PAT_TA_97352.pep
LDESFGAKLGDFGLARFIDHAVGTQTMTAVSGTPGYVDPQSMITGRASAESDVYSFGVLLLEVACGXRRPISLLHDPAEKNGLFRLVXWVWDLYGRGALPDGADERLNRSTIGRRWVMVARALVARNRRSPRSMTSNGPSIPRDAK

SEQ ID NO: 202935 - protein, 152 aa, Triticum aestivum
  unsure (1)..(152): unsure at all Xaa locations
  Clone ID: PAT_TA_97353.pep
DFIKNMITGTSQADCAVLIIDSTTGGFEAGISKDGQTREHALLAFTLGVKQMICCCNKMXATTPKYSKXRYEXEIVKEVSSYLKKVGYNPDKVPFVPISGFEGDNMIEXRSTXLDWVQGPNPSLRXLDXXLNXPKRPLKTKPPPFXPLQGPF

SEQ ID NO: 202936 - protein, 106 aa, Triticum aestivum
  unsure (1)..(106): unsure at all Xaa locations
  Clone ID: PAT_TA_97354.pep
MLVYQDKLSGDELLSDSFPYRELENGVLWEVDGHWVVQGAVDVDIGANPSAEGGGDDEGVDDQAVKVVDIVDTFRLQEQPAFDXXSKFISHMKRHIKNLSAKLETG

SEQ ID NO: 202937 - protein, 126 aa, Triticum aestivum
  unsure (1)..(126): unsure at all Xaa locations
  Clone ID: PAT_TA_97355.pep
MAAPRGAAVVLAMVLAAMVVAPPATVHAAISCSTVYSTLMPCLQYVQQGGSPXRGCCTXIQXNLLAXAXNSPDRRTICGXCLKNVXNGASGGPXITPRPXALPXQXXNXGLPTXLSPKXXXCNRLK

SEQ ID NO: 202938 - protein, 122 aa, Triticum aestivum
  unsure (1)..(122): unsure at all Xaa locations
  Clone ID: PAT_TA_97356.pep
MKTFLILALLAIVATTATTAVRVPVPQLQPQNPSQQQPQEQVPVVQQQQFLGQQQPFPPQQPYPQPQPFPSQQPYLQXLQPFPQXPQLPXSQXPQPFQPQQPYXKPQPXYSQPKQPISKXQQ

SEQ ID NO: 202939 - protein, 140 aa, Triticum aestivum
  unsure (1)..(140): unsure at all Xaa locations
  Clone ID: PAT_TA_97357.pep
MARTKQTARKSTGGKAPRKQLATKAARKSAPATGGVKKPHRFRPGTVALREIRKYXKSTELLIRKLPFQRLVREIAQDFKTXDLRFXSSAVPALARRPPEVLTSWGALGQQTFCRQSNAAVNHPCPKGTQAFRPAAIWER

SEQ ID NO: 202940 - protein, 142 aa, Triticum aestivum
  unsure (1)..(142): unsure at all Xaa locations
  Clone ID: PAT_TA_97358.pep
DVVLQQHNIAHGRSQVLQQSTYQLLQELCCQHLWQIPEQSQCQAIQNVVHAIILHQQQKQQQQPSSQVSFQQPLQQYPLGQGSFRPSQXQNPQDQGSVQPQQLAQFRGNXRDXTXXXLPAMXCNVHIPPLQSRHFNRWRKLT

SEQ ID NO: 202941 - protein, 126 aa, Triticum aestivum
  unsure (1)..(126): unsure at all Xaa locations
  Clone ID: PAT_TA_97359.pep
LLLAVAVAFVSASNRRPRHQLVSSNGGKTVIVKLKWGMEYKGYLVSXDSYMNLQLSGTEEYIDGQCSGNLGDILIRCNNVMYLRGVPRGGHGHSRMRPEHMDCSWVDAWCSAEKKNFQFVNLLTGY

SEQ ID NO: 202942 - protein, 121 aa, Triticum aestivum
  unsure (1)..(121): unsure at all Xaa locations
  Clone ID: PAT_TA_97360.pep
MARLNSKAVAAAVVLAAVVLMMAGREASAALSCGQVDSKLAPCVAYVTGRASSISKECCSGVQGLNGLARNSPXRXIACRXLKSLATSIKSIKHGAKGLPXVGPGKVGVQRPFPRNVQPTQ

SEQ ID NO: 202943 - protein, 141 aa, Triticum aestivum
  unsure (1)..(141): unsure at all Xaa locations
  Clone ID: PAT_TA_97361.pep
MARTKQTARKSTGGKAPRKQLATKAARKSAPATGGVKKPHRFRPGTVALREIRKYQXKSTELLIRKLPFQRLVREIAQDFKTDLRFQSSAVGPGKEAARLPSWGLLRRDTKLLPIQPKAAQFHAQRIQASPPQSRWNKGPM

SEQ ID NO: 202944 - protein, 50 aa, Triticum aestivum
  unsure (1)..(50): unsure at all Xaa locations
  Clone ID: PAT_TA_97362.pep
LQNXCEKYTPHPLGLAYXSQNSCRTSSNRSQLTSTTEESMIQQTCIWLRK

SEQ ID NO: 202945 - protein, 78 aa, Triticum aestivum
  unsure (1)..(78): unsure at all Xaa locations
  Clone ID: PAT_TA_97363.pep
HYFPNRIPPISSRPKIFGKRDHXCHVHKSHNPPLLFKMHKNISKKRNHFTEEKKYEKNSITQKKNRAKLILTIASTQQ

SEQ ID NO: 202946 - protein, 150 aa, Triticum aestivum
  unsure (1)..(150): unsure at all Xaa locations
  Clone ID: PAT_TA_97364.pep
MKTFLVFALLAVAATSAIAQMETRCIPGLERPWQQQPLPPQQTFPQXPLFSXQQQLFPQQPSFSQXQXPPFWQQQPPFSQXNXQILPQQPPFSQQQQLVLPATTHHFSQQQPTKFXLQQQSTFSTNKXQQPNKLGNQNPLLVPNPIFGQL

SEQ ID NO: 202947 - protein, 99 aa, Triticum aestivum
  unsure (1)..(99): unsure at all Xaa locations
  Clone ID: PAT_TA_97365.pep
MKTLLILTXLXMAVPIGTANIQVDPSGQVQWLQXQLVPQLQQPLSQQPQQXFPQPQXTFPHQXTXSXFXKPQAXNXQTNFSSPXXNQFPKRKPISPQLQ

SEQ ID NO: 202948 - protein, 87 aa, Triticum aestivum
  unsure (1)..(87): unsure at all Xaa locations
  Clone ID: PAT_TA_97366.pep
RGVXHIKQGLIAFISTLLMPLYKSKKIDREAYKTMMRKAVTKIIDACTEGEXLMTANEFLDFRRKTKIQTFVKLVERHWHVAPAPKS

SEQ ID NO: 202949 - protein, 140 aa, Triticum aestivum
  unsure (1)..(140): unsure at all Xaa locations
  Clone ID: PAT_TA_97367.pep
MAPTVMASSATSVAPFQGLKSTAGLPVSRRSNGASLGSVSNGGRIRCMQVWPIEGIXKFETLSYLPPLSTXEXLLKQVDYLIRSKWVPCLXFXKVGXQPSVEQXASPXVXRMARYWXMLGSPNVSGWRNAQHKGSTGDGG

SEQ ID NO: 202950 - protein, 92 aa, Triticum aestivum
  unsure (1)..(92): unsure at all Xaa locations
  Clone ID: PAT_TA_97368.pep
MAAPRGAAVVLAMVLAAMVVAPPATVHAAISCSTVYSTLMPCLQXTCXQGGSPARGCCTGIXNXAGXTGNNQADPPAICGLPQVLQTASRGG

SEQ ID NO: 202951 - protein, 51 aa, Triticum aestivum
  unsure (1)..(51): unsure at all Xaa locations
  Clone ID: PAT_TA_97369.pep
MEXDMTXXSSQGTXPXPPRRSRYSPLXCDXQXGVXXQVYEGGXSRXRXNXL

SEQ ID NO: 202952 - protein, 115 aa, Triticum aestivum
  unsure (1)..(115): unsure at all Xaa locations
  Clone ID: PAT_TA_97370.pep
GPTLLPSKLLWCDQGSAPVRAAVSSRFLCLKLLPAPPPWXPQPRRGQAPRLRPPPARGLPPSSRPPRRRPASPPRAPPPSARPMGSGHQRWPLPSWMQENDRSGRGWLAEASATL

SEQ ID NO: 202953 - protein, 94 aa, Triticum aestivum
  unsure (1)..(94): unsure at all Xaa locations
  Clone ID: PAT_TA_97371.pep
MSCCGGNCGCXAGCKCGNGCGGCKMFPDVEXTAGAAXAMVMPTASHKGEAPXXFETXRGRPAGCDCTTLQVAAPCWLLLQLQPEAAQPDGRASM

SEQ ID NO: 202954 - protein, 152 aa, Triticum aestivum
  unsure (1)..(152): unsure at all Xaa locations
  Clone ID: PAT_TA_97372.pep
PXQEGWGQXXVARXKQKRALGERSSFRIVPRRPTSRGDXRGRSSSKERGKKKEGRNKEEATAGLGEEEATAGGWRREKQQGHREKRGGAADGQQRWWRCDGGVGGDVRCGWWWWRRGGDGVVDGAWWCWWRVATPAWLRRRPVVEEEVVRGE

SEQ ID NO: 202955 - protein, 118 aa, Triticum aestivum
  unsure (1)..(118): unsure at all Xaa locations
  Clone ID: PAT_TA_97373.pep
MSRGGSAGGGQSSLGYLFGDGEPAKPAAAPAAKPAPAEKPALAAADVTKQIPAGIXGSRANNYYRADGQXNTVNFLTDRPSTXVXAAPGGGLVPGGYXVXGEDLCLNAACNAWLLNQL

SEQ ID NO: 202956 - protein, 140 aa, Triticum aestivum
  unsure (1)..(140): unsure at all Xaa locations
  Clone ID: PAT_TA_97374.pep
MKTFLVFALLAVAATSAIAQMETRCIPGLERPWQQQPLPPQQTFPQQPLFSQQQQLFPQQPSFSQXQQPPFWQQXPPFSQQQPILPQXQPPFSQXQQQLVLPATTNIFNSNNXQVLPSTNNQLFHXQXQHQXXXATSLLV

SEQ ID NO: 202957 - protein, 105 aa, Triticum aestivum
  unsure (1)..(105): unsure at all Xaa locations
  Clone ID: PAT_TA_97375.pep
PSLMEVFLIIILXIMEALLIVILLLMXALLIVILLLVTGGGILGRRHRQRSLWRRSCPLGRSGHRGGVQSRLPELGEASEGEGEGDALRCLRASGAILYRQLGVA

SEQ ID NO: 202958 - protein, 130 aa, Triticum aestivum
  unsure (1)..(130): unsure at all Xaa locations
  Clone ID: PAT_TA_97376.pep
MANPRVFFDMTVGGAPAGRIVMELYKDAVPRTVENFRALCTXGEKGVGKSGKPLHYKGSAFHRVIPDFLCQGGDFTKGNGTGGEXSIYGRRSSPDXKFVHKQNKPGDPLQXQXRAPTTXXSQFFICTXPX

SEQ ID NO: 202959 - protein, 132 aa, Triticum aestivum
  unsure (1)..(132): unsure at all Xaa locations
  Clone ID: PAT_TA_97377.pep
MAAKEPMRVLVTGAAGQIGYALVPMIARGVMLGADQPVILHMLDIEFAAEALKGVKMELIDAAFPLLKGVVATTDVVEACTGGNVAVXMVGGFPXKERMXREDVYXKXFQSYKAQSNCSLKAQAXPNCXGLC

SEQ ID NO: 202960 - protein, 138 aa, Triticum aestivum
  unsure (1)..(138): unsure at all Xaa locations
  Clone ID: PAT_TA_97378.pep
SHLLPSLGDDAPSPVLAGLSSLRAPAKPASCHQALPLPDALRRRPALSADASSASLDWMXAARPXDRASPSAHLCLAXQGPACSSSPTGLLPPPPKRXQGLLXFXFRSGSCEGFVXTYIRFXFLQWEHXFLLPKPGIS

SEQ ID NO: 202961 - protein, 113 aa, Triticum aestivum
  unsure (1)..(113): unsure at all Xaa locations
  Clone ID: PAT_TA_97379.pep
MSDTDEHHFESKADSGASKTYPQQAGAIRKGGHIVIKARPCKVVEVSTSKTGKHGHAKCHFVAIDIFNXKKLEDIVPSTQNCDVPHVDRQDYQLIDIXDDXYVXLPTXXGNTK

SEQ ID NO: 202962 - protein, 100 aa, Triticum aestivum
  Clone ID: PAT_TA_97380.pep
APFRSTSHCFLPPKGTHNIFTMTSKGDMSPNLEKKEANGVTHITQRSRGGGGWAGFHDAGWMAGEEGEKKEKKRKEKVKHTKVKKNGSFAPGVVQCRQYK

SEQ ID NO: 202963 - protein, 107 aa, Triticum aestivum
  unsure (1)..(107): unsure at all Xaa locations
  Clone ID: PAT_TA_97381.pep
HGCTRERQQENETANEISKSPRQIDTHARTHPSCFLPIENGGAIAAPPRSAPSTALLISKQAYRPGRXGSLRFXXAKGSGLANNVVLAGTKTIRAGTPLVAXXGFPP

SEQ ID NO: 202964 - protein, 109 aa, Triticum aestivum
  unsure (1)..(109): unsure at all Xaa locations
  Clone ID: PAT_TA_97382.pep
CLAYILPLGXPXLLQLVARRFATTAEESLLAIAFRSRRSTAAEGRIQGRSTKAEDSKGGVQQQRGGSSGGRGAECSWPPPAAAAGGQWVAAAALSQVRRTGGSLWGRLK

SEQ ID NO: 202965 - protein, 136 aa, Triticum aestivum
  unsure (1)..(136): unsure at all Xaa locations
  Clone ID: PAT_TA_97383.pep
MATTAMALSPSSFAGKAVKDLPSSALFGEARVTMRKTAAKAKPVSSGSPWYGSDRVLYLGPLSGDPPSYLTGEFPXGDYGWXDNRGALGRXPKTFAKETGSWEVXHFRVGQCWGGGXGWRXPRELAPQGVVRLKAV

SEQ ID NO: 202966 - protein, 144 aa, Triticum aestivum
  unsure (1)..(144): unsure at all Xaa locations
  Clone ID: PAT_TA_97384.pep
MARTKQTARKSTGGKAPRKQLATKAARKSAPATGGVKKPHRFRPGTVALREIRKYQKSTELLIRKLPFQRLVREIAQDFKTDLRFQXSSAVSALQEAXRXLPWWGLFEGQQXXAAIKAKARQQSXPKGQFKLAXRXRWRGKLCL

SEQ ID NO: 202967 - protein, 103 aa, Triticum aestivum
  unsure (1)..(103): unsure at all Xaa locations
  Clone ID: PAT_TA_97385.pep
LSLSLSLSLSLSLSLPQSPTPLSPAALPGAPAAARARVRTHTRPRRXRSGRRRRRRWSTGRRPRTRPRALAAXGDAAGRLGLRXSARAKNAXGXXQRLXATXP

SEQ ID NO: 202968 - protein, 105 aa, Triticum aestivum
  unsure (1)..(105): unsure at all Xaa locations
  Clone ID: PAT_TA_97386.pep
MSRGGSAGGGQSSLGYLFGDGEPAKPAAAPAAKPAPAEKPAPAAADXAKQIPAGIPGSRANNYYRADGQNTGNFLTGPXPQXRVHAXPWRXAPXLGXLXFGGKSE

SEQ ID NO: 202969 - protein, 71 aa, Triticum aestivum
  unsure (1)..(71): unsure at all Xaa locations
  Clone ID: PAT_TA_97387.pep
TLPPPAAAAAQPQGEKARRXNEWEDXXLCXGCGLLXXELFXSVFXIXWCXXRSPPYXXXPIYCLGXXLLLS

SEQ ID NO: 202970 - protein, 75 aa, Triticum aestivum
  unsure (1)..(75): unsure at all Xaa locations
  Clone ID: PAT_TA_97388.pep
NRHYLTQINHEEIPRPCPHCCRGDHHXRRTLYCIPYXLGAAPSIISRAATNSTATRTTSSTSKVEPMQGCPPTTV

SEQ ID NO: 202971 - protein, 139 aa, Triticum aestivum
  unsure (1)..(139): unsure at all Xaa locations
  Clone ID: PAT_TA_97389.pep
MAPTVMASSVTSVAPFQGLKSTAGLPVSRRSNGASLGSVSNGGRIRCMQVWPIEGIKKFETLSYLPXLNTXXLLKQVDYLXRSXKWVPCLRXSTRVGFXFREQNASPGXTKGRYWXMWXKLPMFRMHPNPRKNQGGGKE

SEQ ID NO: 202972 - protein, 152 aa, Triticum aestivum
  unsure (1)..(152): unsure at all Xaa locations
  Clone ID: PAT_TA_97390.pep
MARTKXTARKSTGGKAPRKQLATKAARKSAPATGGVKKPHRFRPGTVALREIRKYQKSTELLIRKLPFQRLVREIAQDFKTDLRFQXSSAVSALQEAAEALPGWGLFEDTNLVRHPTPNARSTIIQRNIQAPPPHSGGSAYVFGFAPGELGT

SEQ ID NO: 202973 - protein, 84 aa, Triticum aestivum
  unsure (1)..(84): unsure at all Xaa locations
  Clone ID: PAT_TA_97391.pep
MQIFVKTLTGKTITLEVESSDTIDNVKAKIQDKEGIPPDQQRLIFAGKQLEDGRTLADYNIQKESTLHLXVLRLRGGMQIFVKT

SEQ ID NO: 202974 - protein, 111 aa, Triticum aestivum
  unsure (1)..(111): unsure at all Xaa locations
  Clone ID: PAT_TA_97392.pep
WCRVVSKVEVIEQGRELTCACGNFEHTXLLCCHAVKVLDFLGIDQIPAKHILERWKXNARDILADHLAHLQKDKISVTSITFKTHKIYTHMPLKLXDLGDASILAIMSVQV

SEQ ID NO: 202975 - protein, 96 aa, Triticum aestivum
  unsure (1)..(96): unsure at all Xaa locations
  Clone ID: PAT_TA_97393.pep
XLSDKMSKGKGCGEFLRAEDVGTSIEIVRSIYCPLXRTYFYFYPFVNLRXRLCLAKIITIQNCXTSLDKIDDSNFYXKKKKKKKKKKKKKLEXSSL

SEQ ID NO: 202976 - protein, 50 aa, Triticum aestivum
  Clone ID: PAT_TA_97394.pep
MAPGLYTDIGKKTRDLLYRDYCTHQKFTLTTCTPEGVVSTSAILSLALVP

SEQ ID NO: 202977 - protein, 156 aa, Triticum aestivum
  unsure (1)..(156): unsure at all Xaa locations
  Clone ID: PAT_TA_97395.pep
XPGXRXFCXXVPXXRGCXNPVFAGDWQVXVRXLXXLPQXIRELFAHRIDGQGAIGAKEGXEPGQEVGLAPEPRPALHPDKLAGDVHDDREGLQADGEVEGEGAERLRRDDEALRQVTPVGPSRPTDTMDDAVTGGHRRHQKEKQKKRASCSWGWHC

SEQ ID NO: 202978 - protein, 104 aa, Triticum aestivum
  unsure (1)..(104): unsure at all Xaa locations
  Clone ID: PAT_TA_97396.pep
FTPQELTEPTEQKGKTAGEACSQHQSYSKEQGGDNSKVIDLFSTNCSGSFNRRSEAWCRQVEVPPVTDARSACRYRNAMMDYANVTVPKXKVTPESNDEPNGKA

SEQ ID NO: 202979 - protein, 101 aa, Triticum aestivum
  unsure (1)..(101): unsure at all Xaa locations
  Clone ID: PAT_TA_97397.pep
MATTAMALSPSSFAGKAVKDLPSSALFGEARVTMRKTAAKAKPVSSGSPWYGSDRVLYLGPLSGDPPXSYLTRVKFPGRTTGWGTPAGGGGPPRTPEPGGR

SEQ ID NO: 202980 - protein, 126 aa, Triticum aestivum
  unsure (1)..(126): unsure at all Xaa locations
  Clone ID: PAT_TA_97398.pep
MSAYCGKYKDELIKNAAYIGTPGKGILAADESTGTIGKRFAXSINVENVEDNRRALRELLFCNPGALQXLNGVXLFEENLXXSNKXGKPFXQILKGGNXLPGIXVXDKGNIXXAXNNGEXNNQGFF

SEQ ID NO: 202981 - protein, 138 aa, Triticum aestivum
  unsure (1)..(138): unsure at all Xaa locations
  Clone ID: PAT_TA_97399.pep
MAKGGLSSKLKCMIRRWSSSRISRTPSAVSHGGGEEEDPWGRGVGGGGGGAASFHGADGVPPGLHPVYVGKSRRRYLIAADLVCHPLFQNLVDRSGGGXAARRRAATIIGCEVVLFEQXLLESGETNPTPLPSSVTRV

SEQ ID NO: 202982 - protein, 98 aa, Triticum aestivum
  unsure (1)..(98): unsure at all Xaa locations
  Clone ID: PAT_TA_97400.pep
VPTKQNGADGCMFEIMTPKARSDVHVNLPALQKLDSMLIEVLDSMVDTEYWYVESGSRSGGQGKNNGERQTKKWWLPSPCVPEXGLSQFQRKRIVFQG

SEQ ID NO: 202983 - protein, 80 aa, Triticum aestivum
  unsure (1)..(80): unsure at all Xaa locations
  Clone ID: PAT_TA_97401.pep
NXXEXARRDRTGLXVXAAAQHQTKHXNXSTTXARXEXRQESXGXDDGRIGLGXKIRXLEGGGKTLAATANGEEAAVCCAA

SEQ ID NO: 202984 - protein, 75 aa, Triticum aestivum
  Clone ID: PAT_TA_97402.pep
ITQILLIYSRCGHSFMQIVSEYHILEAFQSTRRSATAATFKSAAAEHFASGMVGHLGPLRRGTTPLLRRPLQEVP

SEQ ID NO: 202985 - protein, 154 aa, Triticum aestivum
  unsure (1)..(154): unsure at all Xaa locations
  Clone ID: PAT_TA_97403.pep
IEFXILXFVAPTSXLFXXXFSCFDLXTFIIICIVIXSKLPRKYIPIVTRIRRERPLNSRSRSEFKFARFDRKSLPDLSNTSGDLDSSLDPVVGTADGGLAVAKIRRLVCRWHATAAPPALRGCTAEDMLLSIFRIMSRRGLQERAAATSGRWEL

SEQ ID NO: 202986 - protein, 79 aa, Triticum aestivum
  unsure (1)..(79): unsure at all Xaa locations
  Clone ID: PAT_TA_97404.pep
VCDEINARAGVTVLVXGDGAMSTLVSDAXADLXAIKNXLRLHALLDYWDFKXLKVLPXXADTLTXTFXQARGLRPPPGM

SEQ ID NO: 202987 - protein, 84 aa, Triticum aestivum
  unsure (1)..(84): unsure at all Xaa locations
  Clone ID: PAT_TA_97405.pep
PAPPLXPPLLRSPPLSRTLAPPHPAQQPHPFPLSARRAXVASLPALHPPRSPPPTPLLXXEXGXPPNPQLPVSSPSRGRRSLFP

SEQ ID NO: 202988 - protein, 125 aa, Triticum aestivum
  unsure (1)..(125): unsure at all Xaa locations
  Clone ID: PAT_TA_97406.pep
MAGRKGGDRKKAVTRSVKAGLQFPVGRIGRYLKKGRYAQRVGSGAPVYLAAVLEYLAAEVLELAGNAGKDNKKTRIIPRQLLLAVRKEQELXKLLXGVNIAXGGVIPNINSVAAPQXSSRAARRR

SEQ ID NO: 202989 - protein, 116 aa, Triticum aestivum
  unsure (1)..(116): unsure at all Xaa locations
  Clone ID: PAT_TA_97407.pep
MASIAGSAVSFAKPVKAINTNSLSFSGARRGNAFLRLQPVPMRFAVCCSAKQDTVEKVCEIVKKQXLAVPEGTEVCGXTTKFSELGXADSLDNVSKIVMGPRGSFKIKAWENQKAI

SEQ ID NO: 202990 - protein, 145 aa, Triticum aestivum
  unsure (1)..(145): unsure at all Xaa locations
  Clone ID: PAT_TA_97408.pep
KFTGPRARTPGAFKQXSXNFRPRIAXSFSPNEMXSLWESKIGRTLPRXTLSEEHLLAMAAEDIIPESIVASLTHDIFINGCQTNFGIDGSRDVEVSTLYPDIPFRTIDECFDDYAHGLHLEEEAEDSKKSNAPMVERLAVYPTCA

SEQ ID NO: 202991 - protein, 105 aa, Triticum aestivum
  unsure (1)..(105): unsure at all Xaa locations
  Clone ID: PAT_TA_97409.pep
MSGRGKGGKGLGKGGAKRHRKVLRDNIQGITKPAIRRLARRGGVKRISGLIYEETRGVLKIFLENVIRDAVTYTEXHARRKTVTAMDVVYALKXARARTLYGFGG

SEQ ID NO: 202992 - protein, 118 aa, Triticum aestivum
  unsure (1)..(118): unsure at all Xaa locations
  Clone ID: PAT_TA_97410.pep
APFIPLRRXRPRVLCAXSRSLLPPSMVDQLTDEHIAXFNRXPSGSSNXDGERFASPPRGXSGPVXRSXRXRXPTGRXGXWXXKXIQXRXRRXDGKREPIXFPGXXGTLXXKEXMKGTT

SEQ ID NO: 202993 - protein, 91 aa, Triticum aestivum
  Clone ID: PAT_TA_97411.pep
MGKEKTHINIVVIGHVDSGKSTTTGHLIYKLGGIDKRVIERFEKEAAEMNKRSFKYAWVLDKLKAERERGITIDIALWKFETNQSTTAPVI

SEQ ID NO: 202994 - protein, 93 aa, Triticum aestivum
  Clone ID: PAT_TA_97412.pep
TNFCKIKFNLVVSCIGYVISDTARCTGGNLRTSMSKYIYVDRLESSANMTIIIYTYFQYNQFSCFYHHIFYRILVLEVFQKWTVYGQVSTTCA

SEQ ID NO: 202995 - protein, 52 aa, Triticum aestivum
  unsure (1)..(52): unsure at all Xaa locations
  Clone ID: PAT_TA_97413.pep
MKTLLILTIIAVALTTTTANIQVDPSGQVQWPQXQQPFPQPQQPQQXFPPPN

SEQ ID NO: 202996 - protein, 64 aa, Triticum aestivum
  unsure (1)..(64): unsure at all Xaa locations
  Clone ID: PAT_TA_97414.pep
EXGPSSVDXXVHEHSXXNIMDPXXLMKXLXLXISGREXTKXGRRKGGGGGVDGWIAGGGEGCVL

SEQ ID NO: 202997 - protein, 71 aa, Triticum aestivum
  unsure (1)..(71): unsure at all Xaa locations
  Clone ID: PAT_TA_97415.pep
MSRGGSAGGGQSSLGYLXFGDGEPAKPAAAPXAKPAPAEKPAPAAACTQADTWHSRPGRTTITVQTNTGFL

SEQ ID NO: 202998 - protein, 120 aa, Triticum aestivum
  unsure (1)..(120): unsure at all Xaa locations
  Clone ID: PAT_TA_97416.pep
HISSSAARRGSSATMSGRGKGGKGLGKGGAKRHRKVLRDNIQGITKPAIRRLARRGGVKRISGLIYDETRGVLKIFLENVIRDAVTYTEHXRRXTVTAMXDVVYAPQSARGRTLLTASGG

SEQ ID NO: 202999 - protein, 146 aa, Triticum aestivum
  unsure (1)..(146): unsure at all Xaa locations
  Clone ID: PAT_TA_97417.pep
PSXGPAXRVXXFXPTAXPFGLLVLDQRAGRPSAXRFRPRSLLXXGASLVXLLASXCLPAPPPLFSLKPRRGQAPRLRPPPARGLPPSSRPPRRRPASPPRAPPPSARPMGSGHQRWPLPSWMQENDRSGRGWLAEASATLIRECEA

SEQ ID NO: 203000 - protein, 107 aa, Triticum aestivum
  unsure (1)..(107): unsure at all Xaa locations
  Clone ID: PAT_TA_97418.pep
MVKAVAVLTGSEGVKGTIFFTQXEGDGPTTVTGSVTGLKEGLHGFHVHALGDTTNGCMSTGPHFNPAGHVHGATEDEIPHAGDWEMLQLGADGCLLNNQMFTGLANI

SEQ ID NO: 203001 - protein, 108 aa, Triticum aestivum
  Clone ID: PAT_TA_97419.pep
GGRELHRRQQIGLGQCAAQRPLLPRPVMPRRRRHREVPVAQYMLHRRGRRHARRVEQRRGRAPQQHHGHPRSTLSPSPSPQREREREREREREISQADWQRTGKRVAS

SEQ ID NO: 203002 - protein, 80 aa, Triticum aestivum
  unsure (1)..(80): unsure at all Xaa locations
  Clone ID: PAT_TA_97420.pep
WDXGPXPLXYQXHIQVXLKIAXXALLXTLXXXVLXSNADTXPTCTVKYLKKFGGYLTGXXQEDCHXXXTCPEDKECNLEA

SEQ ID NO: 203003 - protein, 57 aa, Triticum aestivum
  unsure (1)..(57): unsure at all Xaa locations
  Clone ID: PAT_TA_97421.pep
LXLVLXWDKPIVXXSVVHKHVTRHVYACIIISTWFVHASITHNIGQINPSXQVHPYT

SEQ ID NO: 203004 - protein, 80 aa, Triticum aestivum
  Clone ID: PAT_TA_97422.pep
QTSEKCAIDQLAARSNQCSKHHCGQPVENYEQSKICSDWPEEQLPMEHEKHHVLNNEHQIVDKNTENSQNKQVILLPNLV

SEQ ID NO: 203005 - protein, 146 aa, Triticum aestivum
  Clone ID: PAT_TA_97423.pep
AVASPCFPCKASPMCPHPLPHLSLLGHALHVLLPSFFHLRRRLTSARPRRRASPRLRTLRPAGAPLAGAEHRRRPTPLPPAPLSSCLSLTSLSPMDAWSSLAGRCAALPRGLQMRPATPPEPSTAAALGEQRRRPAPFPPTGYRFG

SEQ ID NO: 203006 - protein, 142 aa, Triticum aestivum
  unsure (1)..(142): unsure at all Xaa locations
  Clone ID: PAT_TA_97424.pep
XFXEIXFPSXXRQXKIFXQPXGKXXHXWNRSXKXTFXRXWGPIIVDLDIXXSCLXFXLFPPPWSLWXXGLGCXSGSFRTXGHPTTCALXXGGAXAPAAAAASPFLLVLLPASPGSRGSTVEERVCEPALGAAPVRDVSSSGS

SEQ ID NO: 203007 - protein, 132 aa, Triticum aestivum
  unsure (1)..(132): unsure at all Xaa locations
  Clone ID: PAT_TA_97425.pep
MARTKQTARKSTGGKAPRXQLATKAARKSAPATGGVKKPHRFRPGXVALREXRKYQXKSTELLIRKLPFQRLVREIXXDFKTDXRFQSSAVSALQRXAEAYXLGLFEEXKLXXIQAKRVNNMPRDINSQRRI

SEQ ID NO: 203008 - protein, 44 aa, Triticum aestivum
  unsure (1)..(44): unsure at all Xaa locations
  Clone ID: PAT_TA_97426.pep
FFFXFFXXFFFFFFFLDPITHMLRSNHTKRDTMIQRQQRKDTRC

SEQ ID NO: 203009 - protein, 62 aa, Triticum aestivum
  unsure (1)..(62): unsure at all Xaa locations
  Clone ID: PAT_TA_97427.pep
CSETSSFHLLQLPDFIPPXXXCXVXEXTXXAAAMFMPTXSHXGXSXGFXXAXGXXGXXECXX

SEQ ID NO: 203010 - protein, 110 aa, Triticum aestivum
  unsure (1)..(110): unsure at all Xaa locations
  Clone ID: PAT_TA_97428.pep
TKRALATEPCSGNFGPAXCQXFCXSNXXPVXLXXFCLGXLVFGSIVAGNQXXCXXCGCACGCGCGCCWHCXYPWXQVVXSCATALVPVKARRARRNMVFMVAGYKLALVF

SEQ ID NO: 203011 - protein, 96 aa, Triticum aestivum
  unsure (1)..(96): unsure at all Xaa locations
  Clone ID: PAT_TA_97429.pep
FLTTKYTSQRCVQGNHYKEQDIQKRISKKMGKSSHXWILEVGFLFRPSSLLIWLFLVFSLISKPSSLLLFFCSGDEGPANWADPSFVRKKKILPGL

SEQ ID NO: 203012 - protein, 131 aa, Triticum aestivum
  unsure (1)..(131): unsure at all Xaa locations
  Clone ID: PAT_TA_97430.pep
MARTKQTXRKSTGGKAPRKQLATKAARKSAPATGGVKKPHRFRPGTVALREIRKXQKSTELLIRKLPFQRLVREIAXDFXTDLRFQSSAVSXLXXAADAYLVGLFXDNNLXAIXAKXVTSCPKDIQAPPQF

SEQ ID NO: 203013 - protein, 132 aa, Triticum aestivum
  unsure (1)..(132): unsure at all Xaa locations
  Clone ID: PAT_TA_97431.pep
WSRXGXCGPQHPEVRAGRXRXXWVGRTXADRRRSPTGQXKKTMMPXVDXNPNSTXVGICDVADGAGSSGQGPWARGRWWARESTTAMATRCSGVRRGEEKWRGEGGNGARVRSRGRGRXGGSCXRRGGEDGR

SEQ ID NO: 203014 - protein, 129 aa, Triticum aestivum
  unsure (1)..(129): unsure at all Xaa locations
  Clone ID: PAT_TA_97432.pep
MELPLRTQPHPQQEQGARPRVLLPLILRAMPMRVLTVGKKRSQGTQLLVEEYKEKLGHYCDVEDTLIKSNPKLTSDVKVQIEAEDASMMQQLKAEDFVVVLDENGERDSCPSRLADLIGDAXNTGVQFG

SEQ ID NO: 203015 - protein, 104 aa, Triticum aestivum
  unsure (1)..(104): unsure at all Xaa locations
  Clone ID: PAT_TA_97433.pep
DFTRRFXRAKVPRSKSCHPPKKASCTMTMVLSPQMGAATCVACWRRLLAAPLLLLPLDYSSSRGFSRTHTHGRNSQETHTHTYKESPKVFALRHSSLSAQEXHC

SEQ ID NO: 203016 - protein, 120 aa, Triticum aestivum
  unsure (1)..(120): unsure at all Xaa locations
  Clone ID: PAT_TA_97434.pep
XTFLVFALLAVAATSAIAQMEXRCIPGLERPWXXQPLXPQQXTFPQQRLFSQXQQLFPQQPSFSQXQPPFWEQQPPFXQXQXXILPXQPXFSQAXTXVLPQXXXFSQXSXXQFLPPTTLF

SEQ ID NO: 203017 - protein, 165 aa, Triticum aestivum
  unsure (1)..(165): unsure at all Xaa locations
  Clone ID: PAT_TA_97435.pep
QILQQQLIPCRDVVLQQHSIAHGSSQVLQQSTYQLVQQLCCQQLWQIPEQSRCQAIHNVVHAIIXLHQQQQQQQQQQQQQQQQPLSQVCFQQSQQQYPSGQGSFQPSQQNPQAQGSVQXPNNCPKFEEIRNLALRDLPANVQCLYPLQYCTNWLQLILVTKLRNK

SEQ ID NO: 203018 - protein, 139 aa, Triticum aestivum
  unsure (1)..(139): unsure at all Xaa locations
  Clone ID: PAT_TA_97436.pep
MARLNSKAVVAAVVLAAVVLMMAGREASAALSCGQVDSXKLAPCVAYVTGRASSISKECCSGVQGLNGMARXSSDRKIACRCLKSLATSIXSINMGKVSGVPXKCGRQCVLPPISMSTXRQCSTSIINPFPNPHALPLV

SEQ ID NO: 203019 - protein, 153 aa, Triticum aestivum
  unsure (1)..(153): unsure at all Xaa locations
  Clone ID: PAT_TA_97437.pep
MAPTVMASSATSVAPFQGLKSTAGLPVSRRSNGASLGSVSNGGRIRCMQVWPIEGIKKFETLSYLPPLXSTEALLKQVDYLIRSKXGXPCLEVXQRVGFIFREHNASPGVLXDGRYWXIWELPMFXVXPTXXQGDSGGKRKKRSPGRSSAINP

SEQ ID NO: 203020 - protein, 137 aa, Triticum aestivum
  unsure (1)..(137): unsure at all Xaa locations
  Clone ID: PAT_TA_97438.pep
CLDRIRKLSDNCTGLQGFLVFNAVGGGTGSGLGSLLLERLSVDYGKKSKLGFTVYPSPQVSTSVVEPYNSVLSTHSLLEHTDVSILLDNEAIYDICRRXPLXIERPTYTKPQTRLCFLKVNSSTGQFPGVWGASEMV

SEQ ID NO: 203021 - protein, 171 aa, Triticum aestivum
  unsure (1)..(171): unsure at all Xaa locations
  Clone ID: PAT_TA_97439.pep
LFPSTSKGXGAGXGLGQXXPXLFPFTFLXPXRXGFSXKPKALPFXXLVXGXNGGGXRXSRFRPASLLAPGSLSFSLCLKLLAGASSLGLLNLDRGQAPRLRPPPARGLPPSSRPPRRRPASPPRAPPPSARPMGSGHQRWPLPSWMQENDRSGRGWLAEASATLIRECEAR

SEQ ID NO: 203022 - protein, 96 aa, Triticum aestivum
  unsure (1)..(96): unsure at all Xaa locations
  Clone ID: PAT_TA_97440.pep
RRRRPRWRSRSPPRRSRRRRKPPRRWRPKSRRLPPSKLRRPKRXXPGSNLRAKGXRKEXRSQAXLXXENRKGRRPRWVQKQKEGRWVGNPGGGPRG

SEQ ID NO: 203023 - protein, 43 aa, Triticum aestivum
  Clone ID: PAT_TA_97441.pep
FRQPSRLNIITDQVFLERSKAYSEVICRKLHLLIGLVGLKQCL

SEQ ID NO: 203024 - protein, 130 aa, Triticum aestivum
  unsure (1)..(130): unsure at all Xaa locations
  Clone ID: PAT_TA_97442.pep
MKTFLILALLAIVATTATIAVRVPVPQLQPQNPSQQQPQEQVPLVQQQQFPGQQQPFPPQQPYPQPQPFPSQQPYLQXLQPFPQPXATYPAAGNLPISAXPQLTISXXRHPIFDQQQTXCXQIRQPQPNP

SEQ ID NO: 203025 - protein, 131 aa, Triticum aestivum
  unsure (1)..(131): unsure at all Xaa locations
  Clone ID: PAT_TA_97443.pep
PKAAPHPARPTDAPSXPPPPXARPAKTLSATSPPPPRSPRAPPPRSPRAPPPPPPPPWRTTPSPRSWTSTTPPAALPXPASSTTTTRGNLLSHRMGGGKRGGGGPSPFRRASSPFDRTFDELFWAGEPPGK

SEQ ID NO: 203026 - protein, 117 aa, Triticum aestivum
  unsure (1)..(117): unsure at all Xaa locations
  Clone ID: PAT_TA_97444.pep
KPXGGTNLLPRDCNXXXSXIAPXSXXTXSRQIQIXADSNXQQIDXGXXSGAKRIYAAVICRXRXGSXDEXTDXRRGRRXPLQWRTXAKRXAAPEXTSVAARDXXAAPXADTGLGAGA

SEQ ID NO: 203027 - protein, 116 aa, Triticum aestivum
  unsure (1)..(116): unsure at all Xaa locations
  Clone ID: PAT_TA_97445.pep
YREGLMSPQTETKAGVGFKAGVKDYKLTLLHPXYETKDTDILAAFRVSPQPGVPPEEAGAAVXAAESSTGTWXTVWTDGLTXSLIXYXGRCYHIEXPXAGEXSQWIXYVAXXIRPI

SEQ ID NO: 203028 - protein, 74 aa, Triticum aestivum
  unsure (1)..(74): unsure at all Xaa locations
  Clone ID: PAT_TA_97446.pep
MAAIRRLIPSFNRVLVEKVVQPXKSAXGILLPETSKQLNSGKVIXVGPWQXRDKEXKLIPVALKGRTCSCELWS

SEQ ID NO: 203029 - protein, 76 aa, Triticum aestivum
  unsure (1)..(76): unsure at all Xaa locations
  Clone ID: PAT_TA_97447.pep
MKTFLIFALXAVAATSAIAQMXTIHIPSLXKPLQXXPLPLQXILXYQXXXPIQXQPXPFPQQXPXXSQXXXRPLSX

SEQ ID NO: 203030 - protein, 60 aa, Triticum aestivum
  unsure (1)..(60): unsure at all Xaa locations
  Clone ID: PAT_TA_97448.pep
GDGRVRILITATTRAAAAVAITRYYGSMNFMDASVSCMVLNNVIVLHHNVLSLXVFSVGC

SEQ ID NO: 203031 - protein, 114 aa, Triticum aestivum
  unsure (1)..(114): unsure at all Xaa locations
  Clone ID: PAT_TA_97449.pep
AIPIPKHXIAXAASMXXPXXPRXYGSXAVPXVRLHRLPRRSTLSSPSXSPDLPTPRGDPRLLRGHPMXATRLLLGSXXRPPGXLLLMPSMVGPTRRSPTXPXRAXNXXSPAXSS

SEQ ID NO: 203032 - protein, 105 aa, Triticum aestivum
  unsure (1)..(105): unsure at all Xaa locations
  Clone ID: PAT_TA_97450.pep
XXPKXXNRVESXLFRALTGXWPVGNWLWRASLXASHGNGGRAXWHPRXPIGVSANTLSSTLXPLDPAVNSSKAKGASQFHASTLFSVWHCMCSSSAGLDSRVLXC

SEQ ID NO: 203033 - protein, 103 aa, Triticum aestivum
  unsure (1)..(103): unsure at all Xaa locations
  Clone ID: PAT_TA_97451.pep
MAPTVMASSXTSVAPFQGLKXXAXLPVSRRXNXASLGSVSNXGRIXCMQVXPIEGIKXFXXLSYLPPXXXGGPLQARLEPDFPGLPFAFFTQRVVVSVAIHPP

SEQ ID NO: 203034 - protein, 104 aa, Triticum aestivum
  unsure (1)..(104): unsure at all Xaa locations
  Clone ID: PAT_TA_97452.pep
GRXXXGRLXFXXXEKDGEANPVXGEXQLQPRRRSATRTPGCXXSLPRTNPPPRSGQGASLRAGANHGXMERGKGGGKGXGGAAAKGDGEGARAVAGWGEWSGVG

SEQ ID NO: 203035 - protein, 115 aa, Triticum aestivum
  unsure (1)..(115): unsure at all Xaa locations
  Clone ID: PAT_TA_97453.pep
MARLNSKAVVAAVVLAAVVLMMAGREASAALSCGQVDSXKLAPCVAYVTGRASXINKEXCCSXVQRAERDXPQQLXTAKITCXXSKSLXXNXKFNXNWQGXRXXPGXXGVXXXFP

SEQ ID NO: 203036 - protein, 109 aa, Triticum aestivum
  unsure (1)..(109): unsure at all Xaa locations
  Clone ID: PAT_TA_97454.pep
MAGATMALSSPAMAGTPVKASRAAPFGEGRITMRKTAGKPKVAASNNPWYGSDRVAXLGPLSGEPPSXSXXSFPGNNGGKXXGLSAEPQNXPKKREXGXIQLXWXNLXA

SEQ ID NO: 203037 - protein, 47 aa, Triticum aestivum
  unsure (1)..(47): unsure at all Xaa locations
  Clone ID: PAT_TA_97455.pep
MXXRANHPXVMXXFGGXFHLASSFSEXVRXRNICPSXXSYERXFTTS

SEQ ID NO: 203038 - protein, 153 aa, Triticum aestivum
  unsure (1)..(153): unsure at all Xaa locations
  Clone ID: PAT_TA_97456.pep
PPLAPPGLLLSRDLARSTQLILPTPPCFPQPHNQIHLLHSTPPLDPTKLLPEAPSRSARTRLPTLPFATPGYLAQVLKHXQXRPFPSLPSPAFFSFSSASLSRSHLSLSFLSXRXPWCQXPGXRPTRPXKIPNXXGTXPGALNNRTXXVAPXT

SEQ ID NO: 203039 - protein, 78 aa, Triticum aestivum
  unsure (1)..(78): unsure at all Xaa locations
  Clone ID: PAT_TA_97457.pep
MITSPIVAPTSVPSLSRRGSSFAVVCSGGKKIKVDKPLGLGGGLTVDIDANGXKVGXKGVYQFVDKVRGXNVEGYNPI

SEQ ID NO: 203040 - protein, 107 aa, Triticum aestivum
  unsure (1)..(107): unsure at all Xaa locations
  Clone ID: PAT_TA_97458.pep
LAPPPPAPTSALPPPPPPEKERKQPQPWVASATKTVKKTSRQVIXKYYSRMNLDXQTNKEGARGRSPXXNPKRLXNKGXAGXNNHLIAPESRRARGPLKLQGRKEPN

SEQ ID NO: 203041 - protein, 57 aa, Triticum aestivum
  unsure (1)..(57): unsure at all Xaa locations
  Clone ID: PAT_TA_97459.pep
GLKKDTXXXLXKHPGVTEXXIRXTXCKRHRTGRTTKGTXWQRLTAXQVXYXXXNNAX

SEQ ID NO: 203042 - protein, 147 aa, Triticum aestivum
  unsure (1)..(147): unsure at all Xaa locations
  Clone ID: PAT_TA_97460.pep
MKTFLILALLAIVATTATTAVRVPVPQLQPQNPSQQQPQEQVPLVQQQQFLGQQQPFPPQQPYPQPQPFPSQHPYLQLQPFPQPQLPYSQPQPFRPQQPYPQPQPQYSQXQXPISQXQHQXQQQQPDPSTFATTTWIPMCWYCKQPQ

SEQ ID NO: 203043 - protein, 61 aa, Triticum aestivum
  unsure (1)..(61): unsure at all Xaa locations
  Clone ID: PAT_TA_97461.pep
MGKTYPVVSAEYQXAVEKARQKLRALIAEKNCSPLMLQXPRXTXAGTFXDVXQRXGGXVRR

SEQ ID NO: 203044 - protein, 67 aa, Triticum aestivum
  unsure (1)..(67): unsure at all Xaa locations
  Clone ID: PAT_TA_97462.pep
SRXXPRXALGLAPTSAGTTATXALAHREARXPRSGGHGTXSALQGGSALRRNTPGRGGDSQRGAWLR

SEQ ID NO: 203045 - protein, 50 aa, Triticum aestivum
  Clone ID: PAT_TA_97463.pep
ARLRLRLRLRITEEMICYSTRLGRTHTPLLPSPPSLPPTPAPPYLLPRRK

SEQ ID NO: 203046 - protein, 114 aa, Triticum aestivum
  unsure (1)..(114): unsure at all Xaa locations
  Clone ID: PAT_TA_97464.pep
PIPTEESPTDRSQGSLVLLPKIFVKTLTGKTITLEVESSDTIDNVKATIXGQGGHLPGTKXRLIFAGKQLEDGXTFADYXIQEXGPPLQLXLRLXWAVILPVKTDATITGGSPS

SEQ ID NO: 203047 - protein, 133 aa, Triticum aestivum
  unsure (1)..(133): unsure at all Xaa locations
  Clone ID: PAT_TA_97465.pep
PPXXVRXGGNXXALEXXLVMPXLAXEXXWXXPXQTXPACACRGRRXAXSGSGGXGLRLLMAEQKKGKMPSIAGPDQAVDRPSRAAEVLASLLGQSSARRQVLDCLSGFMARFEELRDGTNWHPHHVSYSGRGE

SEQ ID NO: 203048 - protein, 51 aa, Triticum aestivum
  unsure (1)..(51): unsure at all Xaa locations
  Clone ID: PAT_TA_97466.pep
RVLVLVLAXSXERRXVXGXTLEAXAACLRWGVELXYHNWXNGPXXXRXYXV

SEQ ID NO: 203049 - protein, 157 aa, Triticum aestivum
  unsure (1)..(157): unsure at all Xaa locations
  Clone ID: PAT_TA_97467.pep
SDLEHPFSYGSKGGSTSVEKDYGGVGGGILWLFADDLLMNGTVLADGGDXXDKXGGGSGGSIYIKAETMHGAGKISASGGNGLAGGGGGRVSXINVFSRHDDTQIFVHGGMSSGCPNNAXAAWXLLMNAXTXKSLVFTTNNNEFTKLXTPPVGFQNQ

SEQ ID NO: 203050 - protein, 106 aa, Triticum aestivum
  unsure (1)..(106): unsure at all Xaa locations
  Clone ID: PAT_TA_97468.pep
AWVRMARIWRXARDPAVGCXGEAPLLWCWVGGETRLVVIPLSCGLGXRWPRGIXLGXAPXAXGXXXALXXGRXPNWXLPKXLPXXPAVLVKXLPAXFQXHXDPXTX

SEQ ID NO: 203051 - protein, 104 aa, Triticum aestivum
  unsure (1)..(104): unsure at all Xaa locations
  Clone ID: PAT_TA_97469.pep
RHAPPPPQPDPAPSLPHSHPAXPPPPTLPSSPAPSWDXRRRHRVDPTXXPWYXPTPVPNAVEDPXTPXAPXGDDTLLSXVXDLPHCPGXXXFXPXXXRQXXPQP

SEQ ID NO: 203052 - protein, 95 aa, Triticum aestivum
  unsure (1)..(95): unsure at all Xaa locations
  Clone ID: PAT_TA_97470.pep
MAAIRRLIPSFNRVLXEKVVHPKXSAGGIXLPXETSKQLNSGKVISCCALAXRDKXGKLIPVALXEGDCASCLELWWGLEKAPGKPSLTNKWPPK

SEQ ID NO: 203053 - protein, 66 aa, Triticum aestivum
  unsure (1)..(66): unsure at all Xaa locations
  Clone ID: PAT_TA_97471.pep
AYCGPIGFEYMHIPDRXDKCNWXREKIETVAPREYPKDXRLVMLDRLIWSTQFENFLATKWATAXR

SEQ ID NO: 203054 - protein, 82 aa, Triticum aestivum
  unsure (1)..(82): unsure at all Xaa locations
  Clone ID: PAT_TA_97472.pep
MAAPRGAAVVLAMVLAAMVVAPPATVHAAISCSTVYSTLMPCLQYXQQGGSPARGCCTGIXEPXXRXPTXXPNGGTIXGQER

SEQ ID NO: 203055 - protein, 138 aa, Triticum aestivum
  unsure (1)..(138): unsure at all Xaa locations
  Clone ID: PAT_TA_97473.pep
MKTFLVFALLAVAATSAIAQMETRCIPGLERPWQQQPLPPQQTFPQQPLFSQQQQLFPQQPSFSQXQQPTFWEATNNHFPQEQPIPPTXTNQFXXQTQXIXXEXPTIXXQQQPXLXPQXSPFPXQXQPQXXXEQQIPG

SEQ ID NO: 203056 - protein, 112 aa, Triticum aestivum
  unsure (1)..(112): unsure at all Xaa locations
  Clone ID: PAT_TA_97474.pep
DXLEXXSXXXLXLXDRPXESTLISSEMXLVWPDSXXNRRXRADGETAKRTAARRXSVEGGSXLEAGDPXRRAAMAGDRSXSRSARQGPRTKSRGGVGRLADWDGDGGGGERL

SEQ ID NO: 203057 - protein, 151 aa, Triticum aestivum
  unsure (1)..(151): unsure at all Xaa locations
  Clone ID: PAT_TA_97475.pep
ALLAFTLGVKQMICCCNKMDATTPKYSKARYEEIVKEVSSYLKKVGYNPDKVPFVPISGFEGDNMIERSTNLDWXYKGPTLLEALDQINEPKRPSXDSPWRLPLQGRLTRLXGIGTVPVGAGVEXWVPSXPXVXAGNXXPNGSDNLRVTSV

SEQ ID NO: 203058 - protein, 117 aa, Triticum aestivum
  unsure (1)..(117): unsure at all Xaa locations
  Clone ID: PAT_TA_97476.pep
DCSSMPWESTRRQALVLVALVTVLTLVKLKHQLLHSPFSKGQAKIPHGASRELSPPPMALHPTFQVGPKGRAFAITLRVKXXXVPMRGKKKKKKNLXLXGGGARXXQISAPXXXGXF

SEQ ID NO: 203059 - protein, 47 aa, Triticum aestivum
  unsure (1)..(47): unsure at all Xaa locations
  Clone ID: PAT_TA_97477.pep
ELPSGKDKXIXHFSHMLLGKDGLXWSSPSKYHTLLLXSXFXFNVYXL

SEQ ID NO: 203060 - protein, 144 aa, Triticum aestivum
  unsure (1)..(144): unsure at all Xaa locations
  Clone ID: PAT_TA_97478.pep
FCFSXLXMXVXQHVXXQTCKDQDYTLLFFYFLVTKYFSFVGRVGGGRALPPQCLVKNCLRAFLITIFRRAIAKVFGIRKTTPTIAIIAFWNYSRWSTQSIWXXXLXCYLCLQYSHIEHEQRSKREEVSRVALVGAHVPCTSPCT

SEQ ID NO: 203061 - protein, 130 aa, Triticum aestivum
  Clone ID: PAT_TA_97479.pep
ATFAGCFMSLYIWYIHKYNSLDGRPDILQSLYSALQPSTTTLEDRRYYDGRLSDQQDGITSIPKGKNIHYLSEEVLRLQRMFGANTKKNWMFGKNPQGLILVNPLTWTKETFESPAGDESKTQKLQLALI

SEQ ID NO: 203062 - protein, 140 aa, Triticum aestivum
  unsure (1)..(140): unsure at all Xaa locations
  Clone ID: PAT_TA_97480.pep
LATSIPTFCHVILMSIFRHYIQNMMHYVEVTNGQKNSGYDTCLLLFTLCRSCIRQNKNKNICQFFHVLVQQAGXCSRQELXVHHIXYICCRXXNKXAXRYPIPPXHXFPKTLGFXQSSVRXSXLAAFXQWGWQFPLXTGX

SEQ ID NO: 203063 - protein, 91 aa, Triticum aestivum
  unsure (1)..(91): unsure at all Xaa locations
  Clone ID: PAT_TA_97481.pep
SRSLLASAFPSLVTSLLRSEMRQEQKQQESGVICAMVIRCMLNLFSVASYFCLILSSSNKQVGGNGFNQGRXGIYSGDIKREGDXRXASRP

SEQ ID NO: 203064 - protein, 137 aa, Triticum aestivum
  unsure (1)..(137): unsure at all Xaa locations
  Clone ID: PAT_TA_97482.pep
MKTFLVFALLAVAATSAIAQMETRCIPGLERPWQQXPLPPQQTFPQQPLFSQQQQLFPQQPSFSQQQPXFWXATTTFSQQQPILPQQATIFRQQASKXXSTANNPPFSXGKXXAKFXPPXTIQPFFXRTTQATKPGW

SEQ ID NO: 203065 - protein, 106 aa, Triticum aestivum
  unsure (1)..(106): unsure at all Xaa locations
  Clone ID: PAT_TA_97483.pep
FGXQEWXKTHPPXYTNLXIGLQSTXKXCDILAXIHXYXNMXLVPVRXSFLNLIRXRKSGTRSDADSSMHFIYNFWKYQTKEASVHTFLEHHANPASLXSFMVASSL

SEQ ID NO: 203066 - protein, 110 aa, Triticum aestivum
  unsure (1)..(110): unsure at all Xaa locations
  Clone ID: PAT_TA_97484.pep
PIARRRSGXARNRXEPRCCRRRLRRSPLSVADFVQDPALHTMLPCQGIXNXNGXXSXIWDSLPQTAYGYPEXINWVSSKQRRFLXLRGXRAXRXDKENPPFXXLFFXFPV

SEQ ID NO: 203067 - protein, 73 aa, Triticum aestivum
  unsure (1)..(73): unsure at all Xaa locations
  Clone ID: PAT_TA_97485.pep
LSLSLSLSLSLSLSLXLSLSXSLXXEXYKTRSXXIXXKRXXWEXSDXIEIXXIXADTQFNQMCIIANRSXXGG

SEQ ID NO: 203068 - protein, 104 aa, Triticum aestivum
  unsure (1)..(104): unsure at all Xaa locations
  Clone ID: PAT_TA_97486.pep
MELATRDLAALGAADLVRVSAAXPRAAPRTFALLXTACLVFPALLXRCWGXSLFNQPNPPXESGXXNKXATXGNXXPXXXXQXLQLNXLFNFSXXXNGGGVFNG

SEQ ID NO: 203069 - protein, 94 aa, Triticum aestivum
  unsure (1)..(94): unsure at all Xaa locations
  Clone ID: PAT_TA_97487.pep
MSCCGGNCXCXAXCKCXNXCGGCKMFPDVEATAGAAXMVMPTASHKGEAPAGFEXVGRXKTXAATXTXCKVRXRALRVAPCQNSRAPQEGRGRN

SEQ ID NO: 203070 - protein, 131 aa, Triticum aestivum
  unsure (1)..(131): unsure at all Xaa locations
  Clone ID: PAT_TA_97488.pep
XXNXAGGGKXNSRRKKRXGGEXGATLSGXPMFKPEILELTIIVXPEXGXEXEERQVXGXFXSWXMMPSAXXSPPFPPPGTAGGGVASEGPPHYALATAHSSAPLNWSRSPACHLLRVTGARGVGKVLLPLA

SEQ ID NO: 203071 - protein, 183 aa, Triticum aestivum
  unsure (1)..(183): unsure at all Xaa locations
  Clone ID: PAT_TA_97489.pep
MSPQTETKAGVGFKAGVKDYKLTYYTPXEYETKDTDILAAFXVSPQPGVPPEEAGAAVAAESSTGTWTTVWTDGLTXLDRYKGRCYHIEPVAGENSQWICYVAYPLNLFEEGSVTNKFTSNVXXVFGFKXLRALRLXDYEIPXLXXKNFQGPPQXXQIXXXKLNNMXPXFGKXIKQXWXIPMS

SEQ ID NO: 203072 - protein, 125 aa, Triticum aestivum
  unsure (1)..(125): unsure at all Xaa locations
  Clone ID: PAT_TA_97490.pep
LRDPPLRSPFVXXEPXLXRGGGLLSXKXXLCSRXSPESTLDXSGRIEXVLCPLSTDWIRPXRPLPNLPWSLFGAEIVGDGDEHLGVLVEQLGRASWSYAIFFSALVLLIAXEAAXRWTEALTXDC

SEQ ID NO: 203073 - protein, 164 aa, Triticum aestivum
  unsure (1)..(164): unsure at all Xaa locations
  Clone ID: PAT_TA_97491.pep
MGKEKTHINIVVIGHVDSGKSTTTGHLIYKLGGIDKRVIERFEKEAAEMNKRSFKYAWVLDKLKAERERGINIDIALWKFETTKXYYCTVIDAPGHRDFNKNMITGNSXADCAVLXNDSTTGGFXAGISXDGXTREHPLLAFTPXVKQXMXCWWNKMXANTXKY

SEQ ID NO: 203074 - protein, 76 aa, Triticum aestivum
  unsure (1)..(76): unsure at all Xaa locations
  Clone ID: PAT_TA_97492.pep
ASKLTLGVVGSGPWXYPGNSSXTMXPLLRPXQGGXPXGAQPXSGXXREGXXXXPGXPNSXXGNLKSLTPAQKGXNR

SEQ ID NO: 203075 - protein, 134 aa, Triticum aestivum
  unsure (1)..(134): unsure at all Xaa locations
  Clone ID: PAT_TA_97493.pep
SLLTVAASSQSSPSSPRHHPPRKGGCLAAAATADAAPXASXATAAXGARCSPTLRPPPAPPPWSCPPPPTRGAPAGSRRPAGRPAAATAPPASXARPAXAPAAXATEPAXXEAGRRGEHXDEEDNWXXNQHHHH

SEQ ID NO: 203076 - protein, 96 aa, Triticum aestivum
  unsure (1)..(96): unsure at all Xaa locations
  Clone ID: PAT_TA_97494.pep
MKTFLIFALLAIAATSAIAQMETSRVPGLXKPWQQQPLPPQQQPPCSQQQQPFPQXQQQPIIILQQSPFSASNNNQVLAXTXTKXLXLEQPTISTT

SEQ ID NO: 203077 - protein, 164 aa, Triticum aestivum
  unsure (1)..(164): unsure at all Xaa locations
  Clone ID: PAT_TA_97495.pep
MKTFLVFALLAVAATSAIAQMETRCIPGLERPWQQQPLPPQQTFPQQPLFSQQQQLFPQQPSFSQQQPPFWXQQQPPFSQXQPILPQXPPFSQQXQLVLTQQAPFSQQQQPVLPPQQXPFPQQQQHQQVGXQQIPXVVXPXILEQXNPRKXFLXXXVPPWGNAQ

SEQ ID NO: 203078 - protein, 54 aa, Triticum aestivum
  Clone ID: PAT_TA_97496.pep
LDSQNIFLYSKVLSSTIRDIFFFAGLHLYQLYACVVVPETLMQSSNNLYVGFKQ

SEQ ID NO: 203079 - protein, 96 aa, Triticum aestivum
  unsure (1)..(96): unsure at all Xaa locations
  Clone ID: PAT_TA_97497.pep
VVSPXXYPDSXDGPISXXWGLTFFXXDPGPGPLSPRQXSVQDRRTLPAVGLFFRGIADGPCQAADMVSFISSHILHEICPNPVKTLLXSPFAFRSC

SEQ ID NO: 203080 - protein, 64 aa, Triticum aestivum
  unsure (1)..(64): unsure at all Xaa locations
  Clone ID: PAT_TA_97498.pep
QXXPFXXXQXQXXSXXFPSQQPXLQLQXFPQPXLPYSQPQPFRPXQPYPXSXPXYSQPQHPILQ

SEQ ID NO: 203081 - protein, 92 aa, Triticum aestivum
  unsure (1)..(92): unsure at all Xaa locations
  Clone ID: PAT_TA_97499.pep
FKHRRNCNFPRLTHLLYGASQGSHSSLPSGHRCDRHGHVIMSWCTRGVQPDPAVHRQCVATSXWQSWGTRTPRRAVSVALPLKASSTIHAAV

SEQ ID NO: 203082 - protein, 144 aa, Triticum aestivum
  unsure (1)..(144): unsure at all Xaa locations
  Clone ID: PAT_TA_97500.pep
MSRGGSAGGGQSSLGYLFGDGEPAKPAAAPAAKPAPAEKPAPAAADVAKQIPAGIPGSRANNYYRADGQNTGNFLTDRPSTKVXAAPGGGSSLGLLCLGKGDVNDACFNETRMKLGVGNPMLGEKIGKWFGFEALTTWRNVRVH

SEQ ID NO: 203083 - protein, 130 aa, Triticum aestivum
  unsure (1)..(130): unsure at all Xaa locations
  Clone ID: PAT_TA_97501.pep
MAPKAEKKPAPEKTPAGKKPAAEKRPAAGKTASKEGGEKKGXKKAKNSVETYXIYIFXVLKQVHPDIGISSKAMSIMISFIXDIFXKLXGXSXXXWARYNXKPTITSRGDXXXVRXRSSPGEAXXRSPFG

SEQ ID NO: 203084 - protein, 120 aa, Triticum aestivum
  unsure (1)..(120): unsure at all Xaa locations
  Clone ID: PAT_TA_97502.pep
IPSPFPSPXISPPVTTPSPNPIRRRXPLTPXWXLPPAXPCSSSSPPPPWPSSRCPRXXPPXPAAARRRXXSPXPPSPAPTXXPPXPSXLTXPVVVPPAVRPPRLRHAKGRTQDARPFRGE

SEQ ID NO: 203085 - protein, 68 aa, Triticum aestivum
  unsure (1)..(68): unsure at all Xaa locations
  Clone ID: PAT_TA_97503.pep
YKXXNVTISVRXHEEQRXMXLXYXCRVXCFGXDHTXXRLTTLIADGEVXTAQDAMXTHCVXSXNRERE

SEQ ID NO: 203086 - protein, 142 aa, Triticum aestivum
  unsure (1)..(142): unsure at all Xaa locations
  Clone ID: PAT_TA_97504.pep
MARTKQTARKSTGGKAPRKQLATKAARKSAPATGGVKKPHRFRPGIVALREIRKYQKSTELLIRKLPFXRLVREIAQDXKNELRFQXSSAVSALKEXXKAXSXGWFKENNSXXNQXKGRXTIXPKXIQXPPPNLGKXAKLSP

SEQ ID NO: 203087 - protein, 130 aa, Triticum aestivum
  unsure (1)..(130): unsure at all Xaa locations
  Clone ID: PAT_TA_97505.pep
MAPKVAVAKKGDAKAQAAKVAKAVKSGSIKKTAKKIRTSVTFHRPKTLSKARDPKYPRISTPGRNXLDXYQXILKVPRLTTEVXNEXRSKDNNNTXVFIVXLKGRQRRKFKGAVKEKCSNIQGQRKGNNP

SEQ ID NO: 203088 - protein, 149 aa, Triticum aestivum
  unsure (1)..(149): unsure at all Xaa locations
  Clone ID: PAT_TA_97506.pep
ESGVIAQYVDEAWPAASAAPLLPEDPYQRAMHRFWTAFVDDRFWPALDGASLAPTPEARAEAAAEARAALRHLEEAFAALSNGGAFFSGAAPGLLDIALGCFLPALKACERLNXALLLEXKAPTPLLKKWNRKVPPGSNQSELLAGKRT

SEQ ID NO: 203089 - protein, 119 aa, Triticum aestivum
  unsure (1)..(119): unsure at all Xaa locations
  Clone ID: PAT_TA_97507.pep
SEPNHTRQRPAMAITATTDGAAAPTHAANGTGNQAGRDHVVVFPFMAKGHTLPLLHFATALTEQQKNSASPWSSRPPNLAFRPQAPPXVRLPSPVPXVPVRWPPVTIGVGFKGNLXXPG

SEQ ID NO: 203090 - protein, 106 aa, Triticum aestivum
  unsure (1)..(106): unsure at all Xaa locations
  Clone ID: PAT_TA_97508.pep
SSCPPPPPQPLPRPRGLRPPPPRXQXSXGXPGLPAPASGTPRPRRNXERGGHRAPPVMXRRGPSSRALXPGPPASRTPXGPPPSPPAAPTRTSWRPGFPHRASGLK

SEQ ID NO: 203091 - protein, 81 aa, Triticum aestivum
  unsure (1)..(81): unsure at all Xaa locations
  Clone ID: PAT_TA_97509.pep
QPQPQQFLQQAPPATTPPXTSISPTAIAPTTTHPPXIXXPPAXTXNPPTSTXPPAPKXIPPTXISPPSNSRQPGIXTKQIG

SEQ ID NO: 203092 - protein, 152 aa, Triticum aestivum
  unsure (1)..(152): unsure at all Xaa locations
  Clone ID: PAT_TA_97510.pep
MARTXXTARKSTGGKAPRKQLXTXAARKSAPATGGVKKPHRFRPGTVXALREIRXYQXKSTELLIRKLPFQAPXVGKIAQDFKTDLRFQSSXAVSALQXXAEGYLVXLFEGNNLXCAIXAKRVTNMPKDIQARXPXRXEARLSFSPPLTNLG

SEQ ID NO: 203093 - protein, 116 aa, Triticum aestivum
  Clone ID: PAT_TA_97511.pep
MSDTDEHHFESKADSGASKTYPQQAGAIRKGGHIVIKARPCKVVEVSTSKTGKHGHAKCHFVAIDIFNGKRSFEDIVPSSQNCDVPQCLTGQRFTSIDINWMKGYQPLEWQLKGGP

SEQ ID NO: 203094 - protein, 80 aa, Triticum aestivum
  unsure (1)..(80): unsure at all Xaa locations
  Clone ID: PAT_TA_97512.pep
MAMAVAEARLRQDKVKKFEDFVDRRLKPDLVNAIAQXRDNLFQXSKKTFLXLKXXIKTLEKNGXTKHIHSNKRKGNPDKG

SEQ ID NO: 203095 - protein, 165 aa, Triticum aestivum
  unsure (1)..(165): unsure at all Xaa locations
  Clone ID: PAT_TA_97513.pep
RDAVLVGMKKTLVFYTGRAPSGGKTPWVMHEYRLEGELPHRLPRTAKDDWAVCRVFNKDLAARNAPQMAPAADGGMEDPLAFLDDLLIDTDLFDDADLPMLMDSPSGADDFAGASSSTCXSAALPLEPDAELPVLHPQQQQSPNYFFMPXXGNGNLGGRRVLNLT

SEQ ID NO: 203096 - protein, 169 aa, Triticum aestivum
  unsure (1)..(169): unsure at all Xaa locations
  Clone ID: PAT_TA_97514.pep
RHRXDDIFDFPGHATLAGTSSMIPRSTTSPMRSSSLRGAENRFFFQFGHDRSLPQPTSTGGQLGAHRCAVSAARPMQLGLRRQAVWHLAWCNSPXFXISSCFAVWLPCRFNSTXKKQHAVGRTVRSSAPNESLXVXGCSNVLPIXQVFXFFKFCLFCPGWXPFSSKGCF

SEQ ID NO: 203097 - protein, 99 aa, Triticum aestivum
  unsure (1)..(99): unsure at all Xaa locations
  Clone ID: PAT_TA_97515.pep
XSPVRVNVTGAVDGLAGIGRGNXXXXGAAWXPTGYVFSRVPXGLGSRNXQQSFAXDXSXPTVHXNXDIGYGLLNLSHLQCFSSVRFLRQCKIYGACCFQ

SEQ ID NO: 203098 - protein, 124 aa, Triticum aestivum
  unsure (1)..(124): unsure at all Xaa locations
  Clone ID: PAT_TA_97516.pep
ARLPTKILWMRRMRVLRRLLRKYREAKKIDKHMYHDMYLKVKGNMFKNKRVLMESIHKSKAEKAREKTLSDQFEAKRAKSKASRERKXXRGEERLAQGPRDHAPAPAAAAXXPAAAAPXKXKAK

SEQ ID NO: 203099 - protein, 153 aa, Triticum aestivum
  unsure (1)..(153): unsure at all Xaa locations
  Clone ID: PAT_TA_97517.pep
MAPKVAVAKKGDAKAQAAKVAKAVKSGSIXKTAKKIRTSVTFHRPKTLSKARDPKYPRISTPGRNKLDQYQILKYPLTTESAMKKIEDNNTLVFIVDLKADKKKIKAAVKKMYDIQAKKVNTLIRXPDGQEKGXYVKLTPDLWLLVGQQDGSY

SEQ ID NO: 203100 - protein, 148 aa, Triticum aestivum
  unsure (1)..(148): unsure at all Xaa locations
  Clone ID: PAT_TA_97518.pep
ATLSSXSRXAAXSAXTXANGYHQRRRGDHRRRPCRHRQAAGPRSAPAEDEEREGEVQLLQGRQGGDPGRAAVRGAGASLLAAAGAVTASAGPGARSGXNERDVXGRXPGLXLGGLSNNXAGGXDSPGAXFGPQSGXAXXNRSXXXPGP

SEQ ID NO: 203101 - protein, 149 aa, Triticum aestivum
  unsure (1)..(149): unsure at all Xaa locations
  Clone ID: PAT_TA_97519.pep
MKTFLIFALLAIVATSAIAQMENSHIPGLERPSQQQPLPPQQTLSHHQQQQHLPQKQFPQPQXIPQXXXXPKQPXQFPQAXIPPNXQQFSPTXKEFPPKQXFPGKQQVSXQTXXLPXNXQXXPKQXKFPPXKEIFPPTXKKXPPQEKGF

SEQ ID NO: 203102 - protein, 148 aa, Triticum aestivum
  unsure (1)..(148): unsure at all Xaa locations
  Clone ID: PAT_TA_97520.pep
SIPKSKANPKRIRDRSPNREQGTAVREEMADANQGGDPAPLPIRTCPESQRKHLVSASFSSDPLNISFFAGQIQPSRRGCNFYRWQHGYADHLASLGPAAPQLAQIQPPEEQGGQXLGVQDIQLPASNKXGGXXAPPXGKXXNSSIXA

SEQ ID NO: 203103 - protein, 148 aa, Triticum aestivum
  unsure (1)..(148): unsure at all Xaa locations
  Clone ID: PAT_TA_97521.pep
QQPFPQQPQRPQQSFPQQPEQIIPQQPQQPFPLQPQQPFPQQPEQIISQQSQQPFSLQPQQPFSQPQQPLSQQPGTNNSPSNPNXPCPLQPHQTIPPSNQEQIIRQQPXQQPFLLQSQXXFHQATKNKIISQPPNHSSLQPQQIFPRP

SEQ ID NO: 203104 - protein, 117 aa, Triticum aestivum
  unsure (1)..(117): unsure at all Xaa locations
  Clone ID: PAT_TA_97522.pep
METAEAGEKKMIMLKSSDGMEFEVEEAVAMESQTIRHLIEDDCVDKGILIPNINSKILSKVIEYCNKHVPTMPGVVATRATGAAASDIVAPGALXEDLKDLGXQEFXXGQPVTAEQS

SEQ ID NO: 203105 - protein, 118 aa, Triticum aestivum
  unsure (1)..(118): unsure at all Xaa locations
  Clone ID: PAT_TA_97523.pep
MARGLKKHLKRLNAPSHWMLDKLGGAFAPKPSSGPHKARECLPLILILRNRLKYALTYREVQSILMQRHIMVDGKVRTDKTYPAGFMDIISIXPKTGENXRLLYDTKGXRFRLXSVXD

SEQ ID NO: 203106 - protein, 131 aa, Triticum aestivum
  unsure (1)..(131): unsure at all Xaa locations
  Clone ID: PAT_TA_97524.pep
MARGLKKHLKRLNAPSHWMLDKLGGAFAPKPSSGPHKARECLPLILILRNRLKYALTYREVQSILMQXRHIMVDGKVRTDKTYPAGFMDIISNSQRXGEKLQGXCYDTKGVXFRLHSWSGPIKGSKLWQQG

SEQ ID NO: 203107 - protein, 135 aa, Triticum aestivum
  unsure (1)..(135): unsure at all Xaa locations
  Clone ID: PAT_TA_97525.pep
QQQPFPQHXQPLLLQQPPFSQQRPPFSQQQQQPVLPXQPPFSQQQQQQPILPQQPPFSQHQXPVLPQXQIPYVQPSILQQLNPCKVFLQQHCIPVAMPQXSLAXXQXLXQXSCHVIAIVAKREIPKRLSATPVAS

SEQ ID NO: 203108 - protein, 57 aa, Triticum aestivum
  unsure (1)..(57): unsure at all Xaa locations
  Clone ID: PAT_TA_97526.pep
ESXRAHQRAPSLPPXATGGATVAVAGIRIEALHERRXHLPXAGEPERGGVEVGRLGA

SEQ ID NO: 203109 - protein, 136 aa, Triticum aestivum
  unsure (1)..(136): unsure at all Xaa locations
  Clone ID: PAT_TA_97527.pep
MGPLKSPFLSPSGPRPTSPASRRPPPPGHRHHRLPPPPPLPPPPPLPLPPPPPLPSSSLPLPPPCPPSRCPPXPPSPPLPPPPPLTPVTSHLSRLSSSPPLPPPRTLRKRRLTPPVGGSLPRGFRPQTGWAPPCAP

SEQ ID NO: 203110 - protein, 88 aa, Triticum aestivum
  Clone ID: PAT_TA_97528.pep
FLGSIFFLEHNKMLSVFAFLGNIAANMSLCDVPSFVGVGITRYSKELEAFHALCCAASADGLRHPHICTPGQPITLNARTCINHGMLR

SEQ ID NO: 203111 - protein, 142 aa, Triticum aestivum
  unsure (1)..(142): unsure at all Xaa locations
  Clone ID: PAT_TA_97529.pep
MKKFLVLALIVVAATTTAAEPFTAFRTAWEPHHPSSPEQQPTPQPQEQPVPHQKLNPCRDALLQQCSPVADMSFLRSQVVQHSSCLVMXKQCCQATKSXPQSSQRCXXIHNVVXAIVLQXATXNWVQRVSTQTSRKQTNKGN

SEQ ID NO: 203112 - protein, 146 aa, Triticum aestivum
  unsure (1)..(146): unsure at all Xaa locations
  Clone ID: PAT_TA_97530.pep
GPXVPTAGXPFXLPESPNPCRARISSCRRLNLELKSNSAAAILRDGFVTSGGFTGGKPLAVYPRCPRAGPGNVLVGARPRPFHQRAGAGTRAPRRPGDLLLLHWGMEERLSKSASASWRSAGRPSPSPPANQRQPASSPLSLSGVR

SEQ ID NO: 203113 - protein, 69 aa, Triticum aestivum
  unsure (1)..(69): unsure at all Xaa locations
  Clone ID: PAT_TA_97531.pep
IMLVQSRSTYNHGCEHRVDDHMADSRGDLINEFMEDQLGDDYVFESKMVNPKAHQXNDEHIKGVKGQCL

SEQ ID NO: 203114 - protein, 101 aa, Triticum aestivum
  unsure (1)..(101): unsure at all Xaa locations
  Clone ID: PAT_TA_97532.pep
MSDTDEHHFESKADSGASKTYPQQAGAIRKGGHIVIKARPCKVVEVSTSKTGKXHGHAKCHFVAIGHPLNGKRKLWRDXVPSSQQLLNVPQCTGQGLIKLD

SEQ ID NO: 203115 - protein, 120 aa, Triticum aestivum
  unsure (1)..(120): unsure at all Xaa locations
  Clone ID: PAT_TA_97533.pep
KAGIAPXXVHXXVVQSFLXXSRARRRTCXPSRPFERCLVLSXHGRTATAGVLHPRASMVPLLLSXARSNSATVGVTDQDQEDLRSSGKKLWQESVAXITNLSRPDRDLGDPSRQEGERGR

SEQ ID NO: 203116 - protein, 124 aa, Triticum aestivum
  unsure (1)..(124): unsure at all Xaa locations
  Clone ID: PAT_TA_97534.pep
MKTFLVFALLAVAATSAIAQMETRCIPGLERPWQQXPLPPHQTFPQHPLXSQQQQLFPQQPSFSQQQPPFXXQQQPPFFSSSXQXLPTAXHHFXQQTTXXFYXQQPSNFSTGPAQFLSNQLLIN

SEQ ID NO: 203117 - protein, 95 aa, Triticum aestivum
  unsure (1)..(95): unsure at all Xaa locations
  Clone ID: PAT_TA_97535.pep
MASKWVRPEVYPLFAATGVAIGICAFSLLRNITGNPXEXRVNKMGRAAGVLENXEEXGRRXAEHGPQEPMCRDXTPXDXCPGNXTCXFXKPXDGF

SEQ ID NO: 203118 - protein, 43 aa, Triticum aestivum
  unsure (1)..(43): unsure at all Xaa locations
  Clone ID: PAT_TA_97536.pep
PISNSYGGSCKIHLLSXSYQFIRCSDSHRCFXEGILKLTLYLS

SEQ ID NO: 203119 - protein, 105 aa, Triticum aestivum
  unsure (1)..(105): unsure at all Xaa locations
  Clone ID: PAT_TA_97537.pep
LESAALGARWEFGLRREVCGGCRRQQLSPAVLCSPWWWAAAPSCILVALLLNAQSLWFSVLLCSKXRSXXTGRVCXIPTMWMHPVXXQPRFXGXXVYLSDXFXXP

SEQ ID NO: 203120 - protein, 108 aa, Triticum aestivum
  unsure (1)..(108): unsure at all Xaa locations
  Clone ID: PAT_TA_97538.pep
MKTFLVFALLAVAATSAIAQMETRCIPGLERPWQQQPLPPQQTFPQQPLFSXQQQLFPQQPSFSQXQXPPFWQQXSPFSQXQPKFYHKXQQFFGSXQQLVLPXTQFFT

SEQ ID NO: 203121 - protein, 134 aa, Triticum aestivum
  unsure (1)..(134): unsure at all Xaa locations
  Clone ID: PAT_TA_97539.pep
QPQQTFPXQPQLPFPQXPQQPFPQPQQPQQQFPQSQQPQQPFPQPQQQFLQPQXQPQXSFPQQQQPLIQLSLQQQXMNPCXNFLLQQXCNPVSXVSSLISXILPRSDCXVMQQQLLPRXGHXIPQAXPXXXSHP

SEQ ID NO: 203122 - protein, 153 aa, Triticum aestivum
  unsure (1)..(153): unsure at all Xaa locations
  Clone ID: PAT_TA_97540.pep
PASSVLTASSQSLASFPRRHPPXKGGCLAAAXTAGAAXXASAATAAAGAICSPTWXPPPAPPPWSCPPPPTXGAPAGSXRPGRPXAATAXXASAAPRAAAXXAAAAXXPAXXRXAXHXXSXMIKEDXXSXHQSPPFXXXSSXSINSSCSAPAA

SEQ ID NO: 203123 - protein, 101 aa, Triticum aestivum
  unsure (1)..(101): unsure at all Xaa locations
  Clone ID: PAT_TA_97541.pep
KDVMTKNVSIYKAQASALEAHAAPNCKVLVVANPANTNALILKEFAPSIPEKNISCLTXRLDHNRALXGQISERLGVQXVSDVKECYXSGGXHSPSQVTLP

SEQ ID NO: 203124 - protein, 126 aa, Triticum aestivum
  unsure (1)..(126): unsure at all Xaa locations
  Clone ID: PAT_TA_97542.pep
MDAGKLKKVAGKKFGGPRKKSVTRSVKAGLQFPVGRIGRFLKKGRYAQRVGSGAPVYLAAVLEYLAAEVLELAGNAAKDNKKSRIXPRHLLLXIXNXQEXGRLLSGXHPXAHVGXHPPKSVLVSPR

SEQ ID NO: 203125 - protein, 72 aa, Triticum aestivum
  unsure (1)..(72): unsure at all Xaa locations
  Clone ID: PAT_TA_97543.pep
LTPTISSSSAVLRLPRIARRRPLSCSASPLAVFATMEXPPEGYRNXVGICLAGPHPHXXSSPRPRIXIPKVG

SEQ ID NO: 203126 - protein, 93 aa, Triticum aestivum
  unsure (1)..(93): unsure at all Xaa locations
  Clone ID: PAT_TA_97544.pep
MXXFLIFALLAIAATSAIAQMXTXRVPGLXKPWQQQXLXPQXXPPCSQQXXPFPQQXXPIIXXQQVTXFSQQQQPSGRKAFINHHFANHSSFT

SEQ ID NO: 203127 - protein, 74 aa, Triticum aestivum
  unsure (1)..(74): unsure at all Xaa locations
  Clone ID: PAT_TA_97545.pep
NFSSTDMDIQNLVSFCRVLIYLELASFEGINHLTVQAPKLKLLYVXGMLKDINFDAPNLEVAALFLDQKAITSF

SEQ ID NO: 203128 - protein, 80 aa, Triticum aestivum
  Clone ID: PAT_TA_97546.pep
RYRTEMSPTVLPTLASKPGNLSSLASARILPGTGVHMHCRIANLLFKLTQDRKRESRDVITLIALTNSSHTWLKGKRREM

SEQ ID NO: 203129 - protein, 114 aa, Triticum aestivum
  unsure (1)..(114): unsure at all Xaa locations
  Clone ID: PAT_TA_97547.pep
SYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKXPPGCEESGKG

SEQ ID NO: 203130 - protein, 159 aa, Triticum aestivum
  unsure (1)..(159): unsure at all Xaa locations
  Clone ID: PAT_TA_97548.pep
XKKXLGXXTEVFSLFLXPPFPCSXXAPXPXFLLXTRCKSIRXPPRKKASGXQLLASKFFEASKGSGTADKRGLAVIASKLNRAAAKSMVKRIHALRASEKDKVIQVGLCWNQETYKLKLTATMARGRQWLRWFCAAYCVAAFLIFIPLICTELTKGEIN

SEQ ID NO: 203131 - protein, 126 aa, Triticum aestivum
  unsure (1)..(126): unsure at all Xaa locations
  Clone ID: PAT_TA_97549.pep
AXNXSLPLXVXPLAKLGTXXXFFSDISFLGLXHHHCPPSTXLSSLISESDGINELXEYVVIKLLVHKIIILVDPSFAGAAHGVTIVLGAKRTTWRGLGAVVAALRVGDTNEIRVGTTKELGKGRHG

SEQ ID NO: 203132 - protein, 132 aa, Triticum aestivum
  unsure (1)..(132): unsure at all Xaa locations
  Clone ID: PAT_TA_97550.pep
MAGATMALSSPAMAGTPVKASRAAPFGEGRITMRKTAGKPKVAASSSPWYGSDRVLYLGPLSGDPPSYLTGEXFPGDYGWDTAGLSADPETFXAKNRELEVXQLPAGPMXRRGXGCVFPGXGPPAKGVQFXE

SEQ ID NO: 203133 - protein, 130 aa, Triticum aestivum
  unsure (1)..(130): unsure at all Xaa locations
  Clone ID: PAT_TA_97551.pep
MARGLKKHLKRLNAPSHWMLDKLGGAFAPKPSSGPHKARECLPLILILRNRLKYALTYREVQVXILCKRHIMVDGKVRTDKDLPXAGFMDIISIPKDXRNYRLLYDNKGAASXLHSXREXRXLSLKLCXG

SEQ ID NO: 203134 - protein, 135 aa, Triticum aestivum
  unsure (1)..(135): unsure at all Xaa locations
  Clone ID: PAT_TA_97552.pep
MASQDGGWGDGGDSLFEGMVLFAPAAAEAEAPEAPKPPTPPADAAATSASDAESXAASQPLDEDLFSDLTLLAPQTPLDQDQHPQPQAQXSEQPPRLAXSRVXAPPGGAALSRQXSSSFAXGKKNRGXXAXXYGA

SEQ ID NO: 203135 - protein, 65 aa, Triticum aestivum
  unsure (1)..(65): unsure at all Xaa locations
  Clone ID: PAT_TA_97553.pep
MSTPADGXAYWLRWQVLVCGAVIAVPXALXAALLPXLXRSAVPLRXTXLWXPCXXXRXXXGWXLG

SEQ ID NO: 203136 - protein, 114 aa, Triticum aestivum
  unsure (1)..(114): unsure at all Xaa locations
  Clone ID: PAT_TA_97554.pep
CTRIPPTPTVSPPPPPPQLDEKKKRERRTRREGSRSVXGEREFLKSESEQAGALGXGVTIQFFPXTFXECANGSQRVGKSLTXXSSLMYESXPRXQHXKXXQPAGGGQXXXWLA

SEQ ID NO: 203137 - protein, 83 aa, Triticum aestivum
  unsure (1)..(83): unsure at all Xaa locations
  Clone ID: PAT_TA_97555.pep
MDQRESQAGDDRSGERDQISGDFISTLPDAILCTIISLLPTKDGXRXTPAISPRWGYLWRSAPLNPRDSPASQPLHRPSKLCG

SEQ ID NO: 203138 - protein, 152 aa, Triticum aestivum
  unsure (1)..(152): unsure at all Xaa locations
  Clone ID: PAT_TA_97556.pep
RALRLDTGNFSWGSEAVTRKTRLLDVVYNSSNNELVRTQTLVKNAIVQVDAAPFKQWYLTHYGVEIGRKKKAAAAAKKDAAEGQESEVAAAAXEEAKKSNNVXRKLEKRQQGRTLDSHIEEXFNGXXXLLACISSRPGQVWEKLMVHPGRRL

SEQ ID NO: 203139 - protein, 108 aa, Triticum aestivum
  unsure (1)..(108): unsure at all Xaa locations
  Clone ID: PAT_TA_97557.pep
TVVHLYAMYRRSRQWNSAHFYYCIYKLKSEQSTVCLLIRQITHXTFSYSSPAYFQFTTFQMLGXVVRASTFLGTXXVGNAMLPKTIKXPKQKDYKGLDPFWGNKRGGP

SEQ ID NO: 203140 - protein, 79 aa, Triticum aestivum
  unsure (1)..(79): unsure at all Xaa locations
  Clone ID: PAT_TA_97558.pep
STPILINPSPPPPPQIAPPTDRSDGXLHRRVQGRGRPRRXVGRRPLRRXPRRRSRXRAPXXPXAXAVSVSRXIASSLPG

SEQ ID NO: 203141 - protein, 82 aa, Triticum aestivum
  Clone ID: PAT_TA_97559.pep
HQDGPGIWCLTVQLQGTSALDNVSWEQIINKKQNSADHGSHTLSYKNTCIMGIAVAKLIYCECDLLPKATISFCSSSALINC

SEQ ID NO: 203142 - protein, 99 aa, Triticum aestivum
  unsure (1)..(99): unsure at all Xaa locations
  Clone ID: PAT_TA_97560.pep
PFTLFFKGATFDKKAVXSPHXEAXTSKTLTAKLEXDDLDVFKKNVESATKYLLSKLKDLQFFVGESMHDDGGVVFAYYKEGAADPTFLYFAHGLKEVKC

SEQ ID NO: 203143 - protein, 113 aa, Triticum aestivum
  Clone ID: PAT_TA_97561.pep
STEVAPTDGVLGLGSGSISLLSQLKQHGITKNVVGHCLSMRGGGFLFFGDNLVPYSRATWVPMARSAFRRALFLMVFFATQYIVERTSAHCLLVMMLKNRCAFHFLNTNVNID

SEQ ID NO: 203144 - protein, 116 aa, Triticum aestivum
  Clone ID: PAT_TA_97562.pep
MASIAGSAVSFAKPVKAINTNSLSFSGPRRGNAFLRLQPVPMRFAVCCSAKQDTVEKVCEIVKKQLAVPEGTEVCGTTKFSDLGADSLDTVEIVMGLEEEFQISVEETNAQAIANS

SEQ ID NO: 203145 - protein, 137 aa, Triticum aestivum
  unsure (1)..(137): unsure at all Xaa locations
  Clone ID: PAT_TA_97563.pep
LLLKFHRNSTTALHPSLPKSSPKTPPAPAAPPRWGAGTRARRRRRPPRRSRRPSGRRRXPXXTRPTXAXPTTGPTSSLSPXLAARXRRPRPLPXQVLPAASXXRXFGXSSLCQITGFHLXPXMAQXYXXPSXXHYST

SEQ ID NO: 203146 - protein, 137 aa, Triticum aestivum
  unsure (1)..(137): unsure at all Xaa locations
  Clone ID: PAT_TA_97564.pep
GSCATPAAAATAPPAGPASLNAPPSRRRCRPPPPPPLILVPPPRXLALSTPPPPPPRRXPRGSTPNAPASPILAPPAPRLRIRCPRPPWPPRVDVTPGKRHRHEGNRPGRAPCPCSTSPASYSFACRDQEAHTSTIQ

SEQ ID NO: 203147 - protein, 141 aa, Triticum aestivum
  unsure (1)..(141): unsure at all Xaa locations
  Clone ID: PAT_TA_97565.pep
QIYFAXSRLGKXVSWHKXTXGTPSSSRAPRRSAASGFDLESGHNKCISXEIXXXSXXVDKYXXGSPKXXLXXXKNXTLFYSEXXXVMCVYICYMHYSQKIANXGXIXPFXKEWDGHGIXXCVWFPGEVXFXINXXCLKXTF

SEQ ID NO: 203148 - protein, 145 aa, Triticum aestivum
  unsure (1)..(145): unsure at all Xaa locations
  Clone ID: PAT_TA_97566.pep
QQPFPQTQQPQQPFPQQPQQPFPQTQQPQQPFPQFQQPHQPFPQPQQQFPQPQQPQQSFPQQQRPFIQPSLQQRLNPCKNILLQQCKPASLVSSLWSIIWXPQSDCQVMXQQCCQGTXHKIPQASSQVAAXXXIRCYHRCKQRQN

SEQ ID NO: 203149 - protein, 71 aa, Triticum aestivum
  unsure (1)..(71): unsure at all Xaa locations
  Clone ID: PAT_TA_97567.pep
XCSHFVRXRYYGNRFCFLFLWLLRCFSSPGCLLXAHGFSRQFKRLTYLGISSMLIFNSPKHFVAYALPRWV

SEQ ID NO: 203150 - protein, 150 aa, Triticum aestivum
  unsure (1)..(150): unsure at all Xaa locations
  Clone ID: PAT_TA_97568.pep
QQQLIPCRDVXLEKHKXNVMGSSTKFLQQXGTYQTWXQTNCVCQAKLVGKXPRGKFAGGQAIQKCLFKAIILHQQXQQQQQQQQQPLSQVSFQQPQXXYPSXQGSFQPSQQNPXAXGSVQPQQLPQFEEIRXLSLETLPANVQCXIPPYX

SEQ ID NO: 203151 - protein, 55 aa, Triticum aestivum
  Clone ID: PAT_TA_97569.pep
MRPSQKSGFVARISSRITTVIRVARTIKQTITDLMSHSQFHSSNWFILAHAWLNL

SEQ ID NO: 203152 - protein, 116 aa, Triticum aestivum
  unsure (1)..(116): unsure at all Xaa locations
  Clone ID: PAT_TA_97570.pep
MKTILASETMEIPEEVTVKVSAKMISVTGPRGTLTRNFKHLNLDFQXLQEGGRRLKVDAWFGTRKNMGAIATPSPNVXNLIKGVNKGVPATKMRFRXMLNFPXNASNPPPKRREFI

SEQ ID NO: 203153 - protein, 37 aa, Triticum aestivum
  Clone ID: PAT_TA_97571.pep
CIECHVSVICYCYSVCLICSVVLLLRWGSVRTWKENL

SEQ ID NO: 203154 - protein, 157 aa, Triticum aestivum
  unsure (1)..(157): unsure at all Xaa locations
  Clone ID: PAT_TA_97572.pep
MKTFLILALLAIVATTATTAVRVPVPQLQPQHPSQQQPQEQVPLVQQQQFLGQQQPFPPQQPYPQPQPFPSQQPYLQLQPFPQPQLPYSQPQPFRPTXTNIQQPQPHYSATTNNQFQQASKQARQANKQXTNQTTNQPKSPSKFLANKGFQLDFWLQ

SEQ ID NO: 203155 - protein, 135 aa, Triticum aestivum
  unsure (1)..(135): unsure at all Xaa locations
  Clone ID: PAT_TA_97573.pep
PFYQQPQQTFPQPQQAFPHQPQQQFPQPQQPQQQFPQPQQPQQPFPQSQQPQQPFPQPQQPQQSFPQQQQPLIQPYLQQQMNPCKNYLLQQCNPVSLVSSLVSMILPRSDCQXVMQQQCCQQLAKSSPSSGAAIQ

SEQ ID NO: 203156 - protein, 103 aa, Triticum aestivum
  Clone ID: PAT_TA_97574.pep
ARRILLPRRLKMQIFVKTLTGKTITLEVESSDTIDNVKAKIQDKEGIPPDQQRLIFAGKQLEDGRTLADYNIQMESTLHLVLRLRGGHARFFVKTLTGKDHQP

SEQ ID NO: 203157 - protein, 136 aa, Triticum aestivum
  unsure (1)..(136): unsure at all Xaa locations
  Clone ID: PAT_TA_97575.pep
MANPRVFFDMTVGGAPAGRIVMELYKDAVPRTVENFRALCTGEKGVGKSGKPLHYKGSAFHRVIPXFMCQGGDFTRGNGTGGEVHLRARKFADEKVSSHKAXQSPGIPLHGQXXGPKTNXSSSSSXTVPCKFGSTG

SEQ ID NO: 203158 - protein, 135 aa, Triticum aestivum
  unsure (1)..(135): unsure at all Xaa locations
  Clone ID: PAT_TA_97576.pep
AIEFGDEIAAAGEWHHTLEAIKWGTDYFIKAHTEPFVYWAEVGDGDTDHYCWQRPEDMTTSRKAYRVDKDNPGSDLVAETAAALAAASIVFRAXNPHYSHILLQQRNNKLVSNFGGTRLQGGKLNNEAINGVAGF

SEQ ID NO: 203159 - protein, 105 aa, Triticum aestivum
  unsure (1)..(105): unsure at all Xaa locations
  Clone ID: PAT_TA_97577.pep
SVLTASSQSLASFPRRHPPRKGGCLAAAATAGAAPAAIAATAAAGAXCSPTXRXXPGPPXPWSCPXPPKMGAPXGXKXAGXRTGWRLQPCKATPLPCSLLANLQT

SEQ ID NO: 203160 - protein, 77 aa, Triticum aestivum
  unsure (1)..(77): unsure at all Xaa locations
  Clone ID: PAT_TA_97578.pep
RSLLKLRQLWTWIEAKRKSKSDAVPLTIILAINILSPLKTLYFDKXLWQLGXNYPCGRYVLDWXPYYXDDAMFWXXE

SEQ ID NO: 203161 - protein, 128 aa, Triticum aestivum
  unsure (1)..(128): unsure at all Xaa locations
  Clone ID: PAT_TA_97579.pep
PPQXAXMXLAXTPRQRSXPXVLVXGGAALAFNXNLKRAXAXRRKWGWQPRXPRRAGGPGPGAGVNPGVPQIACSNMTGLACRYVAKAREAKXRGAXEKAXAWPGXLGGNWWGSKPRLPFXRLLSRGAA

SEQ ID NO: 203162 - protein, 125 aa, Triticum aestivum
  unsure (1)..(125): unsure at all Xaa locations
  Clone ID: PAT_TA_97580.pep
MAPKAAEKKPVEKTPAGKKPKAEKKVPASKEGGDKKGXKKKAKKSVETYKIYIFKVLKQVHPRHRHLLQXXMSIMNSFIKRHLLSPRLSPPKLRAYKQRKPQQSTFPAKIPSGSGLVPSPGSSAK

SEQ ID NO: 203163 - protein, 107 aa, Triticum aestivum
  unsure (1)..(107): unsure at all Xaa locations
  Clone ID: PAT_TA_97581.pep
MAPTVMASSATSVAPFQGLKSTAGLPVSRRSNGASLGSVSNGGRIRCMQVWPIEGIKKFETLSYLPTLSKEALLXKQVDYLXRXKWVPCLQFNXVGVHLPRQKRNLG

SEQ ID NO: 203164 - protein, 67 aa, Triticum aestivum
  unsure (1)..(67): unsure at all Xaa locations
  Clone ID: PAT_TA_97582.pep
EDGVKGRCVAGAINNYTSQLLTYGXSSLSPSSKSSSSGQYNLTXEALLFLSHFMGDIHXXLHCGFCF

SEQ ID NO: 203165 - protein, 140 aa, Triticum aestivum
  unsure (1)..(140): unsure at all Xaa locations
  Clone ID: PAT_TA_97583.pep
PQQTFPQQPLFSQQQQLFPQQPSFSQQQPPFWQQQPPFSQQQPILPQQPPFSQATTXLVLPQQPPFSQXQQQPVLPXPQQSPFPQQQQHQQLGQQQIPVVQXPXILQQLNPSKXFPXQEXNPVXXPKRPARXQMLQQKQP

SEQ ID NO: 203166 - protein, 98 aa, Triticum aestivum
  unsure (1)..(98): unsure at all Xaa locations
  Clone ID: PAT_TA_97584.pep
EEKREAKLEMAQTMASMTGLSQGVRLPGPTGRRANRFTVRASXAEAEGAXRRAVLGLMGXXXLGKRVRSSGAXRXRXGHQGXANAXAXRLDSPXQGTN

SEQ ID NO: 203167 - protein, 88 aa, Triticum aestivum
  unsure (1)..(88): unsure at all Xaa locations
  Clone ID: PAT_TA_97585.pep
MDAAVERLKTGFEKFKTEVYDKKPISSSPSXAGKAPKYMVFACADPVCXPSVTLGXLEPGEGXNNRKIAQNWPLLEKKICPGFFGQSK

SEQ ID NO: 203168 - protein, 159 aa, Triticum aestivum
  unsure (1)..(159): unsure at all Xaa locations
  Clone ID: PAT_TA_97586.pep
XNLXXLKGGRXSXFGIWNETGXXXXFRGAGGLRXLGXKREIFWSFGRXWXNERGTKXXIPGXRGXPRGRRXTRRRGGFAEASXQPLXDEEGGGAGEEEHGGADELRXAEQFGGVRAEXFHARPAALGWGAIGVGVGAVPCPMRGMGSYSGVNWTPACCF

SEQ ID NO: 203169 - protein, 91 aa, Triticum aestivum
  unsure (1)..(91): unsure at all Xaa locations
  Clone ID: PAT_TA_97587.pep
SPRAAGDRRESETLAKVSLSSVSAAAAEVSTFPLDALKTRLQLHRSTGVGGGGGGVVRVAGEARPRXGGLYRGLSPAVLRXLFYTPLAXVX

SEQ ID NO: 203170 - protein, 148 aa, Triticum aestivum
  unsure (1)..(148): unsure at all Xaa locations
  Clone ID: PAT_TA_97588.pep
WXLRGFXPXKXFXSPPXPXFXTPAGXTXSRXRIEPFPEXYXXTAGAXPPGGGGXXPXXADPHRRAPPXPXPPPGXNXRRGPXWXITTSFVRXXTLRRVXSTPGRKEDVNRINXGEEGSDGRRKRGRRERKVRVGERGVREGAWSEERR

SEQ ID NO: 203171 - protein, 77 aa, Triticum aestivum
  unsure (1)..(77): unsure at all Xaa locations
  Clone ID: PAT_TA_97589.pep
MLVYQDKLSGDELLSXSFPXXEXXENGLLWEXQXHWVXQGAIXVDIGANPSSXGGGEEXGGYQRGLFLTSVSRANCF

SEQ ID NO: 203172 - protein, 119 aa, Triticum aestivum
  unsure (1)..(119): unsure at all Xaa locations
  Clone ID: PAT_TA_97590.pep
MSGRGKGGKGLGKGGAKRHRKVLRDNIQGITKPAIRRLARRGGVKRISGLIXXENRGVLKIFLXNVIRDAVXXXTKHARRKTVTAXMDVVXPSSAKGRNLXXFRGKAFFPPLFQKVPTC

SEQ ID NO: 203173 - protein, 103 aa, Triticum aestivum
  unsure (1)..(103): unsure at all Xaa locations
  Clone ID: PAT_TA_97591.pep
SARXRXTXSFPPPSRPAAAGRGRRRPRPRSPSRGRRPRGRTRRKRGGPGRLRRRSPRRSPRPPPPRGRRRRRRSTLRPRRRRTLPRRRRRPRHRWRRPRRRRR

SEQ ID NO: 203174 - protein, 124 aa, Triticum aestivum
  unsure (1)..(124): unsure at all Xaa locations
  Clone ID: PAT_TA_97592.pep
MANPRVFFDMTVGGAPAGRIVMELYKDAVPRTVENFRALCTGEKGVGKEAAKPACNYKGXAFQRRXXPDXMWPRXXEFXKGQTXPGGESIYGXKVXXDXKFVQXATTKPGEFSPLGKSXGAKTG

SEQ ID NO: 203175 - protein, 131 aa, Triticum aestivum
  unsure (1)..(131): unsure at all Xaa locations
  Clone ID: PAT_TA_97593.pep
MARTKQTARKSTGGKAPRKQLATKXARKSAPXXGXVKKPXRFRPGNVPLREIRKXQXNKXXLIPQAPLSXAPSVEXAQRIXXTDLPAFKSSRPSPAPSRKAQGLTWGPPFEGKTKLLIQRPGLPINCPKFK

SEQ ID NO: 203176 - protein, 137 aa, Triticum aestivum
  unsure (1)..(137): unsure at all Xaa locations
  Clone ID: PAT_TA_97594.pep
MGKEKTHINIVVIGHVDSGKSTTTGHLIYKLGGIDKRVIXKGSKKEAAXIKKXSFKYALGCFDKXLKAXREXGIXTIDIALWESSKXNKVLLAXSLNAPGQXRXSSKNMITGTSQADWCCAQQLLXXLGGLXAGYPR

SEQ ID NO: 203177 - protein, 144 aa, Triticum aestivum
  unsure (1)..(144): unsure at all Xaa locations
  Clone ID: PAT_TA_97595.pep
MKTFLVFALLAVAATSAIAQMETRCIPGLERPWQQQPLPPQQTFPQQPLFSQQQQLFPQQPSFSQQQPPFWQQQPPFSQXQQXILPQQPTFSQQQQLVXLPQQPPFSQQQTTKFLPPQQXQXFPQQTNNXQQLGWQQTKSPCLF

SEQ ID NO: 203178 - protein, 86 aa, Triticum aestivum
  unsure (1)..(86): unsure at all Xaa locations
  Clone ID: PAT_TA_97596.pep
TVEGDGKSAGTVRLIKYTEGVPMVTFAKXKVEVADEXKXVVXYXVVDGELXNFYKNFXGTGQVNEGAQRRPAPVVKWTGLQRAEQG

SEQ ID NO: 203179 - protein, 121 aa, Triticum aestivum
  unsure (1)..(121): unsure at all Xaa locations
  Clone ID: PAT_TA_97597.pep
ILAQTGGNRFLXAPRWRGRGSHANFGRLTNREVDFYGRRPWWHWCCSXLARPXXIGGGDEVDQGRDEVDLGRGDEEDRGDCPPTGAQAQTRWDRWLHHRRDRHWPPPLAIDGIRGSTADGI

SEQ ID NO: 203180 - protein, 57 aa, Triticum aestivum
  unsure (1)..(57): unsure at all Xaa locations
  Clone ID: PAT_TA_97598.pep
LNLXVKXVXHGSTSFSXPSSSSPGIFLHQPRQWPPLTXXTHXPRXFXPXXPSXXXFF

SEQ ID NO: 203181 - protein, 121 aa, Triticum aestivum
  unsure (1)..(121): unsure at all Xaa locations
  Clone ID: PAT_TA_97599.pep
DPPSYLTGEFPGDYGWDTAGLSADPETFAKNRELEVIHCRXGMLGALXCVFPELLARNXVKFGXAXWXKXGSQIFXEXXLQYXGKPXLVQXPXAXFPSWAWQSPCSMGPRVTASPGAPSGI

SEQ ID NO: 203182 - protein, 67 aa, Triticum aestivum
  Clone ID: PAT_TA_97600.pep
PNWQRAPWGAQSAPKHWFGAGRAGARSHCLAWILTLEAFSHNPAHGSFAPLAFQPSAMTNCVNQRFL

SEQ ID NO: 203183 - protein, 115 aa, Triticum aestivum
  unsure (1)..(115): unsure at all Xaa locations
  Clone ID: PAT_TA_97601.pep
SYLVXNQXHENKRTTSKNSNXPXESLPGPRNSMRIWWXPDFTGASRRAHWPGXPWGXCSXXGWXRMLPXRKMLXKAAXPTIXNXQKIFPXAFPXGVXEXKSXAGLXNXGXPLXKG

SEQ ID NO: 203184 - protein, 124 aa, Triticum aestivum
  unsure (1)..(124): unsure at all Xaa locations
  Clone ID: PAT_TA_97602.pep
MKTFLVFALLAVAATSAIAQMETRCIPGLERPWQQQPLPPQQTFPQQPLFSQQQQLFLNNHHFRKQQPPFXQQQHISQATTILPQQPHFCKNTTVLPQHTFLQEQTFYSKITFPQQHTQQRGRC

SEQ ID NO: 203185 - protein, 105 aa, Triticum aestivum
  unsure (1)..(105): unsure at all Xaa locations
  Clone ID: PAT_TA_97603.pep
MSRGGSAGGGQSSLGYLFGDGEPAKPAAAPAAKARTXLEKPAPAAADVAKQXPTGIQXYPGEQLYRSKLQNTGXXLTDVFNKVNLLPGGGPPWVLFRNYVNGPLN

SEQ ID NO: 203186 - protein, 142 aa, Triticum aestivum
  unsure (1)..(142): unsure at all Xaa locations
  Clone ID: PAT_TA_97604.pep
QQKETFPQQPPSSQQQQPFPQQPPFLQQQPSFSQQPLFSQKQQPVLPQQPXAFSQQQQTVLPQQPAFSQXQQHQQLLQQQXPNGHPSILQQLNPCKDPPRSXVPCGMPQXLXRXQIWEQISAPKVAKINPPLGTVKFKPKKK

SEQ ID NO: 203187 - protein, 152 aa, Triticum aestivum
  unsure (1)..(152): unsure at all Xaa locations
  Clone ID: PAT_TA_97605.pep
MKTFLVFALLAVAATSAIAQMETRCIPGLERPWQQQPLPPQQTFPQQPLFSQQQQXFPQKTIIFASNNHHFWQQQPHFSTTTNSTNKQPXFSQQQQLXLPQQPHFYSNNNXLPPTTSLFPQQQQHQXLVQQQSWSTTILEAVNQAFLQDAPG

SEQ ID NO: 203188 - protein, 107 aa, Triticum aestivum
  unsure (1)..(107): unsure at all Xaa locations
  Clone ID: PAT_TA_97606.pep
MSCCGGNCGCGAGCKCGNGCGGCKMFPDXEATPGAAAMVIPXASHKGSPAXXERRGKTAVRCTSISERLLSLVLNPPKAGGKSTRLQASTSHLQQPHYNRASSRAPP

SEQ ID NO: 203189 - protein, 121 aa, Triticum aestivum
  unsure (1)..(121): unsure at all Xaa locations
  Clone ID: PAT_TA_97607.pep
YLTQINHEEIPRPCPHCCRXDHHXRRTLYCIPYCLGAAPSIISRAAXNSTATITTSSTSKVEPMHGCLLQQCSQLLISRSPVTSXATYNCLVSWNMFXXTKRIXQXXNFXHQKFXETXXXQ

SEQ ID NO: 203190 - protein, 163 aa, Triticum aestivum
  unsure (1)..(163): unsure at all Xaa locations
  Clone ID: PAT_TA_97608.pep
GDTAQTXXXGSPWGTFPXKAFGXGTXPPFLPXXDRSVKLGLWXFVQFLXLXNGFPCFFSPXXXPNXPGFGKKVSYSVRXLLPIENCCSSLACLATRRYGSRAADGGAARRVVDAIAGGLRWLCIIVGVSRNFRFRYAVQFAVFCVFRIAVKFSLTEFFRCKKK

SEQ ID NO: 203191 - protein, 120 aa, Triticum aestivum
  unsure (1)..(120): unsure at all Xaa locations
  Clone ID: PAT_TA_97609.pep
MKTFLILALLAIVATTATTAVRVPVPQLQPQNPSQQQSQEQVPLVQQQHFXGQQQPFPTTTAIPHQATIPSKKXIPXAXPFPPXFQXRQXATXPQXXHFKTEQIFGNKLEQQANNTTKHL

SEQ ID NO: 203192 - protein, 95 aa, Triticum aestivum
  unsure (1)..(95): unsure at all Xaa locations
  Clone ID: PAT_TA_97610.pep
XTEXVTXFTKPNDDQSNPRLHLXTHXXPPXRARGPFXLXRPXDAXXRSRAAAAAAXDRSALRGGLSMSPHTSXSXXLPGXXTXNCXXSXLXLXSL

SEQ ID NO: 203193 - protein, 133 aa, Triticum aestivum
  unsure (1)..(133): unsure at all Xaa locations
  Clone ID: PAT_TA_97611.pep
MQIFVKTLTGKTITLEVESSDTIDNVKAKIQXDKEGIPPDXXASHLRXASXCEDGRTLADYNIQEGXNLQLVLRLRXGMQIFRENLTGKDIXLEVXXPDTSTSXRQIQDKEDSPGQHFLNTLGVPPDQGLWPW

SEQ ID NO: 203194 - protein, 159 aa, Triticum aestivum
  unsure (1)..(159): unsure at all Xaa locations
  Clone ID: PAT_TA_97612.pep
MKTFLILALLAIVATTATIAVRVPVPQLQPQNPSQQQPQEQVPLVQQQQFPGQQQPFPPQQPYPQPQPFXSQQPYLXLXHFXQAATTYSQPQLPYSXAXLPYSXPXHFXXKQPYSXSQPQYXQPQQXIXQQQQQQQQQQQXTTQQQQHXLQQICTTTIK

SEQ ID NO: 203195 - protein, 105 aa, Triticum aestivum
  unsure (1)..(105): unsure at all Xaa locations
  Clone ID: PAT_TA_97613.pep
DDGVWMKEIXXGERCXPLXFSGAIYXDAXGXRLGAPPTPRTPMRIPLPASLKLAAXXYPPHPPSSQSCDIPSLLTAVLMLMPLCFSHLLSKLCFWRAYDNFQCTF

SEQ ID NO: 203196 - protein, 95 aa, Triticum aestivum
  unsure (1)..(95): unsure at all Xaa locations
  Clone ID: PAT_TA_97614.pep
QSPNSSAQQQPDPSPSIPMARTKQTARKSTGGKAPRKQLATKAARKSAPATGGVKKXHRFRPARRLREIRKVQKNTELXIXSSLXXLLPEISPXF

SEQ ID NO: 203197 - protein, 78 aa, Triticum aestivum
  unsure (1)..(78): unsure at all Xaa locations
  Clone ID: PAT_TA_97615.pep
MARTKQTARKSTGGKAPRKQLATKAARKSAPATGGVKKPHRFRPGXFXXRKFXKFKKTTXFXXKXPFKALXXEISXEX

SEQ ID NO: 203198 - protein, 100 aa, Triticum aestivum
  unsure (1)..(100): unsure at all Xaa locations
  Clone ID: PAT_TA_97616.pep
MSGRGKGGKGLSKGGAXRHRNXXRDNIQCITXPXIRRLARXGGXNRISXLIYXDTXGXLKIFLXNVIXDAVTYTXHXLRKTXTXMDXVYXLNXXAAXLLF

SEQ ID NO: 203199 - protein, 168 aa, Triticum aestivum
  unsure (1)..(168): unsure at all Xaa locations
  Clone ID: PAT_TA_97617.pep
QQKETFPQQPPSSQQQQPFPQQPPFLQQQPSFSQQPLFSQKQQPVLPQQPAFSQQQQTVLPQQPAFSQQQHQQFCNNXIPIGHPSILQQLNPCXVXLQQQCSPVAMPQHLGXRXRCXQQSXCNVMQQQXCQQLPRTPXXPAXXIRATLLXILQDNTXFVQLKXNNPTK

SEQ ID NO: 203200 - protein, 137 aa, Triticum aestivum
  unsure (1)..(137): unsure at all Xaa locations
  Clone ID: PAT_TA_97618.pep
QPGYYLTSPLQLGQGQQGYYPTSLQQPGQGQQPGQWQQSGQGQHWYYPTSPQLSGQGQRPGQWLQPXGQGQQGYYPTSXPQQPXGQGQQLXGQWLQPRQGQQGYYQLLLQQDKXXATSRQXQQXTTLIPFNGHQAAT

SEQ ID NO: 203201 - protein, 162 aa, Triticum aestivum
  unsure (1)..(162): unsure at all Xaa locations
  Clone ID: PAT_TA_97619.pep
LVQQQQFLGQQQPFPPQQPYPQPQPFPSQQPYLQLQPFPQPQLPYSQPQPFRPQQPYPQPQPQYSQPQHPIHSKQXQQQQQQQQQEQQILQQILQQQLIPCMXVLQQHNIRMEFTSFATKSYQRLXXLCCQTYGIPEHPLPSIHKLSSISGXTTKQQQQHRA

SEQ ID NO: 203202 - protein, 100 aa, Triticum aestivum
  unsure (1)..(100): unsure at all Xaa locations
  Clone ID: PAT_TA_97620.pep
SNSFLIALIILVRNVRQADCATRKSVQTEWFHLFGEEWXSVSESQNDIXXDXLFXVPHGIQTFLRNSXIXVHQXXSKPEEDNYNVNPGKLRXXXHLKXYX

SEQ ID NO: 203203 - protein, 121 aa, Triticum aestivum
  unsure (1)..(121): unsure at all Xaa locations
  Clone ID: PAT_TA_97621.pep
MSCCGGNCGCGAGCKCGNGCGGCKMFPDVEATAGAAAMVMPTASHKGSXGGFEXAGETGGCDCXNCKCXTPXAXPAATATEPAPXEPAGXGXHEDEDKQAHHTFTHQRTSQPRIARGARAE

SEQ ID NO: 203204 - protein, 90 aa, Triticum aestivum
  unsure (1)..(90): unsure at all Xaa locations
  Clone ID: PAT_TA_97622.pep
QQPQQSFPQQQQPLIQPYLQQQMNPCKNYLLQQCNPVSLVSSLVSMILPRSDCXVMQQQCCQQLDSPRQXQCAASIRPDSXVMQQEQQQG

SEQ ID NO: 203205 - protein, 127 aa, Triticum aestivum
  unsure (1)..(127): unsure at all Xaa locations
  Clone ID: PAT_TA_97623.pep
MKTFLVFALLAVAATSAIAQMETRCIPGLERPWQQQPLPPQQTFPQQPLFXSQQQQLFPQQPSFXQQQPPFXAATTPXXKQQPXLPTATXFXXXQQLVXPXQXPXXQGTQHFXSXTXPFXXQQQHPX

SEQ ID NO: 203206 - protein, 118 aa, Triticum aestivum
  unsure (1)..(118): unsure at all Xaa locations
  Clone ID: PAT_TA_97624.pep
DERTQQRCIGMAXSTRKYCINQGKFDXERSLTXHGNRTCCNRSTALTPPTHRSTPKRGIPGEPTRTDHGSPSNDPSARTHVAGRRGRNRRLASHTLRRRTREPWLRLDRRFPGEIGWG

SEQ ID NO: 203207 - protein, 110 aa, Triticum aestivum
  unsure (1)..(110): unsure at all Xaa locations
  Clone ID: PAT_TA_97625.pep
RPFIQPSLQQRLNPCKNILLQQCKPASLVSSLWSIIWPQSDCQVMQQQCCQELAQIPQQSKCAAIHSVXVHSIIRAAAAXXQQQQQQQQQQXXXSRXQXSQQQQLVKDSA

SEQ ID NO: 203208 - protein, 94 aa, Triticum aestivum
  unsure (1)..(94): unsure at all Xaa locations
  Clone ID: PAT_TA_97626.pep
MATISAAAATTVVARAAIARPQALGLPQLXDEEREGEVQLLQGRQGGDPGGRRPRGRRVPARRGRAPLTASGGPLWRSNRNRAQPLKKVGFPGG

SEQ ID NO: 203209 - protein, 108 aa, Triticum aestivum
  unsure (1)..(108): unsure at all Xaa locations
  Clone ID: PAT_TA_97627.pep
PLSLVXXNXRRXGXRLAGXCWLGSFVSFAKMLRGXSLLWFLNXERXXXPXTSASNRRGASSVLXDLXGGDRLLHRGRLLRQRGRWVLDISGGHCRRGCKKMTGVAEAG

SEQ ID NO: 203210 - protein, 139 aa, Triticum aestivum
  unsure (1)..(139): unsure at all Xaa locations
  Clone ID: PAT_TA_97628.pep
MSLIAGEEFQHILRVLNTNVDGKQKIMFALTSIKGVGRRFSNIVCKKADIDMNKXAGELSAEEMDRLMAVVHNPRQFXKVPDWFLNRKKDYKDGRFSQVLSNAVDMXXKDYLXXVKKLGTSCLLXXGCXXRGQTQXTGR

SEQ ID NO: 203211 - protein, 131 aa, Triticum aestivum
  unsure (1)..(131): unsure at all Xaa locations
  Clone ID: PAT_TA_97629.pep
MARGLKKHLKRLNAPSHWMLDKLGGAFAPKPSSGPXKXKXCLPLXXXLRNXLKYALNXXLXQTHXFSXXYXGLWXKVRTXKDYXAGSXGINXXXPXXVKNXKXLFYTKGXFXLXXXRNXDXXXKPSKGQVP

SEQ ID NO: 203212 - protein, 120 aa, Triticum aestivum
  unsure (1)..(120): unsure at all Xaa locations
  Clone ID: PAT_TA_97630.pep
LQLASLCHSGHFLASTTAMATADVQNPSAALTEEGARGGEAGRRRGGREDRRKPPRPLEXKXKXCPVQGLRXKGXSPGTIFRKXKQKEPQPTTXGXTRRPQGAPXGSKKKTXGGLXXENP

SEQ ID NO: 203213 - protein, 132 aa, Triticum aestivum
  unsure (1)..(132): unsure at all Xaa locations
  Clone ID: PAT_TA_97631.pep
SPGRDLPPPPRHGVACQRRPRLQELGRVARVPAIYRRFQSLRRPPLVGFILTDRSDMPVPHHCPKXRFVPADPVSRLGSXAVXGXSSXXTPXHXFGQQRQRGLYNNXAXEGXKXALLLSAAAMLWFSPXXPL

SEQ ID NO: 203214 - protein, 93 aa, Triticum aestivum
  unsure (1)..(93): unsure at all Xaa locations
  Clone ID: PAT_TA_97632.pep
MAHPAELSREXNVYMANLAKQAERYXEMVEFMEXVANTIDSXELTVXERNLLSVXYXNXIXAXXSXWXIISSIEQXKEXSRXNEDXFTLIKDT

SEQ ID NO: 203215 - protein, 150 aa, Triticum aestivum
  unsure (1)..(150): unsure at all Xaa locations
  Clone ID: PAT_TA_97633.pep
MACKSSCNLLLLAAVLLSVVAAASASGSCVPGVAFRTDLLPHCRDYVLQQTCGTFTPGSKLPEWMTSASISPXEAYLXKLYCCQGAPXNPXQCRCXALRYFIXXPVPXQXVDXKSXNVRXXRLXXLPRXPSKFNGTXQIXFXPGEXXXGT

SEQ ID NO: 203216 - protein, 161 aa, Triticum aestivum
  unsure (1)..(161): unsure at all Xaa locations
  Clone ID: PAT_TA_97634.pep
MKTFLILALLAIVXTTATTAVRVPVPQLQLQNPSQQQPQEQVPLVQEQQFPXQQQPFPPQQPYPQPQPFPSQQPYLQLQPFPQXQLSYPQXQPFRXQQXYXQPQQXXSXRHXXXFXQQQQQQQXXQQQXQXLQQIXQQQLXPCKDVVLQQHNITXGSHKFK

SEQ ID NO: 203217 - protein, 98 aa, Triticum aestivum
  unsure (1)..(98): unsure at all Xaa locations
  Clone ID: PAT_TA_97635.pep
GWVSSXWESXQLDPMXLEAVXFPHEHLACSTDKVAAAMSXYXPSLGRXISIVXDSXMXGGVSXPRRXARRHRLXXGLRGEXGGESLPACXRVAAGCCR

SEQ ID NO: 203218 - protein, 115 aa, Triticum aestivum
  unsure (1)..(115): unsure at all Xaa locations
  Clone ID: PAT_TA_97636.pep
MSCCGGNCGCGAGCKCGNGCGGCKMFPDVEATAGAAAMVMPTASHKGSSGGFEMAGGETGGCDCTTCKCGTALRLLPAAAATXRPQGGPAGKGDTRXXRRSKQSSSAPQHQGSXH

SEQ ID NO: 203219 - protein, 76 aa, Triticum aestivum
  unsure (1)..(76): unsure at all Xaa locations
  Clone ID: PAT_TA_97637.pep
STXRLLLRWRRRLXFYHLLTSLQNPNLSIQSVXHAGGLLLDXNRXGVVLCLSXWLVLCXGDXXXPVRSPXATXTMT

SEQ ID NO: 203220 - protein, 133 aa, Triticum aestivum
  unsure (1)..(133): unsure at all Xaa locations
  Clone ID: PAT_TA_97638.pep
TPASSVLTASSQSLASFPRRHPPRKGGCLAAAATAGAAPAASAATAAAGARCSPTXRPPPAPPPWSCPPPPTRGAPAGXRERRGRPAASTAPPASXAAPRXAAPAATATXPXPXKAAXKGNRIKEGKQKHITS

SEQ ID NO: 203221 - protein, 77 aa, Triticum aestivum
  Clone ID: PAT_TA_97639.pep
EVALCPVRCFRPDPVCGADGVTYWCGCPEAACAGARVARRGYCEVGAGSAPVSGQALLLVHIVWLFVLGAAVLLGFL

SEQ ID NO: 203222 - protein, 122 aa, Triticum aestivum
  unsure (1)..(122): unsure at all Xaa locations
  Clone ID: PAT_TA_97640.pep
RTYXKXLXXGLDFXKXXENVXSQPFMXWRXRFVFCAEXIYKSXAETGEINGHYLNATAGTCEXMIKMXCICNXLRVPIVMXDYLTGGFTAXXTXLAQYCRHNXLXLHIHXSMHSXIDXXQNH

SEQ ID NO: 203223 - protein, 120 aa, Triticum aestivum
  unsure (1)..(120): unsure at all Xaa locations
  Clone ID: PAT_TA_97641.pep
MATTRPLLLCAALLLAALSCTFAADAPFLVAHKKVALSRPKPGVERLAVSLDLYNQGSATAYDVAINDDSWAKEAFELVSGEVSKTLERLEPGXTASHAFVLXSKTQGKFKXSPAVIKYV

SEQ ID NO: 203224 - protein, 86 aa, Triticum aestivum
  unsure (1)..(86): unsure at all Xaa locations
  Clone ID: PAT_TA_97642.pep
PPPPRQWTRPPPPPAPPAPSTPPLRGSPPPPWXPPPPSTERSARLRFNLSEGPRSLSFCGGVLRAVHLPSFCFDDDYIHILKQKLK

SEQ ID NO: 203225 - protein, 142 aa, Triticum aestivum
  unsure (1)..(142): unsure at all Xaa locations
  Clone ID: PAT_TA_97643.pep
QQXFPWQPQQPFPQTQQSFPLQPQQPFPQQPQQPFSQPQLQFPQQPEQIIPQQPQXPFLLEXQQPFPQQPQQPFSQPQQLIPMQPQQPFXQQSQQSQXPFPXXQQLFXELQQPIXQXPHQHFPCNXNKHXPXIATTIPQQPQ

SEQ ID NO: 203226 - protein, 76 aa, Triticum aestivum
  unsure (1)..(76): unsure at all Xaa locations
  Clone ID: PAT_TA_97644.pep
MSCNCGSGCSCGSDCKCGKMYPDLTEQGSAAAQVAAVVVLGVAPENKAGQFEVAAGQSGEXGCSCGDNCKCNPCNC

SEQ ID NO: 203227 - protein, 155 aa, Triticum aestivum
  unsure (1)..(155): unsure at all Xaa locations
  Clone ID: PAT_TA_97645.pep
TRLXKLCXCGPCQWAPXYLXVGXGESXXVVVXASSARRRNGXACRDVVDESNREVGSVGDDALLRRPLIAVRWTVPVARACAVRVFDRSPARPVCLPLVSSPGPRKPPLLHRGSQPGDAPFFWQAPAAFSVLLPWPWLVRIDWQWPLAQRKLPAY

SEQ ID NO: 203228 - protein, 151 aa, Triticum aestivum
  unsure (1)..(151): unsure at all Xaa locations
  Clone ID: PAT_TA_97646.pep
QSRHTRAPGETEAGDRSRDGLCLDGQCSSARGSSSSGAGNGLLAGVWVLCGGRARGCRRRRERLVEEPPIKRGLSFDFXKXSCPKAXSIVRXFVREPLRKGIRLAAGLFGSXSTTAPQRLQPSVLLXXSGXGNRGXXRXPNLKALKGNKKI

SEQ ID NO: 203229 - protein, 105 aa, Triticum aestivum
  unsure (1)..(105): unsure at all Xaa locations
  Clone ID: PAT_TA_97647.pep
PEYHLVLPRENGISKLFSQLGSSKPAVGVQEPAPEHAXHTPSHEDLQWLEALLSLTPRPLLQPQRGSERSSRQWXTPAAAPPRATLLWAKLRACGVLXVSKQQGX

SEQ ID NO: 203230 - protein, 138 aa, Triticum aestivum
  unsure (1)..(138): unsure at all Xaa locations
  Clone ID: PAT_TA_97648.pep
QQFPQSQQPQQPFPQPQQQFLQPQQPQQSFPQQQQPLIQLSLQQQMNPCKNFLLQQCNPVSLVSSLISMILPRXVDCQVMQQQCCQQLGTVPQAVQLLQPSIMSVHSIIMQAKNNDKGANSGMFNSKQGSSNLNNNSI

SEQ ID NO: 203231 - protein, 153 aa, Triticum aestivum
  unsure (1)..(153): unsure at all Xaa locations
  Clone ID: PAT_TA_97649.pep
MGKIKIGINGFGRIGRLVARVALQXSDDVELVAVNDPFITTEYMTYMFKYDTVNXHWEHXDINSKDNKIRPFXXKQXTFFGVXKPKGFPXXKAXAHNFXGPTXXFTEKXKGLSHLRGXQKXGNLCPKXNXQXWVGVNKEIXSNKFMQLTKALI

SEQ ID NO: 203232 - protein, 33 aa, Triticum aestivum
  unsure (1)..(33): unsure at all Xaa locations
  Clone ID: PAT_TA_97650.pep
MAETEXRCFVXXLAWATXDNNLXKAFSQYXDIL

SEQ ID NO: 203233 - protein, 68 aa, Triticum aestivum
  unsure (1)..(68): unsure at all Xaa locations
  Clone ID: PAT_TA_97651.pep
CILRXRXWXGDRLLIKMXTVSPXXXRRRRCXAYXXCXFXADVPXPXGSATPRGISRIGLPAAPSLARS

SEQ ID NO: 203234 - protein, 60 aa, Triticum aestivum
  unsure (1)..(60): unsure at all Xaa locations
  Clone ID: PAT_TA_97652.pep
MEHKETGCXSREGPILCVNNCGFFGSAATMNMCSKCHKEMAMKQEXAKLAAPLFDRSSTW

SEQ ID NO: 203235 - protein, 128 aa, Triticum aestivum
  unsure (1)..(128): unsure at all Xaa locations
  Clone ID: PAT_TA_97653.pep
AWXLHLSPPHHFFSHLRXPPRPGHRXGALPXPRCSTITXAIHHPHHHPYITAPASSAHLARPLPPAGAPGXDTPSLLLLPFFPASLNPCLLLLXXRAPAAALYXSPXLLSFXXXDSSLIPNXXCLLFP

SEQ ID NO: 203236 - protein, 165 aa, Triticum aestivum
  unsure (1)..(165): unsure at all Xaa locations
  Clone ID: PAT_TA_97654.pep
KKRDQGGEGIKIPXAAPFPNRAWNLHLSPPHHFFHHRPPXRPXRXXGAPXXPLSICAIHHSISTTXPSLHRRTSAPRPDGRLXPPREPPMLLLFLSSSPAAFCCSFFXYLXCXSSNSLLPSPLXXALISLNPPLLLLLSQPLXLKPLSXPLLLFPCXXRSSXPDP

SEQ ID NO: 203237 - protein, 66 aa, Triticum aestivum
  Clone ID: PAT_TA_97655.pep
LSTIEGGIVLGCTFLTTRNGSRIIVSAQQVEIASLCMNKPYQVSTLEQSSCDQTIYLLHKKVIISC

SEQ ID NO: 203238 - protein, 105 aa, Triticum aestivum
  unsure (1)..(105): unsure at all Xaa locations
  Clone ID: PAT_TA_97656.pep
NGQXATXPXNXTHXDRYMXXYIPKGTQVHHKXXGTMDASXAXEKWRRSFMTIXNFXQXXXFKTXXQXYILXCRKXQAXQEXLPXSFXRAAXKXKLQSFLLTXSMQ

SEQ ID NO: 203239 - protein, 114 aa, Triticum aestivum
  unsure (1)..(114): unsure at all Xaa locations
  Clone ID: PAT_TA_97657.pep
LIQARCGKSXXTFLILAXXAIVXXIDTXXVRVPXPQLQPQNPTXQQSQEXVPLVQQXQFLGHXQTFSPXQPYXQAXXFHHNNXYLXLEQFXKXNFSASIHHSNTTEAHIGTQQF

SEQ ID NO: 203240 - protein, 66 aa, Triticum aestivum
  Clone ID: PAT_TA_97658.pep
NRLFMRVRPLPSGRKMQRLEVALAAGIQSVCVRSMTINQRNLLHTHIERENGLITFQCFIMSCSDS

SEQ ID NO: 203241 - protein, 146 aa, Triticum aestivum
  unsure (1)..(146): unsure at all Xaa locations
  Clone ID: PAT_TA_97659.pep
MKTLLIVTILAMATTIATAXMQVXPGYQVQWPQXQPFPQPQQPFCQHPQXTIXQPHXTFHHQXQQTLPHQPHQQXFPXXQQPQQXFXQAQQTFPQHPQLQFXQXPHXPSXXLQXPQXIFPIXYQENFSXPQXHSSQKRFFPTTTLI

SEQ ID NO: 203242 - protein, 95 aa, Triticum aestivum
  unsure (1)..(95): unsure at all Xaa locations
  Clone ID: PAT_TA_97660.pep
XXXKWWVPWVGCEAKAVEXXSGPLSFHRWKQAVVVALVRPALRSACQIMAREAQLWHRPRRSHYSTWNRRASSSTLQPGPQRHTSVHTSLKPPLG

SEQ ID NO: 203243 - protein, 158 aa, Triticum aestivum
  unsure (1)..(158): unsure at all Xaa locations
  Clone ID: PAT_TA_97661.pep
MANPRVFFDMTVGGAPAGRIVMELYKDXVPXRTVENFRALSPAXKGXXXNGKPLELXXDAFXRXVFPHFNXPKGGILTXGEXKXGGNSIFGXKXSXXKIFPKKQXKXGFLPXGXXGGPKXKVQFFNXXVPRNXFQXXXIVXXKSPFSTSKGGNCSRCL

SEQ ID NO: 203244 - protein, 94 aa, Triticum aestivum
  unsure (1)..(94): unsure at all Xaa locations
  Clone ID: PAT_TA_97662.pep
PPFSQQQPPFSQQQQPPFSQQQPPFSQQQQXXXXXQXSFSHXXLXXFSQQHXPFXHQQQLFYLMNXILHDKNQFRNNHFRTTLNKKLHFSPSAA

SEQ ID NO: 203245 - protein, 77 aa, Triticum aestivum
  unsure (1)..(77): unsure at all Xaa locations
  Clone ID: PAT_TA_97663.pep
FFFLPXKPSLLHVTTIXHWYXTXRQLQLQXMSQXGTDTWXXTFQRAXIHHKIVXQGPPAXSRKMXXIIYDERTLLSS

SEQ ID NO: 203246 - protein, 107 aa, Triticum aestivum
  unsure (1)..(107): unsure at all Xaa locations
  Clone ID: PAT_TA_97664.pep
CQAIHNVVHAIILHHHQQQQQQPSSQVSYQQPQEQYPSGQGSFQSSQQNPQAQGSVQPQQLPQFQXEIRNLXLQTLPAMCNVYIPPYCSXTTIAPFGIFGTNWRREE

SEQ ID NO: 203247 - protein, 84 aa, Triticum aestivum
  unsure (1)..(84): unsure at all Xaa locations
  Clone ID: PAT_TA_97665.pep
MAAAATATTTAAATAAAVGPGEVISVHSLEQWTMQIEEANAAKKXVVIDFTASWCXGPCRIMXPFLADLAXXFPAAVFLKGQRL

SEQ ID NO: 203248 - protein, 101 aa, Triticum aestivum
  unsure (1)..(101): unsure at all Xaa locations
  Clone ID: PAT_TA_97666.pep
CQAIHNVVHAIILHHHQQQQQQPSSQVSYQQPQEQYPSGQGSFQSSQQNPQAQGSVQPQQLPQFQXEIRNLALQTLPAMCNVYIPPYCSXTPLPPFXIFGY

SEQ ID NO: 203249 - protein, 148 aa, Triticum aestivum
  unsure (1)..(148): unsure at all Xaa locations
  Clone ID: PAT_TA_97667.pep
MKTLLILTILAMAITIGTANIQVDPSGQVQWLQQQLVPQLQQPLSQQPQQTFPQPQQTFPHQPQQQVPXQQPQQHFQAPTTIPQQHNNHSPDQQPQQXFPQQPQQQFPQTQQPQQHFPQQPQQHSPRSNNPNTIPKFQQPQHFFPAQQ

SEQ ID NO: 203250 - protein, 83 aa, Triticum aestivum
  unsure (1)..(83): unsure at all Xaa locations
  Clone ID: PAT_TA_97668.pep
DFELLRKMVLPDGTVLRARLPGRPTKDCLFADPARDGATLLKIWNMNRFTGVLGVYNCQGRGVDSXEKKNFFNKGRGRRAELA

SEQ ID NO: 203251 - protein, 134 aa, Triticum aestivum
  unsure (1)..(134): unsure at all Xaa locations
  Clone ID: PAT_TA_97669.pep
XSPPSVVLMSPSGPRKSWTRLRDAPLTTXAVRXXILTXLPQXHCCLXAFFAFWPXGRPPWPGGXELGFXXXXXRTFXXXXXVTXXAPWDRLSPTYGXQSPAWEVQDAGLGXXVRKGRRPSXXRRASKPDSXHVP

SEQ ID NO: 203252 - protein, 51 aa, Triticum aestivum
  unsure (1)..(51): unsure at all Xaa locations
  Clone ID: PAT_TA_97670.pep
MGPDELPKXAAAGADEISPFSFRIWPPTQQTXXAVXQHLXVDTLXGDTLLX

SEQ ID NO: 203253 - protein, 140 aa, Triticum aestivum
  unsure (1)..(140): unsure at all Xaa locations
  Clone ID: PAT_TA_97671.pep
MKTLLILTILAMATTIATANMQVDPSGQVQWPQQQPFPQPQQPFCQQPQQXIPQPHQXFHHQPQQTFPQPQXTYPHQPQQQFPQTXTTTTTFXQPQQNSPKNPTXFPQQPXKHXPSSXPXNIPQSXQPXNXPSPIIQNNY

SEQ ID NO: 203254 - protein, 73 aa, Triticum aestivum
  unsure (1)..(73): unsure at all Xaa locations
  Clone ID: PAT_TA_97672.pep
MKTFLVFALLALAAASAVAQISQQQQAPPFSQQQQPPFSXQQQPPFSQQQQPPFXXQQQLPXIQXSVLXQXXP

SEQ ID NO: 203255 - protein, 47 aa, Triticum aestivum
  Clone ID: PAT_TA_97673.pep
FYTPTEHLKEVPHQSWKHSEKEKNIKNICASIKFSVSVISIHEMPVS

SEQ ID NO: 203256 - protein, 113 aa, Triticum aestivum
  unsure (1)..(113): unsure at all Xaa locations
  Clone ID: PAT_TA_97674.pep
KYXSNXKXXLXTRXKGQSCCXRLVPQPXRPARXSRTGGSPKASXPMLDPARGRAGPEERGAGESIGWELGGALHHCRGRGWPRGAGSRRIRRPGAGRRPPSSPSFGEGRGPGR

SEQ ID NO: 203257 - protein, 139 aa, Triticum aestivum
  unsure (1)..(139): unsure at all Xaa locations
  Clone ID: PAT_TA_97675.pep
MSDTDEHHFESKADSGASKTYPQQAGAIRKGGTHPSSKALPASLLRLHLQRLGKHGHAKCHFXVAIDIFNGKELXGIFLQSQXCDXPHVYRQNYQLIDITDDGIXTFLTEKGNXKDDXXFPTXEVLLWXXXTVWKDCPS

SEQ ID NO: 203258 - protein, 123 aa, Triticum aestivum
  unsure (1)..(123): unsure at all Xaa locations
  Clone ID: PAT_TA_97676.pep
PEFLKLDXPXEPGXXSPLGAXLXXXRLFXNLFXXXICWCXXSPVETXEXFXSALMRXTYTXCASAILLHHHIHGLPHLHFNSSPLRQKKRPPVFYLLPAADRVDSAGGGGGGGGGGCKQGLGA

SEQ ID NO: 203259 - protein, 171 aa, Triticum aestivum
  unsure (1)..(171): unsure at all Xaa locations
  Clone ID: PAT_TA_97677.pep
HXLKLRGHRXQLFIDARPFVXCPVPCPPSWLPPXAERRRSGGSRKSVMPXPGRRGSSLCPGGVFGDSGRLAVAESGXWMGAANRASALVRRPARQPRRRRARGAPHGGRRGRGRSPRMRLRDGVAALRPSGGEGHGEGCGAQGFGGCMACEGWHSVACDCSPCCRCLLSSC

SEQ ID NO: 203260 - protein, 169 aa, Triticum aestivum
  unsure (1)..(169): unsure at all Xaa locations
  Clone ID: PAT_TA_97678.pep
LIVFFLDLLHRLSSPWPRRRSARAHQQHGGKQQQYQPLRRIEGLTLRSALRSDPRVPALAAAALLVPLGAALLGLSGLFLLATLAGVALAAPLVCSSVRCSCPLXXGALXXMXGLAXTXALAVSGLSALSGSWGTSKGARAXXSGRFGGMVVNPLXTGSXRXXGARLXX

SEQ ID NO: 203261 - protein, 88 aa, Triticum aestivum
  Clone ID: PAT_TA_97679.pep
MSYDQVLSVLGGGGKAAAASAWSGHGSNITRQIVKCTRWQLEETTDLITCPYHYYCDSSYPGDYSAAVGALVAVLALYCLLSAAASRW

SEQ ID NO: 203262 - protein, 135 aa, Triticum aestivum
  unsure (1)..(135): unsure at all Xaa locations
  Clone ID: PAT_TA_97680.pep
MRPRPPALVSSLLLLLLLFAVPRHAAAAGGDGGGMVRVDGTRFVAGDGDRTVYLSGFNAYWLMEMASDPSRRGGVVSAFRQAAAHGLNLARTWAFSXGGDRTAAVSPGVYTRTCSRAGLVIAXARRHGYTPLCSQ

SEQ ID NO: 203263 - protein, 117 aa, Triticum aestivum
  unsure (1)..(117): unsure at all Xaa locations
  Clone ID: PAT_TA_97681.pep
LXFRXXLXQRIPRQSHRTXLDGSTXLSSLQVLAVPXLXALXYCASPREKKGXPSYRKRSXTTRADASRHGGSXXVXQXRVPVRAVSPGXXGDXPSCXRILVPAADXXLSXXPGSPRR

SEQ ID NO: 203264 - protein, 171 aa, Triticum aestivum
  unsure (1)..(171): unsure at all Xaa locations
  Clone ID: PAT_TA_97682.pep
APHAGGLAPPPVPHRPTPEASRRRPFPSXQHRRPRATSSLWRLLPPSASSLRRAARRRLREQRGRHGGFLTPASSVAYSLHRLLXXTSXAGGTXRGGPXSXAGSSXPXSNGAXRWRAPPSGGSSXREATRAXTPPXGWAQSXWLPPGKGGFXGXVGXSKFXPXKAGRXXFX

SEQ ID NO: 203265 - protein, 155 aa, Triticum aestivum
  unsure (1)..(155): unsure at all Xaa locations
  Clone ID: PAT_TA_97683.pep
MGRRPARCYRQIXNKPYPKSRYCRGVPDPKIRIXDVGMKKKGVXEFSHCVHLVSWXKENVSXXALEXARIACXKYMTKHAXKDAFHLRVRVHPFXVLRINXMLSCAGADXLHTGXRGALGXQGVCXRXXIGXVXLSVRXKPTIIPRPSKFTSWRI

SEQ ID NO: 203266 - protein, 143 aa, Triticum aestivum
  unsure (1)..(143): unsure at all Xaa locations
  Clone ID: PAT_TA_97684.pep
NAGGGNPNNAGGRKYFFPKSNKANNKAKAPRNTTSFIIRAKRAGGIASLVSPCPVTPAVLPTPRISPSREGLSDMAQQQWGVDGYGSMKGLIRLRASSPRQPDAEGEDDDSSSGSDXRSTSSQRRSTHSADVYPADATDRRYS

SEQ ID NO: 203267 - protein, 122 aa, Triticum aestivum
  unsure (1)..(122): unsure at all Xaa locations
  Clone ID: PAT_TA_97685.pep
MKTFLIFALLAVAATSAIAQMETSHIPSLEKPLQQQPLPLQQILWYQQQQPIQQQPQPFPQQPPCSQQQQPPLSQXQNNQQFQQQQPTIFAGKQTXXSGATYPTSTMAWNPPTSNRWNGNMG

SEQ ID NO: 203268 - protein, 136 aa, Triticum aestivum
  unsure (1)..(136): unsure at all Xaa locations
  Clone ID: PAT_TA_97686.pep
MEKHLQVQQQQQLKLPSGFRFHPTDVEIITAYLVPKVLKKPFDTREVGEVDLNKHDPWELPEMANMGEKEWYFFSQKDHKYPTGIRTNRATTAGYWEGTGKRQGVLQPXNHDLIGTKKTLXLYKGKAHKGEKTTGS

SEQ ID NO: 203269 - protein, 153 aa, Triticum aestivum
  unsure (1)..(153): unsure at all Xaa locations
  Clone ID: PAT_TA_97687.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATXVITRWRRSKKGVPDXYSASSGSQHA

SEQ ID NO: 203270 - protein, 82 aa, Triticum aestivum
  unsure (1)..(82): unsure at all Xaa locations
  Clone ID: PAT_TA_97688.pep
RFHPWRWVLLRDXLAARNRCSFLNSSTGECIQLDLSELLDHELLAVTPEGLLVXLXDXSHVRLLNXXTRXXKXLRRXTXXRP

SEQ ID NO: 203271 - protein, 97 aa, Triticum aestivum
  Clone ID: PAT_TA_97689.pep
PSRRRRGAAVARGGRGVARRCRRLNRRRRPLNKGTTGDDGLQLPDCKGGRYFSLHLPVMSASSLQPGSLLFQGPPRFSLGHSLKSCATFWSYSSLQK

SEQ ID NO: 203272 - protein, 77 aa, Triticum aestivum
  unsure (1)..(77): unsure at all Xaa locations
  Clone ID: PAT_TA_97690.pep
NEXQKESRXGQINRRRSSLEKIVAFQXPXSHTRKFNXGHPIQGISASPKMAELPIDARKQQTADGXEGRGKYSTSIP

SEQ ID NO: 203273 - protein, 153 aa, Triticum aestivum
  unsure (1)..(153): unsure at all Xaa locations
  Clone ID: PAT_TA_97691.pep
AMSPVEIPHWFDPVPNSVCVDGKRLRQSAMPVDPMSKVLDDDNLLIEILLLIRYPNNPQSALVPVXKTLVXVXLLTLAFLRPLLRTSTGPGSFGVXFKDKGETVNXLCRCXGSPKXMVXHQXGNSGLMPKNPXGXPGXXHXQTXTMXENRLXF

SEQ ID NO: 203274 - protein, 162 aa, Triticum aestivum
  unsure (1)..(162): unsure at all Xaa locations
  Clone ID: PAT_TA_97692.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWXXPMFGCTDXXQVXXXVXEVKKXXPDXYVPSSXSKHXQVQCVXXIP

SEQ ID NO: 203275 - protein, 134 aa, Triticum aestivum
  unsure (1)..(134): unsure at all Xaa locations
  Clone ID: PAT_TA_97693.pep
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTXAHGGVIPKINPVLLPRAP

SEQ ID NO: 203276 - protein, 97 aa, Triticum aestivum
  unsure (1)..(97): unsure at all Xaa locations
  Clone ID: PAT_TA_97694.pep
PAKAAKTSAKDAPGKKAPAAASTPKKAAPRKPPTKRSAPVKKATPXKKAPAKKXXNVVLPQQVSRSSFPRGVGSGFVGKFIRVRGVSVPLEVLWVKR

SEQ ID NO: 203277 - protein, 139 aa, Triticum aestivum
  unsure (1)..(139): unsure at all Xaa locations
  Clone ID: PAT_TA_97695.pep
MVKAVAVLTGSEGVKGTIFFTQEGDGPTTVTGSVTGFKEGLHGFHVHALGDTTNGCMSTGPHFNPAGHVHGAPEDEIRHAGDLXNVTTGXDXVANINVXDXNIPLXGQIQLLGRAVXHGDXDDFXXVAIKSLEWPVAGG

SEQ ID NO: 203278 - protein, 102 aa, Triticum aestivum
  unsure (1)..(102): unsure at all Xaa locations
  Clone ID: PAT_TA_97696.pep
KRSQYITFIYIXCAXXIIWLXFCXFSATLWFVVSTAYYSPFRPWSCVXXESXRFSEXVLXSXMXFFLXTLLIRXHGWXHIMTARXSWXTTTXXIXXMLFHGS

SEQ ID NO: 203279 - protein, 150 aa, Triticum aestivum
  unsure (1)..(150): unsure at all Xaa locations
  Clone ID: PAT_TA_97697.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTXDNVKGKIQDKEGXPPDKQRLIFAGKQLEDGRTLLTXNQKGSTLNFAPVXRE

SEQ ID NO: 203280 - protein, 64 aa, Triticum aestivum
  unsure (1)..(64): unsure at all Xaa locations
  Clone ID: PAT_TA_97698.pep
AXPSLAYRRRDSHGHGARFSGAAPPPGXVXXSSIXXPXXGGTCGGSPAPHAAGHRXPXXXNVFR

SEQ ID NO: 203281 - protein, 176 aa, Triticum aestivum
  unsure (1)..(176): unsure at all Xaa locations
  Clone ID: PAT_TA_97699.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQXQPQQPFPQXTQQPQQPFPQQPQQPFPQDSTTQQPFPSQATQQLFPSQQQCAAQQRNIIPHKTASSTSLNNS

SEQ ID NO: 203282 - protein, 141 aa, Triticum aestivum
  unsure (1)..(141): unsure at all Xaa locations
  Clone ID: PAT_TA_97700.pep
MGKEKTHINIVVIGHVDSGKSTTTGHLIYKLGGIDKRVIERFEKEAAEMNKRSFKYAWVLDKLKAERERGITIDIALWXFETTKYYCTVIDALGTVDFNKEHDYXYSQADCAXLXIDPTLVFXXGXPKDGKPFXXSLLYPW

SEQ ID NO: 203283 - protein, 172 aa, Triticum aestivum
  unsure (1)..(172): unsure at all Xaa locations
  Clone ID: PAT_TA_97701.pep
QPLPQPQQPQQPFPQQQQPLIQPYLQQQMNPCKNYLLQQCNPVSLVSSLVSMILPRSDCKVMRQQCCQQLAQIPQXQLQCAAIHGVVHSIIMQQEQQQQQQQQQGIQLCGTISVVQGQGIIXQPQTTSQLEVIKXLGLGNPSNKCNVFVQLMSTTKICNISPTLGAMMQRLL

SEQ ID NO: 203284 - protein, 152 aa, Triticum aestivum
  unsure (1)..(152): unsure at all Xaa locations
  Clone ID: PAT_TA_97702.pep
MKTFLILALLAIVATTATTAVRVPVPQLQPQNPSQQQPQEQVPLVQQQQFLGQQQPFPPQQPYPQPQPFPSQQPYLQLQPFPQPQLPYSQXPQPFXTTTTISQPQPQLSATTRXIHKQQXQXQQQQQFNKFATTTDPRGVVLQHNITREYFA

SEQ ID NO: 203285 - protein, 88 aa, Triticum aestivum
  Clone ID: PAT_TA_97703.pep
SIYGEKFADEKFVHKHTKPGILSMANAGPNTNGSQFFICTVPCNWLDGKHVVFGEVVEGMDVVKNIEKVGSRSGTCSKQVVIADCGQV

SEQ ID NO: 203286 - protein, 187 aa, Triticum aestivum
  unsure (1)..(187): unsure at all Xaa locations
  Clone ID: PAT_TA_97704.pep
PQQPFPQQPQQQFPQPQQPQQPFPQPQQPQLPFPQQPQQPFPQPQQPQQPFPQLQQPQQPLPQPQQPQQPFPQQQQPLIQPYLQQQMNPXDYLLQQCNLCHWVSSLVSXILPRXCKVMRXQCCQQLXQXPQXVPXRSIQGVRAFIIXQQXQQQQQQQQQGYSLGGIXXRPGISNSNNQSMGGVRHGM

SEQ ID NO: 203287 - protein, 73 aa, Triticum aestivum
  Clone ID: PAT_TA_97705.pep
ITPYKLQLKCLQREFEEVMNTEEGKDIYINTVDAFQGQERDVIIMSCVRASNHGVGFVADIRRMNVALTPRGG

SEQ ID NO: 203288 - protein, 87 aa, Triticum aestivum
  Clone ID: PAT_TA_97706.pep
TDSSLSTPLISAPALLPPTHQIFGCCRGRRGVESPGGATPPFSPTAVMLQWLACGGATRMGVEACPADGGIEARMASLQKYLQKYLQ

SEQ ID NO: 203289 - protein, 158 aa, Triticum aestivum
  unsure (1)..(158): unsure at all Xaa locations
  Clone ID: PAT_TA_97707.pep
MKTLLIVTILAMATTIATANMQVDPXYQVQWPQQQPFPQPQQPFCQQPQQTIPQPHQTFHHQPQQTYPHXPXQQFPQXTQQPQQPFPQXPQHTFPQQXPQLPFPQQPQQPFXQAQQPQQXFPSHSNHNTFPQPNNIPAPQHPHIIPQATXPLIQYSTT

SEQ ID NO: 203290 - protein, 155 aa, Triticum aestivum
  unsure (1)..(155): unsure at all Xaa locations
  Clone ID: PAT_TA_97708.pep
MKTFLILALLAIVATTATTAVRVPVPQLQPQNPSQQQPQEQVPLVQQQQFLGQQQPFPPQQPYPQPQPFPSQQPYLQLQPFPQPQLPYSQXQPFRPQQPYPQPQPQYSQPQQPXSQQQQQQNNNNTHNTXQXSXXILAKNPRVLQKHGNTSWHKS

SEQ ID NO: 203291 - protein, 173 aa, Triticum aestivum
  unsure (1)..(173): unsure at all Xaa locations
  Clone ID: PAT_TA_97709.pep
PLLSLSLFLCLVLSFPRRRHPNLGGSSPRRTSSLLSIFTRSLLPTGLRLFGRRDAVALLMADGATTATLLVAHGGRRRSGRGGLLLMLLLYPLHLSAAAPESECAKFAGPRAHLRWLRFIRPVPRCVRRVASSCASRLRRPDTPLRMPLQXPARXSVAPAARLCRGGCLSSRA

SEQ ID NO: 203292 - protein, 177 aa, Triticum aestivum
  unsure (1)..(177): unsure at all Xaa locations
  Clone ID: PAT_TA_97710.pep
AAEAKGERGSSSRTDPKGSKEAEATSTEQRACDRRLRPRTRVGKTPITKAANSSGSSESEEMDVNTVGVDAPPSQFVVMLKECHFCHQERAVPERATGFSVAHXTPERKKGAAXXMGGXSVGRLSLEHFHIVRGQDPHSFPVRVAPFCVHNHSAXANIFFPALAKRGGTPXLKWRSQ

SEQ ID NO: 203293 - protein, 99 aa, Triticum aestivum
  unsure (1)..(99): unsure at all Xaa locations
  Clone ID: PAT_TA_97711.pep
QXXNKHYLTQINHXEIPRPCPHXCRGDHXGRRTLYCIPXCLGAAPSIISXXAXXSTATXQPVPHXKLTPCMDALLQQCXPXAXMSXLRSXVVXHXXCLX

SEQ ID NO: 203294 - protein, 94 aa, Triticum aestivum
  unsure (1)..(94): unsure at all Xaa locations
  Clone ID: PAT_TA_97712.pep
PXRKXHEVFIGCVASHVPIHXLXCXXXSMVLERTQSTXLHTFPIKHEASVAKHSYMSQALVSKFLVQISCVMTKYGDPHKEHLRKIIRFKFLNV

SEQ ID NO: 203295 - protein, 48 aa, Triticum aestivum
  unsure (1)..(48): unsure at all Xaa locations
  Clone ID: PAT_TA_97713.pep
QPQQPXQLEXIXXLVLQXLPTMCNVYVPXECSXIKAPFSXVVAXIGGQ

SEQ ID NO: 203296 - protein, 165 aa, Triticum aestivum
  unsure (1)..(165): unsure at all Xaa locations
  Clone ID: PAT_TA_97714.pep
PAKAPGQGXXCHQQXXXQPGYYPIXSXLQXGQLQXXAQGXQGLXTGQXQQGQQPGQGQHPGQGXQGQQXPGQGQQXGQGQQGXQFGQGXQGXYPXXXQXSGQGQXGYYPTSLQQXGQGQSGXYPXSPQHPGQGQQPGQLQQPAQGQQPGQGQQGQHPGQGQQGQQ

SEQ ID NO: 203297 - protein, 133 aa, Triticum aestivum
  unsure (1)..(133): unsure at all Xaa locations
  Clone ID: PAT_TA_97715.pep
IRSRLAALRPDGPIARRFLADLPTVLVVGDSVFVHGGLLEANVEYGLERINAEVSDWIRGERGDNARAPEYVCGRDAVVWLRRFSEGFNCDCQRLQGILGMIPGAKRMVMGHTIQXEGTSXFCGAKXXRXXLF

SEQ ID NO: 203298 - protein, 91 aa, Triticum aestivum
  unsure (1)..(91): unsure at all Xaa locations
  Clone ID: PAT_TA_97716.pep
GGHXNPNHHKYXQYHVRKFIHXMTKVLVLLPPITNQLRTTLASRPRQSIPRGAETDRRVEIWEHAAGDGEAGVPAARHLGRCQRGSGSVCC

SEQ ID NO: 203299 - protein, 69 aa, Triticum aestivum
  Clone ID: PAT_TA_97717.pep
VIHLANPNQYHTSLVPKTSTPIQDVPQDTLLSYSFIDRLDRMMRPPCIVPLEMQDVIKGNMAPKIVHRP

SEQ ID NO: 203300 - protein, 146 aa, Triticum aestivum
  Clone ID: PAT_TA_97718.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTNLSSSNNKSTTTTGSGF

SEQ ID NO: 203301 - protein, 146 aa, Triticum aestivum
  unsure (1)..(146): unsure at all Xaa locations
  Clone ID: PAT_TA_97719.pep
XHXIPGXHXLXNQFXLSIVSEXACHELLSTXSGLFDLKNWSATRARCRTWSRCPRAGPGRGAALGGRLRPXSASPGLRFMMATTAAVATSASTSATISHPQHPLVLDPISPPXSLLCIRRPARASGRERRWGCCSRVASAGGEGGS

SEQ ID NO: 203302 - protein, 171 aa, Triticum aestivum
  unsure (1)..(171): unsure at all Xaa locations
  Clone ID: PAT_TA_97720.pep
ALWRRSQGISMEGDEELLAQTEVKVEPKRDEWMTTLPPERKPGGMTMQSTTFSRGPKEGRGDTSVWTDTPLDRAQKAKMNYLEAYNEATALASNEEDKKRASADAELVDKYNKAKRXKTLVQKYQEEVASKSKEKSKELKXSEQQPEKEDWXGQHPWXHGTFKRSDTGRKL

SEQ ID NO: 203303 - protein, 130 aa, Triticum aestivum
  unsure (1)..(130): unsure at all Xaa locations
  Clone ID: PAT_TA_97721.pep
MAAPRGAALVLAMVLAAMLVAPPATVHAISCSTVYSTLMPCLQYVQQGGSPARGCCTGIQNLLAEANNSPDRRTICGCLKNVANGASGGPYITRAAALPSKCNFASPTRXSPSVXATSTERTERPGVNAL

SEQ ID NO: 203304 - protein, 163 aa, Triticum aestivum
  unsure (1)..(163): unsure at all Xaa locations
  Clone ID: PAT_TA_97722.pep
GQRPGGRRPGAVQQSQQPVPMMPQQMLPRGRVYRYPPGRGIPDVPIPGVAGGMFSVPYDVGGMPLRDASISQQIPVGALATALANASPEQQRTMLGENLYPLVEQLEPDNAAKVTGMLLEMDQTEXLHLPESPKTLKAKVVKXMXLLRICQQQAGGTADXLXS

SEQ ID NO: 203305 - protein, 79 aa, Triticum aestivum
  Clone ID: PAT_TA_97723.pep
FTAQPSTIPADLHPHPLVPHKKYISPGRKILSGVSGWLINRNLTTISQHALERGLLYRVLRKAGTIDIIMSARRSTYKV

SEQ ID NO: 203306 - protein, 173 aa, Triticum aestivum
  unsure (1)..(173): unsure at all Xaa locations
  Clone ID: PAT_TA_97724.pep
MGKIKIGINGFGRIGRLVARVALQSDDVELVAVNDPFIXTEYMTYMFKYDTVHXHWKHSDIKLKDDKTLLFGEKPVTVFGVXRNPEEIXWGXXGADYVVESTGVFTDKDKAAAHXKGGXAKXVVISAPSKDAPMFVVGVNXDKXTSNVXIVXNANCTTNCLAPLTKIINDNSV

SEQ ID NO: 203307 - protein, 139 aa, Triticum aestivum
  unsure (1)..(139): unsure at all Xaa locations
  Clone ID: PAT_TA_97725.pep
AEMNKRSFKYAWVLDKLKAERERGITIDIALWKFETTKYSCTVIDAPGHRDFIKNMITGTSQADCAVLIIDSTTGGFEAGXSKDGQDPXSTLSLLSLLGVKQMICCCNKMDATTPKYXKGXYEEISRDXXSYLKKXVTT

SEQ ID NO: 203308 - protein, 190 aa, Triticum aestivum
  unsure (1)..(190): unsure at all Xaa locations
  Clone ID: PAT_TA_97726.pep
QLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQXSKQPQQPFPQPQQQIXQPQQPQQSFPQQQRXFIQPSLQQQLNPCKNILLQQCKLRHGVSLWSISGTKRLQVMRXQCCXQLAQIXNSP

SEQ ID NO: 203309 - protein, 161 aa, Triticum aestivum
  Clone ID: PAT_TA_97727.pep
MAGLRRDRRRRRGAQPSLYSSQPPGSTMPRHGRAPRTPPPWTSAKDAAASPSRLRCPQRQFLRPPMDRRRANRSPPPPSSRWRGHLCSVIAPLTRRRLLDPEDRRRRLPDPKDRRRRLPDPTTSAAAPRHDGAPSPMTRSSSYSFSHAAVQGVMLFCFNKL

SEQ ID NO: 203310 - protein, 109 aa, Triticum aestivum
  unsure (1)..(109): unsure at all Xaa locations
  Clone ID: PAT_TA_97728.pep
PLPAPRQRDTCCPARTCRRWSVSISLNPAAELATSLSVPWPSCTWSHLCQRQRRARPRVLRGYARAIEGEXPIFXFGPQPSSRTRQLHISLAQXDTCYNXRGXHIXRGS

SEQ ID NO: 203311 - protein, 179 aa, Triticum aestivum
  unsure (1)..(179): unsure at all Xaa locations
  Clone ID: PAT_TA_97729.pep
QQQQPVLPQQQIPFVHPSILQQLNPCKVFLQQQCSPVAMPQSLARSQMLQQSSCHVMQQQCCQQLPQIPQQSRYEAIRAIIYSIILQEQQQVRVPSNLKQQQPQQLGQCVSQPQQXSQQQLGQQPQQQHWTGYFLQPHQIXQLEXMIPLRSVPTTIACQVPCXXHTMCIXGWPGLGPRK

SEQ ID NO: 203312 - protein, 162 aa, Triticum aestivum
  unsure (1)..(162): unsure at all Xaa locations
  Clone ID: PAT_TA_97730.pep
MKTFLILALLAIVATTATIAVRVPVPQLQPQNPSQQQPQEQVPLVQQQQFPGQQQPFPXQQPYPQPQPFPSQQTYLQLQPFPQPQLPYPQPQLPYPQPQLPYPQPQPFRPQQPYPXSQPQYSQPQQXFAEQQQQQXXHTHNTHTFNNLQQQRSSRELYATHT

SEQ ID NO: 203313 - protein, 139 aa, Triticum aestivum
  unsure (1)..(139): unsure at all Xaa locations
  Clone ID: PAT_TA_97731.pep
ILALLAIVATTATTAVRVPVPQLQPQNPSQQQPQEQVPLVQQQQFLGQQQPFPPQQPYPQPXPFPSQXPYLQLQPFPQPQLPYSQPQPFRPXQPXPQXQPQYSXAQXXIHSKQQQQHXXXASXPQXQXXXILQXVLEQX

SEQ ID NO: 203314 - protein, 155 aa, Triticum aestivum
  unsure (1)..(155): unsure at all Xaa locations
  Clone ID: PAT_TA_97732.pep
MARTKQTARKSTGGKAPRKQLATKAARKSAPATGGVKKPHRFRPGTVALREIRKYQXKSTELLIRKLPFQRLVREIXAQDFKTDSAPILRRLRLQEAAEATRGLFEDTNXCAIHAXASHHAQGIQLARRIRXEXASCCCHIMLVQLLLGGNYCVC

SEQ ID NO: 203315 - protein, 101 aa, Triticum aestivum
  unsure (1)..(101): unsure at all Xaa locations
  Clone ID: PAT_TA_97733.pep
DQAVKVVDIVDTFRLQEQPAFDKKQFISHMKRYIKNLSAKLEGDDLDAFKKNVESATKYLLSKLKDLQFFVGESMHDDGGVVFAYYXXGTADSTFLYLHNG

SEQ ID NO: 203316 - protein, 80 aa, Triticum aestivum
  Clone ID: PAT_TA_97734.pep
TPLTQIGPHRHTALQTAVPKFLLVPQPAHPVHNPAMQQRAPMQKVNGDDVQIPADVALQGAVIVQWLPSKEEALLGWGNP

SEQ ID NO: 203317 - protein, 87 aa, Triticum aestivum
  unsure (1)..(87): unsure at all Xaa locations
  Clone ID: PAT_TA_97735.pep
MASKWVRPEVYPLFAATGVAIGICAFSLLRNITXGNPEVRVNKMGXAAGVLENHEEXRRYAEHGLXAXLQDKTPEXCKNXXFLTSQN

SEQ ID NO: 203318 - protein, 181 aa, Triticum aestivum
  unsure (1)..(181): unsure at all Xaa locations
  Clone ID: PAT_TA_97736.pep
MKTFLILALLAIVATTATTAVRVPVPQLQPQNPSQQQPQEQVPLVQQQQFLGQQQPFPPQQPYPQPQPFPSQQPYLQLQPFPQPQLPYSQPQPFRPQQPYPQPQPQYSQPQEPISQQQQQQQQQQQILQQILQQQLIXCMDVVLQQHNIAHGSHXLQQSTXQLLQELCCSTMAXPEHRVQA

SEQ ID NO: 203319 - protein, 160 aa, Triticum aestivum
  unsure (1)..(160): unsure at all Xaa locations
  Clone ID: PAT_TA_97737.pep
MAPKAEKKPAAKKPAEEEPATEKAAEKAPAAKKPKAEKRLPAGKTASKEAGGEAKTRGRKKGSKAKKSVETYKIYIFKVLKQVHPDIGISSKAMSIMNSFINDIFEKLAAXAAKLARYNKKPTXTSREIQTXVRLVSPGSRKHAVSKAQLTHSLNSHCST

SEQ ID NO: 203320 - protein, 115 aa, Triticum aestivum
  unsure (1)..(115): unsure at all Xaa locations
  Clone ID: PAT_TA_97738.pep
MASSLSFILALLLAIAATDAFTVHLLNKCPYTVWPSTYPVRSGSKLDPGQLXAIEVSPGMVSGWIWGRTGCNFDAXGPGSCTXGKCGXMLSCAXGFXPPXKIPQLXLGXGGNPEX

SEQ ID NO: 203321 - protein, 113 aa, Triticum aestivum
  unsure (1)..(113): unsure at all Xaa locations
  Clone ID: PAT_TA_97739.pep
RXXLVTXKIFGIXILVXPTGXXPTGKNTXLKLGTHRGQQDLNSYRFWIXCFLAFHTATXEQPSTSIPASTXTSCYRXHCSCSLGKGHNLLYDGHRQIHGEDTIFQGVLNQACH

SEQ ID NO: 203322 - protein, 78 aa, Triticum aestivum
  unsure (1)..(78): unsure at all Xaa locations
  Clone ID: PAT_TA_97740.pep
SPXPTLSSSLPPPTDFDDSFDLSRCPSPAPPRLRRRXKLXXPPPPXRWIHGQQQPPRRIIXETQXLLNXTXRRGIXAL

SEQ ID NO: 203323 - protein, 93 aa, Triticum aestivum
  Clone ID: PAT_TA_97741.pep
GIHGRRWRRSPRRFSLRVPRAPSISEKKTFGGSETSAQTAPASNGCSVGAPVGGGMGQQERSGKWGMADGELRGHPACGKRWTEAQDRRVLAS

SEQ ID NO: 203324 - protein, 102 aa, Triticum aestivum
  unsure (1)..(102): unsure at all Xaa locations
  Clone ID: PAT_TA_97742.pep
SASXYKEGXXXSCXWLGIAXKPDXKSTSCRTXVEKXARLKVFFSSXNDLLHXXXLHGWRPLXPQFCDVVLPFGMYSAXYRSRXVTFLGAVAVCPFCTSGQCL

SEQ ID NO: 203325 - protein, 125 aa, Triticum aestivum
  unsure (1)..(125): unsure at all Xaa locations
  Clone ID: PAT_TA_97743.pep
WPRRPPPSLLSXGLKSTAGLPVSRRSNGASLGSVKQRWKDXXACKVLAIRRGSKKFREPVLTGNGQQXXASSKQGPITXFAPXWXALPQVQTXVXVKLPXXKKXIPXGXKMAGFXKXGNPXIXGH

SEQ ID NO: 203326 - protein, 153 aa, Triticum aestivum
  unsure (1)..(153): unsure at all Xaa locations
  Clone ID: PAT_TA_97744.pep
MARLNSKAVAAAVVLAAVVLMMAGREASAALSCGQVDSKLAPCVAYVTXGRASSISKECCSGVXGLNGLARSSPDRKIACXCLKTSATKHQXINMGKXPAXPGXSXLSVPSHQHSTNCNNSTIQYIFLLHAWTPVDLIYLMECSYMLTTKINE

SEQ ID NO: 203327 - protein, 84 aa, Triticum aestivum
  unsure (1)..(84): unsure at all Xaa locations
  Clone ID: PAT_TA_97745.pep
XIXPPMCCXWVFMXSRXWXPPGIXVLDAMPPRNRSVYHLSRCVRAQGYLDSKKXRXPNXKGXGVFEVGGXXDXAASLSISKICF

SEQ ID NO: 203328 - protein, 158 aa, Triticum aestivum
  unsure (1)..(158): unsure at all Xaa locations
  Clone ID: PAT_TA_97746.pep
MARTKQTARKSTGGKAPRKQLATKAARKSAPATGGVKKPHRFRPGTVALREIRKYQXKSTELLIRKLPFQRLVREIAQXDSKTDLRFQSSAVSALQEAAEATRGLFEDTNSXHPRQXVTIXPKDIQLAAASVAKGLAAATISCVVSCSWWELFRLLVL

SEQ ID NO: 203329 - protein, 96 aa, Triticum aestivum
  unsure (1)..(96): unsure at all Xaa locations
  Clone ID: PAT_TA_97747.pep
PRARVRGLHPRAIDHRLMYAAGRRTNFHKLHSYVTSGSFKKQEKCKKTSPQTNRNLPTSATTVKTMGHXRLVRRFXVLXWGACFNGLLLLXNPPSK

SEQ ID NO: 203330 - protein, 54 aa, Triticum aestivum
  unsure (1)..(54): unsure at all Xaa locations
  Clone ID: PAT_TA_97748.pep
MKLPLSVGAPDAVPELDXPSLPATWLIXXALFCATSMXVGFRFSRLVVFLLFLP

SEQ ID NO: 203331 - protein, 142 aa, Triticum aestivum
  unsure (1)..(142): unsure at all Xaa locations
  Clone ID: PAT_TA_97749.pep
MKTFLIFALLAIAATSAIAQMETSRVPGLEKPWQQQPLPPQQQPPCSQQQQPFPQQQQPIIILQQSPFSQQQQPVLQQQQXAIAXQQQQQQQQQQXTTPXQQQQQQQQQQQQQQKQQQRXPQPRAEFDIKLIDTVDRNLRRY

SEQ ID NO: 203332 - protein, 165 aa, Triticum aestivum
  unsure (1)..(165): unsure at all Xaa locations
  Clone ID: PAT_TA_97750.pep
GXLXRXXVAXALXPMXPRNAGIPVFFFCRXNXXYCMSQTLXHWXKTXRXSTAPXKCXKSXLIHGXSRFQXAXXXHXLVVXGPPRREQRNGRRSFTTDQNXFIXXXFLHTVRPRLXSCPLXANLRQCRNCCRXSFVRRLXARSRSRFMXFPXRXSMXVXGINLXSI

SEQ ID NO: 203333 - protein, 101 aa, Triticum aestivum
  unsure (1)..(101): unsure at all Xaa locations
  Clone ID: PAT_TA_97751.pep
MVRVXTFFRMXFXXFLXRXXMDKVHXWXXLHQXXXQERMEREXDIXKMXADLIAXAXESESSRQWFQALSYFPDPWLMYAHLQTKLLELCIQQALMGKKKK

SEQ ID NO: 203334 - protein, 126 aa, Triticum aestivum
  unsure (1)..(126): unsure at all Xaa locations
  Clone ID: PAT_TA_97752.pep
QQHAGGGGDRGGGRTAGSIELPRGGSRSTTTRGRGDEEPRPRSXAPPPGPGPHLSGRFYFYLGFQPTNRPPNPGHGVAAAQAQCRPGRXPNQRAQRRTPRRXPRAPRPAPRRSAPIXSRPRXGQLP

SEQ ID NO: 203335 - protein, 142 aa, Triticum aestivum
  Clone ID: PAT_TA_97753.pep
AVATTPHLPCLAPPPPYRSHPQWWPRPHSPPSPRSHSFAHGGARRPPPPPPRPRRRLVLLLRRRPAQPRPPPPPPHPLPRRRAARTSSRICVHRRRGPAEAASCRRNPPPPSKGRPPPKLAGLIDYPRRILSPGRVSPIDPD

SEQ ID NO: 203336 - protein, 130 aa, Triticum aestivum
  Clone ID: PAT_TA_97754.pep
PSAAAATSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 203337 - protein, 170 aa, Triticum aestivum
  Clone ID: PAT_TA_97755.pep
PSSASTVEVASESLFDGEVVPSSIIEIAPYLHVANEVEASNPHVAYLCRFFAFRMANNLDPTASARGVHEFKTALLQKLEMENDSTLKGRVEQSDAREMQSFYQHYYKTYITALQNAARYSLTWLNLKKVSRLQVCCLGVSHIQVDHVIQSSFECLDTKGLQQRTSKEDQ

SEQ ID NO: 203338 - protein, 166 aa, Triticum aestivum
  unsure (1)..(166): unsure at all Xaa locations
  Clone ID: PAT_TA_97756.pep
MSPQTETKAGVGFKAGVKDYKLTYYTPEYETKDTDILAAFRVSPQPGVPPEEAXAAVAAESSTGTWTTVWTDGLTSLDRYKGRCYHIEPVAGEDSQWICYVAYPLDLFEEGSVTNMFTSIVGNVFGFKSPTXALRLEILPIPPTNPKNFPKARLKGXKXERDKLNN

SEQ ID NO: 203339 - protein, 69 aa, Triticum aestivum
  unsure (1)..(69): unsure at all Xaa locations
  Clone ID: PAT_TA_97757.pep
FFFLPEKXSLLHVXNIVHWDKTDXXLQXQEMSQIGTXTWLXTFQXATIXHKIVVEGPASRXHRNXXDHL

SEQ ID NO: 203340 - protein, 106 aa, Triticum aestivum
  Clone ID: PAT_TA_97758.pep
MSPQTETKAGVGFKAGVKDYKLTYYTPEYETKDTDILAAFRVSPQPGVPPEEAGAAVAAESSTGTWTTVWTDGLTSLDRYKRDECYHIRSLVCGKTSHLVNSLNPI

SEQ ID NO: 203341 - protein, 164 aa, Triticum aestivum
  unsure (1)..(164): unsure at all Xaa locations
  Clone ID: PAT_TA_97759.pep
GRIWVGANAGLQTKIIEALHSSPVGGHSGSLATYQKIKKLFHWARIKTAVKEFVQQCQICQQAKHENCKYPGLLAPLPIPRGPWEDISMDFIEGLPKSNGSSCILVVVDRYTKYSHFIPLKHPYTAAAQIAHIFLQXVVKLHGMPYTITSXDRDKIXTSNFWXR

SEQ ID NO: 203342 - protein, 115 aa, Triticum aestivum
  unsure (1)..(115): unsure at all Xaa locations
  Clone ID: PAT_TA_97760.pep
MMRLSDDQPVKXVDIVDTFXLQEQPXAFDKKQFISHMKRYIKNLSAXKLEGDDXDVFKKNVESXTKYLLSKLKDLQFFVGESMHDDGGVVFAYYKEGAADPTFLYFAHGLKEVKC

SEQ ID NO: 203343 - protein, 168 aa, Triticum aestivum
  Clone ID: PAT_TA_97761.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQAAATTRSTTTTSGVLASHNNKHNWKGWIAVIRDGHP

SEQ ID NO: 203344 - protein, 66 aa, Triticum aestivum
  Clone ID: PAT_TA_97762.pep
IHRIYKWIIPRQIHKGNNGGATRINQCVRSRRIMLLRYSHTDHATIFLVLLHPTLQLLGKNITLCP

SEQ ID NO: 203345 - protein, 96 aa, Triticum aestivum
  Clone ID: PAT_TA_97763.pep
ANQIIKGIKGKFKPLSLEFDNKAVMHIPPENYLVHTTQGNVCLGILNGSKFPEGQMMRIGDVSMQDLLVIYDKVERRIGWVSKSCPTPEIPSTHVL

SEQ ID NO: 203346 - protein, 63 aa, Triticum aestivum
  unsure (1)..(63): unsure at all Xaa locations
  Clone ID: PAT_TA_97764.pep
SXEFSXPPAFVVRPKRQRPVPTPLRPTCTTPPPKRRREGRKKDGGEGGERGVRSLEFSARRWM

SEQ ID NO: 203347 - protein, 64 aa, Triticum aestivum
  unsure (1)..(64): unsure at all Xaa locations
  Clone ID: PAT_TA_97765.pep
AAAAESQPPFAPPRGQRRTRWRXPPPPRHPPSPPSPTPKPXPPPPPPHPPPSPSPRXHPTPHAP

SEQ ID NO: 203348 - protein, 104 aa, Triticum aestivum
  unsure (1)..(104): unsure at all Xaa locations
  Clone ID: PAT_TA_97766.pep
PPPPVRRRRAAPGPPRRASLSSHRRRRGHRRLSLRATAAAAAIFLGRRSDLGGGDLLRPIQGRWLRXVANXVVVLAAATKRSXRXLWCPIWIPFGIWLXGPXXV

SEQ ID NO: 203349 - protein, 82 aa, Triticum aestivum
  Clone ID: PAT_TA_97767.pep
MKKFLVLALIVVAATTTAAEPFTAFRTAWEPHHPSSPEQQPTPQPQEQPVPHQKLNPCRDALLQQCSPVADMSFLRSQVGAT

SEQ ID NO: 203350 - protein, 154 aa, Triticum aestivum
  unsure (1)..(154): unsure at all Xaa locations
  Clone ID: PAT_TA_97768.pep
PFVHPSILQQLNPCKVFLQQQCSPVAMPQSLARSQMLQQSSCHVMQQQCCQQLPQIPEQSRSEAIRAIVYSIILQEQQQGFVQPQXQQQPQQSGQGVSQHQQQVAAASKQLGQCXFQQPQQLQQLGQXQPQQQQXPQGIFLXPHXISQXEGXTF

SEQ ID NO: 203351 - protein, 119 aa, Triticum aestivum
  Clone ID: PAT_TA_97769.pep
QRFQIWERMVNSHGTAIWVLRKTARMHSVLQYAMLTIVGYSEDGDALLLSVSFGGVATYSFMLQLESMEWTNLNQRFLHCSYHPFAYFYTAGTVRASSTAPAIEPPQQRSTIPAIVPPQ

SEQ ID NO: 203352 - protein, 88 aa, Triticum aestivum
  unsure (1)..(88): unsure at all Xaa locations
  Clone ID: PAT_TA_97770.pep
VYGSRILQAPKRGGKAPVPAKKKAADKVVNPLFEKRPKQFGIGGALPXPKKDLHRFVKWPKXLRIQXQRRILKAXPSKVPPALQQVPA

SEQ ID NO: 203353 - protein, 59 aa, Triticum aestivum
  unsure (1)..(59): unsure at all Xaa locations
  Clone ID: PAT_TA_97771.pep
GQVGSXPSAXIXPSXXVVXLXPPIPXPLRXXXVXLXPLLSSSXFPSXXQGTRSTLSXPY

SEQ ID NO: 203354 - protein, 91 aa, Triticum aestivum
  unsure (1)..(91): unsure at all Xaa locations
  Clone ID: PAT_TA_97772.pep
DGGEAVTDAIAELLSPVGLLLLPVGLLLLIRLLSSDRXAAALADVFAFGGSPDAVHRVGGSPIGVALMLLLILALLYYRSALFGXGGDDDE

SEQ ID NO: 203355 - protein, 124 aa, Triticum aestivum
  unsure (1)..(124): unsure at all Xaa locations
  Clone ID: PAT_TA_97773.pep
HNSHIRSRNHFHQQQQQQQEQKQQLQQQQQQQQQLXQQXXQXQQQPSSQVSFQQPQQXYPSXQVSFQPSQLNPQGQXSVQPQQLXQFAXIRXLAXQTXPXMCNVXIPPHWXHQRHFFPTGKRDF

SEQ ID NO: 203356 - protein, 85 aa, Triticum aestivum
  Clone ID: PAT_TA_97774.pep
AKMRIALVTLLTLAILLVGSDVEAEQLQCTTAVIKRPGGCSNSTCEYDCDQKRKPICGPRCSWKANCVGGSCKCLVCNVKETTML

SEQ ID NO: 203357 - protein, 80 aa, Triticum aestivum
  unsure (1)..(80): unsure at all Xaa locations
  Clone ID: PAT_TA_97775.pep
IQRPXTXQXXLXXSTXRLTEXPMRYLLASILXSXCLXTXPGPCRSLSLVYTTRQADGWSPRRGEEEGERKWAGRERCXXV

SEQ ID NO: 203358 - protein, 134 aa, Triticum aestivum
  unsure (1)..(134): unsure at all Xaa locations
  Clone ID: PAT_TA_97776.pep
SPACWXFWPEGDGEERAGGGGGGLARGQGAGGGHRRGRGQEEAPRRLIQVTTAQIARFSIHRFRLLCSVIWAFSFFQSAVSSPSFHFVVEWTCSCFTPDKTSFILLPSEKVCQVSSDGGSTCVYLKLQHVCIDD

SEQ ID NO: 203359 - protein, 161 aa, Triticum aestivum
  unsure (1)..(161): unsure at all Xaa locations
  Clone ID: PAT_TA_97777.pep
XAXRXRGITIDIALWKFETTKYYCTVIDAPGHRDFIKNMITGTSQADCAVLIIDSTTGGFEAGISKDGQTREHALLAFTLGVXQMICCCNKMDAXTPKYSKARYEEIVKEVSSYLXKKVGYNPDKVPFVPISGFEGXNMIXXSNNLXWVXKGPXLLEAPDQ

SEQ ID NO: 203360 - protein, 64 aa, Triticum aestivum
  unsure (1)..(64): unsure at all Xaa locations
  Clone ID: PAT_TA_97778.pep
MEEESHFPANDPILCHKCKDPQQPPDLKCSSCGLRVHHQCSPWQESGQPGDSANWXCGTCREWQ

SEQ ID NO: 203361 - protein, 144 aa, Triticum aestivum
  Clone ID: PAT_TA_97779.pep
AEDTYNFLINWFKRFPQYKDREFYISGESYAGHYVPQLADLVYERNKDKKASTYINFKGFIVGNPLTDDYYDSKGLAEYAWSHAVVSDEVYDQIKKNCDFRASNWTDDCNKAMNTIYGQYQLIDIYNIYGPKCNLGTNISSICC

SEQ ID NO: 203362 - protein, 81 aa, Triticum aestivum
  unsure (1)..(81): unsure at all Xaa locations
  Clone ID: PAT_TA_97780.pep
PLRLPHSXRPSLXSFVPPRRPPAAGSDLDSTRPARRRGRXGXPPIXPHGAAPGHGEXPXPXGXXNVMXSXAXSISMSXGNF

SEQ ID NO: 203363 - protein, 160 aa, Triticum aestivum
  Clone ID: PAT_TA_97781.pep
KLQLKLAGGRVAVDYIPSLPPPRNVVVFRVLLRANNPGGRATIVYANVTVRLTDASAGPAATITEFDLPQRIDVAQRMAHEATAVAELEPGEDLPMRYVRTLYEGRGVAGAEMELSGVLSTHTGIANTNVLNTYYCWPVNIPRLARDSRPPTCPSKKLDA

SEQ ID NO: 203364 - protein, 122 aa, Triticum aestivum
  unsure (1)..(122): unsure at all Xaa locations
  Clone ID: PAT_TA_97782.pep
MSGRKKTREPKEENXTLGPAVREGEXXFGVXHIFXSFNXTFIXXTVLSGRXTLVRITGGMKVXADXDESSPYAVMFASQDVAVXCXXAWYCLCINVRAYWWEQPVSLVAPRLLQVSGNEIGH

SEQ ID NO: 203365 - protein, 69 aa, Triticum aestivum
  unsure (1)..(69): unsure at all Xaa locations
  Clone ID: PAT_TA_97783.pep
MXETEYRCFVGXLAWATDDNNLXQAFSXYGXILXAKIIXXRXTGRSRGFGFXTFGXEXSXRXAIXDMNX

SEQ ID NO: 203366 - protein, 129 aa, Triticum aestivum
  unsure (1)..(129): unsure at all Xaa locations
  Clone ID: PAT_TA_97784.pep
MKTFLVFALLAVAATSAIAQMETRCIPGLERPWQQQPLPPQQTFPQQXPLFSQQQXLFPQQPSFSQXQPPFWQQXPPFSQQQPILPQXQPPFSQQQQTSSXRNKHHFXKXXQPXXPFQKXITFSQQXPA

SEQ ID NO: 203367 - protein, 107 aa, Triticum aestivum
  unsure (1)..(107): unsure at all Xaa locations
  Clone ID: PAT_TA_97785.pep
VLLASNMTNXQLMQHGDNLMDETDQALARSKQTVQETINVGTETAAALKAQTEQMSRVVNEXLDSIHFSMKKASKLVKEIGRQGLRLIAINGLCFFSIGRWESAIIG

SEQ ID NO: 203368 - protein, 122 aa, Triticum aestivum
  unsure (1)..(122): unsure at all Xaa locations
  Clone ID: PAT_TA_97786.pep
LKELQLCSEFQIPWNKXGVSFLLXAQEQXMVGXICSGTLXTVVLQRLSHSXPTGKXSXFSXKXGKPXRXRXPNEWXELPQXXAGXXKPICXLXTSSLSNXSPEXEXMLXRNXLXKPSXQIXK

SEQ ID NO: 203369 - protein, 93 aa, Triticum aestivum
  unsure (1)..(93): unsure at all Xaa locations
  Clone ID: PAT_TA_97787.pep
VRFPSRPISSLNHXSTTTXRWLASPWXPPSXRSXPXPXPRRAPCRRPXMAPLPAPXVRSXXTXPAPVXTPAHRRVAVXDGLXPGPXHXRSLLL

SEQ ID NO: 203370 - protein, 122 aa, Triticum aestivum
  unsure (1)..(122): unsure at all Xaa locations
  Clone ID: PAT_TA_97788.pep
MARLNSKAVAAAVVLAAVVLMMAGREASAALSCGQVDSKLAPCVAYVTGRASSISKECCSGVQGLNGLARNNPDRKIACRCLKSLATSIKSINMGKVSGRAPAKLXASALPSPINXSTKLAT

SEQ ID NO: 203371 - protein, 116 aa, Triticum aestivum
  unsure (1)..(116): unsure at all Xaa locations
  Clone ID: PAT_TA_97789.pep
LTASSQSLASFPRRHPPRKGGCLAAAATAGAAPAASAATAAAGARCSPTWRPPPAPPPWSCPPPPTRGAPAGSRRPGXPAGATAPPASAXPRAGAPAAXATEPAPKXXGGKSEHQD

SEQ ID NO: 203372 - protein, 56 aa, Triticum aestivum
  unsure (1)..(56): unsure at all Xaa locations
  Clone ID: PAT_TA_97790.pep
GGGXLTDGSCGGVGHGCAGGGCRPGSIARRRAGGGSRTGLITGSSAGWACLGSRWI

SEQ ID NO: 203373 - protein, 99 aa, Triticum aestivum
  unsure (1)..(99): unsure at all Xaa locations
  Clone ID: PAT_TA_97791.pep
NHVVAXXKXSLAXPHQGIAPCLXGXXXLRXFSLLQNRWMXXLVXTCVPXKWWXPXLLRKWRCVXAXVKXCAXGTXRRKSEEGKDEEGXHCGXVLTSVAW

SEQ ID NO: 203374 - protein, 93 aa, Triticum aestivum
  unsure (1)..(93): unsure at all Xaa locations
  Clone ID: PAT_TA_97792.pep
SAXRXPGXXSXADPVSTXRTXWFXPCAPXRLSFRGXLIXGLVIXGLXGRXWRXRVVVEARRXPAXPRLLXFRCRAAQAQEEASXMPWXXQRVV

SEQ ID NO: 203375 - protein, 134 aa, Triticum aestivum
  unsure (1)..(134): unsure at all Xaa locations
  Clone ID: PAT_TA_97793.pep
SLEPSAAAATSALSFLLRSKMKFIAAYLLAYLSGNASPSAEDLTSILESVGCEIDNXKMELMLSQVKGKDITXALGCXVRXKFAAVPSGGXXCGCFKLAAPAAGRCWLPLVFKKNVRGRGTLTLAFVRKVGNLS

SEQ ID NO: 203376 - protein, 110 aa, Triticum aestivum
  unsure (1)..(110): unsure at all Xaa locations
  Clone ID: PAT_TA_97794.pep
MAALSSAAVSVPSFAATPMRSSSSRMVVRASLGKKAASAAVAMXASAMLLGGSAMAQDVLLGANXGVLXVFEPNDFSVKAGRRTSPSKNXAXXPAQWFRPRACPPGRGNV

SEQ ID NO: 203377 - protein, 116 aa, Triticum aestivum
  unsure (1)..(116): unsure at all Xaa locations
  Clone ID: PAT_TA_97795.pep
TFPHQPQQQFSQPQQPQQQFIQPQQPFPQXPQQTYPQRPQQPFPXTQQPXQPFPQSQQSQQPFXXPQQQSRXRQXPQQSFPQQXPSLXQQSLXQXLNPXKNFLLXKCXPVSLHPSV

SEQ ID NO: 203378 - protein, 105 aa, Triticum aestivum
  unsure (1)..(105): unsure at all Xaa locations
  Clone ID: PAT_TA_97796.pep
VAMPQSLARSQMLQQSSCHVMQQQCCQQLPQIPQQSRYEAIRAIIYSIILQEQQQVQGSIQSQQQQPQQLGQCVSQPQQQSQQQLGQQPQQQQLXQGTFLQATPR

SEQ ID NO: 203379 - protein, 107 aa, Triticum aestivum
  unsure (1)..(107): unsure at all Xaa locations
  Clone ID: PAT_TA_97797.pep
MIQSFLQQQMNPCKNFLLQQCNPVSLVSSLVSIILPRSDCQLMQQQCCQRLAQIPQQLQVRKPSTTSRIHHHSAXTTXKXVQILRPTISFAQGVWGQFKPNKPIWGD

SEQ ID NO: 203380 - protein, 95 aa, Triticum aestivum
  unsure (1)..(95): unsure at all Xaa locations
  Clone ID: PAT_TA_97798.pep
IXSXETTSGGXSRIPCXPXXXQVGPXVLGIIQPSTKPRLKFGRGSRSLVLXXMSKPMLQXCMXPPXCXXINMPYANIXXCHWWPMKNSRVMLIGR

SEQ ID NO: 203381 - protein, 135 aa, Triticum aestivum
  unsure (1)..(135): unsure at all Xaa locations
  Clone ID: PAT_TA_97799.pep
LQKHRQAEELPSHHLFSPSTPREEKDTERSIYVAANGVGVGRHGVRLLAEGSRGCVHREPRVGERRRRRGDRAASGRRRRRSGRGRGTTREWWSFXIWRAKXGXGKSPSLRPMPSRAXGLIPPXGXCRALXTSPK

SEQ ID NO: 203382 - protein, 124 aa, Triticum aestivum
  unsure (1)..(124): unsure at all Xaa locations
  Clone ID: PAT_TA_97800.pep
QLGQGQQTGQPGQKQQPGQGQQTGQGQQPEQEQQPGQGQQGYYPTSLQQPGQGQQQGQGQQGYYPTSLQQPGQGQQGHYPASLQXQPGQGQPXGXRXQPGXGXHPXEQGKQXGXGQSTIPNFST

SEQ ID NO: 203383 - protein, 154 aa, Triticum aestivum
  unsure (1)..(154): unsure at all Xaa locations
  Clone ID: PAT_TA_97801.pep
MSPQTETKAGVGFKAGVKDYKLTYYTPEYETKDTDILAAFRVSPQPGVPPEEAGAAVAAESSTGTWTTVWTDGLTSLDRYKGXCYHIEPVAGEDSQWICYVAYPLDLFEQGXLLTCXTSIVGXPTWFXXPYRASXFWEDLXIPPYXIQKXFXRR

SEQ ID NO: 203384 - protein, 112 aa, Triticum aestivum
  unsure (1)..(112): unsure at all Xaa locations
  Clone ID: PAT_TA_97802.pep
RRRRPRWRSRSPPRRSRRRRKPPRRWRPKSRRLPPSRLRRPRRRRRQQLRQRXRXEPRSQATGGRTGGRGRPAVGPRTREQRERWPEPIPGGGPEKKKAAPAEGPKPGLPLS

SEQ ID NO: 203385 - protein, 92 aa, Triticum aestivum
  unsure (1)..(92): unsure at all Xaa locations
  Clone ID: PAT_TA_97803.pep
VEEEEECEXGQIPRPRPQHPXRERQQHGEKEEDXGEQPXPFPFPRPRQPHQEEXHEQKEEHXWXRKEEKHXGKGSEXEHDXXXHXXSHXXHQ

SEQ ID NO: 203386 - protein, 56 aa, Triticum aestivum
  unsure (1)..(56): unsure at all Xaa locations
  Clone ID: PAT_TA_97804.pep
RXDPXAGLPYSFSPTVRPLLLSMAMPDLEPCPSLVVWGRRGGGATRGEEEEMAAAA

SEQ ID NO: 203387 - protein, 91 aa, Triticum aestivum
  unsure (1)..(91): unsure at all Xaa locations
  Clone ID: PAT_TA_97805.pep
RVFFXLFFTIDVFSDEENEANGEFQNAEWTDGMCPNLQVVRLTGVLCSSNEMCFIQLLLSKATVLRIMSINLGYGSLKSSEDALRELIXYR

SEQ ID NO: 203388 - protein, 125 aa, Triticum aestivum
  unsure (1)..(125): unsure at all Xaa locations
  Clone ID: PAT_TA_97806.pep
SAHRHLPPNRRRVLPPSLPLSLYLSFSAMAKQLAVHALLLVVLLLALSSVHAGSNSTASAGPLYGIEFPPYNTAVADAGXDGRLVAXEGDLARQPPSLKAPHDPXVPAARGKTRGKXLLSSXDPS

SEQ ID NO: 203389 - protein, 158 aa, Triticum aestivum
  unsure (1)..(158): unsure at all Xaa locations
  Clone ID: PAT_TA_97807.pep
TFLVFALLAVAATSAIAQMETRCIPGLERPWQQQPLPPQQTFPQQPLFSQQXQLFPQQPSFSQQQXPPFWQQQPPFSQQQPILPQXPPFSQQQQLVLPQXPPFSQQXXPKFYLHNNHPFPQXQQWXXRXVTTKSPVVSSHPFLASAMRFLPQPWANGF

SEQ ID NO: 203390 - protein, 99 aa, Triticum aestivum
  unsure (1)..(99): unsure at all Xaa locations
  Clone ID: PAT_TA_97808.pep
MQIFVKTLTGKTITLEVESSDTIDNVKAKIQDKEGIPPDQXQRLIFAGKQLEDGRTLADYNIQKXSTLXLXLRLXGGMXXFLKTPHWEPSTLEELAPFT

SEQ ID NO: 203391 - protein, 124 aa, Triticum aestivum
  unsure (1)..(124): unsure at all Xaa locations
  Clone ID: PAT_TA_97809.pep
MGKEKTHINIVVIGHVDSGKSTTTGHLIYKLGGIDKRVIERFEKEXAEMNKRSFKYAWVLDKLKXRXXRGGINQLIILGSLRTNKVTNEPLEPLGTLQSKLGYLPRADLCCSNRPNGGFCGNLD

SEQ ID NO: 203392 - protein, 88 aa, Triticum aestivum
  unsure (1)..(88): unsure at all Xaa locations
  Clone ID: PAT_TA_97810.pep
MSSSEVACTLAALILHDDGIPITSEKIATVVKAAGIKVEAYWPALFAKLLEKRSVDYLILSVGFGWXGVAPAAAAAAPAAGGACWPAR

SEQ ID NO: 203393 - protein, 87 aa, Triticum aestivum
  unsure (1)..(87): unsure at all Xaa locations
  Clone ID: PAT_TA_97811.pep
MALSTMALSSPALAAKQAKIASFNVFGEGRITMRKTAAKAKPAASSSPWYGPDRVLYLGPLSGDAPSXXTGEFPRRTGGKGRGSPGP

SEQ ID NO: 203394 - protein, 109 aa, Triticum aestivum
  unsure (1)..(109): unsure at all Xaa locations
  Clone ID: PAT_TA_97812.pep
MARTKXTARKSTGGKAPRKQLATKAARKSAPATGGVKKPHRFRPGTVALREIRKYQKSTELLIRXLPFQRLVREIAQEFKTGASSPPPVSAPPKERPGPLCFNTLVIQR

SEQ ID NO: 203395 - protein, 96 aa, Triticum aestivum
  unsure (1)..(96): unsure at all Xaa locations
  Clone ID: PAT_TA_97813.pep
MKTFLIFALLAVAATSAIAQMXTXHIPSLEKPLXQQPLPLXQILWYQQQQPIQXXPQPFPQQPPCSXQQQPPLSQXXQXPFSXXQXPFLREXXXRF

SEQ ID NO: 203396 - protein, 53 aa, Triticum aestivum
  unsure (1)..(53): unsure at all Xaa locations
  Clone ID: PAT_TA_97814.pep
TAADLARASXARASFRRLITGHAFLRRYRTLHPPPLIGVLEVHDNAFFPAQPP

SEQ ID NO: 203397 - protein, 148 aa, Triticum aestivum
  unsure (1)..(148): unsure at all Xaa locations
  Clone ID: PAT_TA_97815.pep
QPPFSQQQQLXLPQQPPFSQQQQQPVLPQQQIPFVHPSILQQLNPCKVFLQQQCSPVAMPQSLARSQMLQQSSCHVMQQQCCQASWPQNPPSSPLLRANPVAYQSNSNQSLARNNNKGRGNPQASKQAPNWGQIVFSQSPQAGKQNSG

SEQ ID NO: 203398 - protein, 47 aa, Triticum aestivum
  unsure (1)..(47): unsure at all Xaa locations
  Clone ID: PAT_TA_97816.pep
YXXXLYXXXKKKLLSXFTGSIVRXFFNGLMSTLRNQSXLSLSLSLSL

SEQ ID NO: 203399 - protein, 116 aa, Triticum aestivum
  unsure (1)..(116): unsure at all Xaa locations
  Clone ID: PAT_TA_97817.pep
MKTFLIFALLAVAATSAIAQIENSHIPGLEKPSQQQPLPLQQTLSHHQQQQPVQQQPQPFPQQQPCSQXQQQPPLSQQQQPPFSQQQPPFSQQQQPATIIPPATTTVDSSHIYNNR

SEQ ID NO: 203400 - protein, 144 aa, Triticum aestivum
  unsure (1)..(144): unsure at all Xaa locations
  Clone ID: PAT_TA_97818.pep
QQLIVQLGCDVVYMVTGGNCLQKFAESVCPGCTRLHQSYWICIFGSSQFLLSQLRDLNSITAISLAAAVMSLNYSNISWAXCLAKGPVAGVSYAXKGGKXXDXVFRVCXXLGQVXFXFXGHXVVLEXXXNIPXKPXKPSKVPMW

SEQ ID NO: 203401 - protein, 62 aa, Triticum aestivum
  unsure (1)..(62): unsure at all Xaa locations
  Clone ID: PAT_TA_97819.pep
MAVPRGAALVLVMXLAXMVVAPPXTVHAISCSTVYSTLMPCLXYVQQGGSPARXXCXXGIHP

SEQ ID NO: 203402 - protein, 142 aa, Triticum aestivum
  unsure (1)..(142): unsure at all Xaa locations
  Clone ID: PAT_TA_97820.pep
MKTFLILALLAIVATTATIAVRVPVPQLQPQNPSQQQPQKQVPLVQQQQFPGQQQPFPPQQPYPQLQPFPSQQPXFASXNQFPATGNXQYPXSXNXQYXXSXXPFXTKTXNXQNXXXQXSQPKQPISQQQATGSQQQPPLPF

SEQ ID NO: 203403 - protein, 92 aa, Triticum aestivum
  unsure (1)..(92): unsure at all Xaa locations
  Clone ID: PAT_TA_97821.pep
FLKNYXXEGPXKKXPXXXDXAXTXKTLNXLKRNXSFPGXTRHIKFTPVPNPNKPKTLXPSRKTKSHLHILETLNILHTLPPNSKIQTKTKNT

SEQ ID NO: 203404 - protein, 94 aa, Triticum aestivum
  unsure (1)..(94): unsure at all Xaa locations
  Clone ID: PAT_TA_97822.pep
MAFEKIKVTNPIVEMDGDEMTRVFWQSIKDKLIFPFLDLXIKYFDLGXVLHRDATDDKVTSXRLQEATLKXNXAIKCATXTPDXXGLKEFNLKQ

SEQ ID NO: 203405 - protein, 138 aa, Triticum aestivum
  unsure (1)..(138): unsure at all Xaa locations
  Clone ID: PAT_TA_97823.pep
QQFPQPQQPQQPFPQPQQAQLPFPQQPQQPFPQPQQPQQPFPQSQQPQQPFPQPQQPQQSFPQQQQPLIXPYLQQQMNPCXNYLLQXCNPVSLVSSLVSMILPRSDCQVMXATFCQATTRQAQVQIPIVGAIPIHWRN

SEQ ID NO: 203406 - protein, 77 aa, Triticum aestivum
  unsure (1)..(77): unsure at all Xaa locations
  Clone ID: PAT_TA_97824.pep
KXTXSRGXYVLPXQXKXXXGXGWSPXGLXXLXXCXXGXXXIGXFVPXGXFXRTXRLLNREERAXVVQGMGIRHKKSG

SEQ ID NO: 203407 - protein, 119 aa, Triticum aestivum
  unsure (1)..(119): unsure at all Xaa locations
  Clone ID: PAT_TA_97825.pep
MADRGGYVQVQHGQYGGGHHGGQQQHGRQMGEQXKGMFQEKALTVXTLFPLGGLXXVLSGLGLXGXVVGXGRCQAXXSXSLNPXXGPGAXNNXLXXNGFLXLXPLGLGGXSXLNXFSKX

SEQ ID NO: 203408 - protein, 107 aa, Triticum aestivum
  unsure (1)..(107): unsure at all Xaa locations
  Clone ID: PAT_TA_97826.pep
KSYREGLMSPQTETKAGVGFKAGVKDYKLTYYTPEYETKDTDILAAFRVSPQPGVPPEEAGAAVAAESSTGTWTTVWTDGLTSLDRYKGRCXYHIEPCGEQANGCYV

SEQ ID NO: 203409 - protein, 120 aa, Triticum aestivum
  Clone ID: PAT_TA_97827.pep
RLAIDAMAPPSPPAHAARRVPPPCWTPEETVALARAYTARRLAVGRAHLSSADWAAVAAAATPSKTARQCRHKVEKLRRRLRFKRRPPLPILGDKARRPFVVPLLPIPFPPPASPPPPAK

SEQ ID NO: 203410 - protein, 115 aa, Triticum aestivum
  unsure (1)..(115): unsure at all Xaa locations
  Clone ID: PAT_TA_97828.pep
MARGLKKHLKRLNAPSHWMLDKLGGAFAPKPSSGPHKARECLPLILILRNRLKYALTYREVQSILMQRHIXGXMGKVRTDKTYPAGFMDIISIPXDVKNASVMTPGSLPPSLLSG

SEQ ID NO: 203411 - protein, 110 aa, Triticum aestivum
  unsure (1)..(110): unsure at all Xaa locations
  Clone ID: PAT_TA_97829.pep
WKGSASKPYVELPPHTAPLGMGVGPAXACAVKVVARAQAENQSTXXLTQFHHXDLTHPDNPCDGNNHRXRQYPXXPLAAXYNGYNKNXSPXLQPAINPSIHXXXIFPNPH

SEQ ID NO: 203412 - protein, 137 aa, Triticum aestivum
  unsure (1)..(137): unsure at all Xaa locations
  Clone ID: PAT_TA_97830.pep
MASTSCFLHQSTARLAASARPAPAVGRTQLFVCKAXKNDEAAXDAAVVTXERAALSLLAXAAAVAVKVSPAAAAYGEXANVFGKAXXNTDFVXYXAGEGFKLXIPGPKXEPPARERXFPLGKVLRYXGQFDQNPLPF

SEQ ID NO: 203413 - protein, 117 aa, Triticum aestivum
  unsure (1)..(117): unsure at all Xaa locations
  Clone ID: PAT_TA_97831.pep
MAEHKEEPVAESMMDKISDKFHGGDSSSSSSDSDDEKKGSAAGVKAKIYRLFGREKPVHXVLGGGKPAYLVLRRNXXVSXGVLAGXYCHPGWLFQVMEXHXXTLGGQPSPWELLPCP

SEQ ID NO: 203414 - protein, 135 aa, Triticum aestivum
  unsure (1)..(135): unsure at all Xaa locations
  Clone ID: PAT_TA_97832.pep
MKTFLILALLAIVATTATTAVRVPVPQLQPQNPSQQQPQEQVPLVQQQQFLGQQQPFPPQQPYPQPQPFPSQQPYLQLQPFPQPQLPYXRKPQPFRPKQPXYPQPQPQXYSQXQEPISQXQQQXPQQQPSTNFNN

SEQ ID NO: 203415 - protein, 76 aa, Triticum aestivum
  unsure (1)..(76): unsure at all Xaa locations
  Clone ID: PAT_TA_97833.pep
MAAEGGGVRALSQREQDIQMMLAADVHLGTKNCDFQMEPLRXQSRRNLTELKSIXXGXTXXKXQXAXRXNXSNXNP

SEQ ID NO: 203416 - protein, 108 aa, Triticum aestivum
  unsure (1)..(108): unsure at all Xaa locations
  Clone ID: PAT_TA_97834.pep
PTPKTSPHLAPLPRRRRRRRGHRASPCPIAMAAPTAFAAARFLPSAHLDSSARLAPLRAAPTSNLAFSPLPASSSALLALRSASPXPSGPGGKAAPAPRPRRSYXGXG

SEQ ID NO: 203417 - protein, 142 aa, Triticum aestivum
  unsure (1)..(142): unsure at all Xaa locations
  Clone ID: PAT_TA_97835.pep
GIFSKIAKPLTXIFKKDNKFKWTEECEASFQELKKCLVTAPVMILPDIRKDFQVYCDASHLGLGGVLMQDGRVVSYASRQLRPHELNYAMHDLELATVVHALKTWRHFLIGNQCDVYMDHKSSKYIFTRKELNLRQRRWLEL

SEQ ID NO: 203418 - protein, 72 aa, Triticum aestivum
  unsure (1)..(72): unsure at all Xaa locations
  Clone ID: PAT_TA_97836.pep
VLVNANPPVKTLLILTILAMATTIXTANMQVDPSGQVQWPQXXSFPQPPTTILXRXPXQTIPXPHQIFHXQP

SEQ ID NO: 203419 - protein, 75 aa, Triticum aestivum
  unsure (1)..(75): unsure at all Xaa locations
  Clone ID: PAT_TA_97837.pep
MAEEKHHHHLFHHKKEGEDFQPAADXGVNMYGYSTETVVTATGNEGEYERXTKEEKHHKHKEHLRQXGARRPRLP

SEQ ID NO: 203420 - protein, 109 aa, Triticum aestivum
  unsure (1)..(109): unsure at all Xaa locations
  Clone ID: PAT_TA_97838.pep
MAAATMALSSPAMAGTPVKASRAAPFGEGRITMRKTAGKPKVAASSSPWYGSDRVLYLGPLSGDPPEXTXPGSSPGXITGWDNAGVVEPERQRVARVIQGPWLRGGSPD

SEQ ID NO: 203421 - protein, 57 aa, Triticum aestivum
  unsure (1)..(57): unsure at all Xaa locations
  Clone ID: PAT_TA_97839.pep
MKTFFLLAFXXLVVSTAIAQYAXVPRPXAQAPNAGGFGERVAIAPKCLVLKISKENN

SEQ ID NO: 203422 - protein, 152 aa, Triticum aestivum
  unsure (1)..(152): unsure at all Xaa locations
  Clone ID: PAT_TA_97840.pep
ESSTRGNPNHHRLIERRRGGAAEMETXSSGFAGFKIYTIDEXGASRPAGGTRGVATTGKEVSSSSKVXASTRXEGRGLRDANPDXLRKGNGGSANFFGDSFNLSAWXRXNPPPRDXQKXSGXRSPXKPVFALGNTLPSXGGXAGSFRTXXXC

SEQ ID NO: 203423 - protein, 109 aa, Triticum aestivum
  unsure (1)..(109): unsure at all Xaa locations
  Clone ID: PAT_TA_97841.pep
PFTQLENKHYLTQINHEEIPRPCPHCCRGDHHXRRTLYCIPXCLGAATSIISGASXQFRSHKEHPVPHQKLNPCRGCPPTTVVXQLLDMSXPPVTXXGATXGNXLGXXG

SEQ ID NO: 203424 - protein, 74 aa, Triticum aestivum
  unsure (1)..(74): unsure at all Xaa locations
  Clone ID: PAT_TA_97842.pep
MDATAEIHNVASMRRDSGSIWRRGDDVFSRSSRDEDDXEALRWAALEKLPTYDRVRRAILPPLDGGEGAAPGAA

SEQ ID NO: 203425 - protein, 117 aa, Triticum aestivum
  unsure (1)..(117): unsure at all Xaa locations
  Clone ID: PAT_TA_97843.pep
WRPRTQHDCTAPAADRPRAELTPRPDQIPRRPPPQISPRAPLPDPAPSTWIFNKEVLPAVVRVWKLVGCCFLLPSALWRRGTGGRLGLGGEXFQPGERLGRLTSXXAPSXSNXNCKK

SEQ ID NO: 203426 - protein, 81 aa, Triticum aestivum
  unsure (1)..(81): unsure at all Xaa locations
  Clone ID: PAT_TA_97844.pep
MKTFLVFALLAVAXTSAIAQMXTRCIPGLXRPXXQQXLPPXQIFXQQXLFSQXXXXFPQXPSFSQASXPPFWAXNXXPFSQ

SEQ ID NO: 203427 - protein, 81 aa, Triticum aestivum
  unsure (1)..(81): unsure at all Xaa locations
  Clone ID: PAT_TA_97845.pep
VDISDEDDGGGDEXEGGDDDDDXDDXDDDXEDDDQVDEEEEPEEELGTEYLVQPLXXAXDDKHXTXFXXTXXGHGAXDXGD

SEQ ID NO: 203428 - protein, 68 aa, Triticum aestivum
  unsure (1)..(68): unsure at all Xaa locations
  Clone ID: PAT_TA_97846.pep
AARERKGRKAVCVLFIPFVRRRSRGDXRRRPLWAAARXXXGXAXLPPPQGRXMRXXXRXRGXLIGXQX

SEQ ID NO: 203429 - protein, 116 aa, Triticum aestivum
  unsure (1)..(116): unsure at all Xaa locations
  Clone ID: PAT_TA_97847.pep
GLSQGVRLPGPAGRRASRFIVRASSAEAEAAGRRAVLGLMASGVVGSAFAQVVHAGTVAAIKVGPPPPLSGGLPGTDNSDXARDFDLPLXEPXXTLQPLPXGXRAAVGRDPILKRT

SEQ ID NO: 203430 - protein, 97 aa, Triticum aestivum
  unsure (1)..(97): unsure at all Xaa locations
  Clone ID: PAT_TA_97848.pep
QPGYYPTSPQQSGQWQQPGQGQQPGQGQQSGQGQQGQQPGQGQRPGQGQHXXXPISPQQPGXGXQSGXGXXGYLPLCGRPLAARGVSNPKGPTNGSA

SEQ ID NO: 203431 - protein, 104 aa, Triticum aestivum
  unsure (1)..(104): unsure at all Xaa locations
  Clone ID: PAT_TA_97849.pep
VQDAGFKAAIVYDNENSGVLVSMAGSSSGIQIYAVFISKVSGEVLKKFSGRTDVEVWIIPTFENSXWAIMAISFISLLAMSAVLAXLFSLXRKTSEAGTGNRIP

SEQ ID NO: 203432 - protein, 122 aa, Triticum aestivum
  unsure (1)..(122): unsure at all Xaa locations
  Clone ID: PAT_TA_97850.pep
SQRTGKSLRRRRRRRRRRSAILSGLSSSSLPPCLHLSRRGAASPPPKHHPIRTRLHRESISPPPPPPPCSASVAASSCGSSLPPPXPXGPPLQRPXXRRGXXAAPXFXLKTLXFWXAGXXTL

SEQ ID NO: 203433 - protein, 153 aa, Triticum aestivum
  unsure (1)..(153): unsure at all Xaa locations
  Clone ID: PAT_TA_97851.pep
PXXXKGXGXAAPEXXGARXTGXLLXRRGGEXAGNXQPAGSAXXRQXXGPAXRTXVDKPLPRRRRAPAGRRALEEVEPPLVCPSVXLXCFCGEAMAGGADCFVPGDLPGGGRWQVRRRAGRAGGGGDQHRVGXRGGRAGREPDGAGAPSAPILA

SEQ ID NO: 203434 - protein, 114 aa, Triticum aestivum
  unsure (1)..(114): unsure at all Xaa locations
  Clone ID: PAT_TA_97852.pep
SPSRCSSSSTDPPLCRWTPRRRAGRRCPTTTASSSPTAPRSPSPPPPAPRPPPPPRPPPPSRRTTRPTPTPAPPSSSRPPCPPPAGCLPPPNAGGPXPFRGXREGXXPSPVQAF

SEQ ID NO: 203435 - protein, 74 aa, Triticum aestivum
  unsure (1)..(74): unsure at all Xaa locations
  Clone ID: PAT_TA_97853.pep
MAAKCYPTVSDEYLAAVAKAKRKLRGFIAEKNCAPLMLRLAWHSAGTFDVAXKTGGPFGNXXCPAGXAXGQTPK

SEQ ID NO: 203436 - protein, 101 aa, Triticum aestivum
  unsure (1)..(101): unsure at all Xaa locations
  Clone ID: PAT_TA_97854.pep
LAXXXLXXXRLKXRXRSLLLCXHQXRTXVNHMDXGNFXRXGPRSSLSGAILGDHAASXPKGASIRQQRPVGXWTSAVAIASRGCKKMPGVAEXGYXKVVLV

SEQ ID NO: 203437 - protein, 114 aa, Triticum aestivum
  unsure (1)..(114): unsure at all Xaa locations
  Clone ID: PAT_TA_97855.pep
IAIAXMQVDPGXQVKWTQXXPFPQPXQPFCQQPQQTIPQPHQTFHHQPQXTYPHXPXXXFPQXPXXPXQPFPQPQQXFPXQPXLXPFPXQFXAXISXKXQQCPTTIXPRSKAIQ

SEQ ID NO: 203438 - protein, 48 aa, Triticum aestivum
  unsure (1)..(48): unsure at all Xaa locations
  Clone ID: PAT_TA_97856.pep
MAQPAELSREENVYMAKLAXQAERYEEMVXESWXKVAKTVXSXAHSRR

SEQ ID NO: 203439 - protein, 121 aa, Triticum aestivum
  unsure (1)..(121): unsure at all Xaa locations
  Clone ID: PAT_TA_97857.pep
MKTFLILALLAIVATTATIAVRVPVPQLQPQNPSQQQPQEQVPLVQQQQFPGQQQPFPPQQPYPQPQPFPSQQPYLQXLQPFPQPQLPYPQAGNYHIPQAFRPPNQPTINPTRQPNNQPNF

SEQ ID NO: 203440 - protein, 119 aa, Triticum aestivum
  unsure (1)..(119): unsure at all Xaa locations
  Clone ID: PAT_TA_97858.pep
MGLKNNMVVLKVCLVLLFLVGGTTSASLRLSELGLLMKSDHHQHSNDDESSKPCCDQCACTKSNPPQCRCSDMRLNSCHSACKSCICALSYPAQXCFCVDITDFCYEPCKPXEDDKENY

SEQ ID NO: 203441 - protein, 161 aa, Triticum aestivum
  unsure (1)..(161): unsure at all Xaa locations
  Clone ID: PAT_TA_97859.pep
RTPSSPPPAPLRLTRRRRLYAARSASASPSCVVAAFPCCHTPSPLPLQDLIFTPAAGSEAQLLHLPQGGGDLRRLDLKRSCSTFLRVAGISGSLRRGRARPAGGRCGQXGNCVGDIVXVGRPKGKGATXGTQLAGPMQXAKPXPLPVVRPXAXAWXXRKXA

SEQ ID NO: 203442 - protein, 138 aa, Triticum aestivum
  unsure (1)..(138): unsure at all Xaa locations
  Clone ID: PAT_TA_97860.pep
MQIFVKTLTVKTITLEVESSDTINNVKAKIQDKEGIPPDQQRLIFAGKQLEDGRTLADYNIQXKESTLHLVLRLRGGMXIFVKDXSPGKTITLGVGSSGQQXTIVKXEXFKDKGXEXPPGPNXVRNFLPGKQLRNGQW

SEQ ID NO: 203443 - protein, 142 aa, Triticum aestivum
  unsure (1)..(142): unsure at all Xaa locations
  Clone ID: PAT_TA_97861.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKXDKGAAQFEGWCKKVGQSLPQAKDAPMFVGGVNEG

SEQ ID NO: 203444 - protein, 135 aa, Triticum aestivum
  unsure (1)..(135): unsure at all Xaa locations
  Clone ID: PAT_TA_97862.pep
MQIFVKTLTGKTITLEVESSDTIDNVKAKIQDKEGIPPDQQRLIFAGKQLEDGRTLADYNIQKESTLHLVLRLRGGXCKIFVKTLTGKTITLGGRRAPTPFDNVKGKIKXTKEGIPPDQASXXIFAGQATWRDWA

SEQ ID NO: 203445 - protein, 100 aa, Triticum aestivum
  unsure (1)..(100): unsure at all Xaa locations
  Clone ID: PAT_TA_97863.pep
GTVDEASDGTIQLGRGAIGNIXSVNNRFEKGDELXGQLKRLVQAGVDGVTXNLXWGXVXEGKXPKGXXWSXXXQXFXLVXXAXPEXXKPXSHXXNXGGTR

SEQ ID NO: 203446 - protein, 145 aa, Triticum aestivum
  unsure (1)..(145): unsure at all Xaa locations
  Clone ID: PAT_TA_97864.pep
MKTFLIFALLAIVATSAIAQMENSHIPGLERPSQQQPLPPQQTLSHHQQQQPIQQQPQPFSQQQPCSQQQQQPLSQQQQPPFSQQQPPFSQQQXXNHYRRQQQPPFSQXQTTIFGSXXQXPPFXXAAQLTSNHRDTNPPVFTPNF

SEQ ID NO: 203447 - protein, 130 aa, Triticum aestivum
  unsure (1)..(130): unsure at all Xaa locations
  Clone ID: PAT_TA_97865.pep
MSCCGGNCGCGSGCKCGNGCGGCKMFPDVEATAGAAAMVMPTASHKGSSGGFETAGETGGCDCTTCKCGTRVRLLLLQLATEPAPKEAGPAKAKHEGXGGTXXAKHHQPPXSXXHPVINPAIARAPPPLN

SEQ ID NO: 203448 - protein, 150 aa, Triticum aestivum
  Clone ID: PAT_TA_97866.pep
INFFFCGTAFSENLKMKSFLLVALLAVAAAASVITNEAPEEPEVLEIPEGLEVADVDEVAGMSELAVITSMVKDEAEIPWQPSFAPRRGLSVGNIGSADRLMSRTTHSRMAVANQILTQDVTYRGSASTIITAIRVQVIGSSQGATGSVG

SEQ ID NO: 203449 - protein, 80 aa, Triticum aestivum
  Clone ID: PAT_TA_97867.pep
DSLDADVIQSYMEFSLASMLFYALKEGACSEQSSRMTAMDNASKNAGEMIDKLTLTFNRTRQAVITRELIEIISGAAALE

SEQ ID NO: 203450 - protein, 53 aa, Triticum aestivum
  unsure (1)..(53): unsure at all Xaa locations
  Clone ID: PAT_TA_97868.pep
XXXKTKRGFKIXKFXLASKKLLKSNSXHXXPSTQSGPIXEAENYPTXIGISIL

SEQ ID NO: 203451 - protein, 138 aa, Triticum aestivum
  unsure (1)..(138): unsure at all Xaa locations
  Clone ID: PAT_TA_97869.pep
KVYIYIENKSSSTKTTTMTTPAKLYGRELSTYDEVDVDELLAKLSQEELTMLAKEVDPXDDNFLPPSQRNNYDCEKDPTGPLNRKKLIEHINKQALXTPNRXGIKPYVXGVVRGKXWIPPPGXXKVRDXEEQISIELG

SEQ ID NO: 203452 - protein, 68 aa, Triticum aestivum
  Clone ID: PAT_TA_97870.pep
MDQIAKFVEPGKQFAKDSIRLVRRCTKPDRKEFQKIAIATAIGFCIMGFIGFFVKLIHIPINNIIVGS

SEQ ID NO: 203453 - protein, 101 aa, Triticum aestivum
  unsure (1)..(101): unsure at all Xaa locations
  Clone ID: PAT_TA_97871.pep
MSNLADPVAFAKDFLAGGISAAVSKTAVAPIERVKLLLQVQXTSSKQXAADQRYKGIIDAFVRIPKEXGPLSFWRGNLPNVIKYFPNQALNFAXKGKYKAS

SEQ ID NO: 203454 - protein, 101 aa, Triticum aestivum
  unsure (1)..(101): unsure at all Xaa locations
  Clone ID: PAT_TA_97872.pep
MISNLFSIFDPSTNLFNIPFNXIRTILGIIFIPYSFXLIPNRHFLLXNFILLKLHNEFKTLLKNNYFXGXTFIFXIQIFTFNLIKKFLGXFPLNFHKLFTT

SEQ ID NO: 203455 - protein, 129 aa, Triticum aestivum
  unsure (1)..(129): unsure at all Xaa locations
  Clone ID: PAT_TA_97873.pep
MPDSGPSLCSVLNPMESLIYWRSAAHSGAALGAGLALLVALACCSVVSVLAYASLLALSAAVAFRIYKNVLQAVQKTNDGHPFKWLLERDISVPAERAXSLAGAANAQLNAALAELRKLFLVEDLVDSL

SEQ ID NO: 203456 - protein, 142 aa, Triticum aestivum
  unsure (1)..(142): unsure at all Xaa locations
  Clone ID: PAT_TA_97874.pep
MPFARFVEPGRVALVADGPLKGKLVSVVDVIDQTRALVDGPCSGVSRQQLRLNQLHLTKFRLSYPFTAPTRVVRKAWTDAKLTEKWTESQWATKLXANKEKRAQITDYERFKXLSSARVKRKRARTAVFKKLEGEREPAVPS

SEQ ID NO: 203457 - protein, 139 aa, Triticum aestivum
  unsure (1)..(139): unsure at all Xaa locations
  Clone ID: PAT_TA_97875.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQXQRCEAIHNVVHAIILQQQQXXVQSYFQPNLKKQTKG

SEQ ID NO: 203458 - protein, 103 aa, Triticum aestivum; identical to SEQ ID NO: 187895
  Clone ID: PAT_TA_97876.pep

SEQ ID NO: 203459 - protein, 129 aa, Triticum aestivum
  unsure (1)..(129): unsure at all Xaa locations
  Clone ID: PAT_TA_97877.pep
MALPRVYFDVSADGSALGRIVVELRTDVTPKTCENFRALCTGEKGFGYKGSTFHRVIPNFMLQGGDFTNHNGTGGKSIYGEEVPLTRTSSLKHTXPXGVLSMANAGSNTNGXQFFIXNRELPGLDGKFG

SEQ ID NO: 203460 - protein, 128 aa, Triticum aestivum
  unsure (1)..(128): unsure at all Xaa locations
  Clone ID: PAT_TA_97878.pep
GLFPYIFTRTXSHLTLSLSISLPLXLSFIIYGXLNNSQHIFIHIIPQGTPTILIPFIVLIETIRNIIRPGTLAVRLTANIIAGHLLITLLRGNGPNIRSYFIIILILIQILLLILESAVAVIQSYVIA

SEQ ID NO: 203461 - protein, 68 aa, Triticum aestivum
  unsure (1)..(68): unsure at all Xaa locations
  Clone ID: PAT_TA_97879.pep
IDSESETDPLWLQQKTMMMIDEFTDVNEGEXEXMXXXXLHVMKYNYXGDCQXPIXCQXFLHMLGKXLL

SEQ ID NO: 203462 - protein, 147 aa, Triticum aestivum
  unsure (1)..(147): unsure at all Xaa locations
  Clone ID: PAT_TA_97880.pep
QPEKSGSSGSKPAEKKPATAKTPAAAPKAASTSSAAAPKPASAKTPAPAPKAAAPKAAPAAKPAAAKPSIRPGGXSLQQAASKPAEKKPASVPTAKPGSAKXAALKAKSXAKPSXKKAATASKPKPKPXXXKLKIPQPKTNKGKKQI

SEQ ID NO: 203463 - protein, 56 aa, Triticum aestivum
  Clone ID: PAT_TA_97881.pep
SRVKIVCVIKGLPWLSETSILVSYVDILILILINKLVPLDGSHGTISCKFKIKTSN

SEQ ID NO: 203464 - protein, 109 aa, Triticum aestivum
  unsure (1)..(109): unsure at all Xaa locations
  Clone ID: PAT_TA_97882.pep
MATETLIPLESNPEVMNKFLQKLGVSSQWGIVDVMGLEPEMLSWVPRPVLSVMLLFPVSDAYEEHKQKEESDILSKGQEVSSNIFYXKQFISNACGTVALVQSVANNTE

SEQ ID NO: 203465 - protein, 114 aa, Triticum aestivum
  unsure (1)..(114): unsure at all Xaa locations
  Clone ID: PAT_TA_97883.pep
MWWCCTSSASSGPMAAIRKKLVIVGDGACGKTCLLIVFSKDQFPEVYVPTVFENYVADIEVDGKQVELALWDTGGQEDYDRLRXAVVPDTDXILMCFSGWTRPDSLEEHPREVD

SEQ ID NO: 203466 - protein, 103 aa, Triticum aestivum
  Clone ID: PAT_TA_97884.pep
MAVPIRNLSRFKDVLKLGSVSVRYSSEYASTNTNLLLTKDTKVIIQGFTGKQGTFHAQQAIEYGTNIVGGVSPKKAGKEHLGKPVFGTVREAMAATGATATAI

SEQ ID NO: 203467 - protein, 96 aa, Triticum aestivum
  unsure (1)..(96): unsure at all Xaa locations
  Clone ID: PAT_TA_97885.pep
MTTTEENAEIDWGNERLSRAQRAVEANTYDVDSWSLLIREXAQTRPINEVRXMYEKLITAFPTTGRYWXYILNKEMKARNFEKVXEKLFQRCLMKI

SEQ ID NO: 203468 - protein, 95 aa, Triticum aestivum
  Clone ID: PAT_TA_97886.pep
SISKLHPSLVAVGKLHPSLVAVGKLYPTLVAVGKLHSTLVAVGKVDASTVVVYDLEPGVIAFSYVDSTLIVIYNAYTTVIDLNTHCGFKIRQKSK

SEQ ID NO: 203469 - protein, 42 aa, Triticum aestivum
  unsure (1)..(42): unsure at all Xaa locations
  Clone ID: PAT_TA_97887.pep
LILYXNVKLNFFLKKLGYRLKTXNISFPINXLKYFXYNNFYN

SEQ ID NO: 203470 - protein, 116 aa, Triticum aestivum
  unsure (1)..(116): unsure at all Xaa locations
  Clone ID: PAT_TA_97888.pep
MSDEYFYGVTLSTSHQSETWDPEAKADYPRSNKLLIRQALLGPDAKADELNVVQVETMSLQEAVKIPVAVLKAGESRHARLDIEFPDAPXTFTLIQGXGPVHLIGQQLVGALVEGV

SEQ ID NO: 203471 - protein, 137 aa, Triticum aestivum
  unsure (1)..(137): unsure at all Xaa locations
  Clone ID: PAT_TA_97889.pep
MADKDKKVKKKKAKEDAPAEEAPAAAAPAATGGSDRQSSRGSRKAKRTGSNVFSMFSQKQVAEFKEAFQLMXTTTRDGIIGKNDXLRATFDSLGRLASEKELRRXGRLRXSXPINFNQLPEPPSRNRKSGRFTRDDV

SEQ ID NO: 203472 - protein, 127 aa, Triticum aestivum
  unsure (1)..(127): unsure at all Xaa locations
  Clone ID: PAT_TA_97890.pep
MSWQDYVDKQLMASRCVTKAAIAGHDGNVWAKSEGFEISKDEVAKMVAGFDNESLLTSGGLTIAGTRYIYLSGXDRIIRAKLGKVGVHCMKTQQAVXISLYEEPIQPQQAASXSGEXLGDYLIXCXY

SEQ ID NO: 203473 - protein, 56 aa, Triticum aestivum
  Clone ID: PAT_TA_97891.pep
TFPQINWNTSIQTISIKLSTSLSRYNKTKNCFPLILVISFLSLLIISINSCDQNLE

SEQ ID NO: 203474 - protein, 101 aa, Triticum aestivum
  unsure (1)..(101): unsure at all Xaa locations
  Clone ID: PAT_TA_97892.pep
MKGAKSKGAVKADTKLAVKSKGAEKPAAKGKKGKAGKDPNKPKRAPSAFFVFMGEFXEEFKXXNPXNKSVAAVGKSGRVRGGKSXXXSEKGPYVCXRATSR

SEQ ID NO: 203475 - protein, 132 aa, Triticum aestivum
  unsure (1)..(132): unsure at all Xaa locations
  Clone ID: PAT_TA_97893.pep
SVDCGPAPSRAAEKGPTPSASCDIALYNTNMKILPLFILVACVVCSARGQDEERPAAPSRGLLKRGSLAKGKPTTTTTTPAPQEEAEYEDEGDYPAEGEASRRPRPKLPRPPPKGRKXVXXRASXPFKKXTT

SEQ ID NO: 203476 - protein, 139 aa, Triticum aestivum
  Clone ID: PAT_TA_97894.pep
KYLLIRMAAEVKQRVVKDSKNEEKTESGNNTKPKYWEPLTDGVKWIEKYASNLENFFERLPEFISTFIATLAVFTFGATLRGEWVVILVASAEAAERSHTKQYKCDDKCTGFVFVQKPEDGELQPHLQWGHNTGSFAMS

SEQ ID NO: 203477 - protein, 75 aa, Triticum aestivum
  Clone ID: PAT_TA_97895.pep
KINKIKMFAARSLFKANAQILKNVAQTRNMSVIATPARNKVSTGEMVFLISAMVVGWSAIPAWVLINIKNYRVKE

SEQ ID NO: 203478 - protein, 45 aa, Triticum aestivum
  Clone ID: PAT_TA_97896.pep
EKQSFIAILVDETVLLNYVDTLINCIFYITKKKKKKKKKKKKKKK

SEQ ID NO: 203479 - protein, 90 aa, Triticum aestivum
  unsure (1)..(90): unsure at all Xaa locations
  Clone ID: PAT_TA_97897.pep
GVFLPINKMSAPIIITVPNNYLAMESVEELDSKVVVELPSPAPSKKRRLDHLTREGENAKKETEEPRNXSNFXRXKEXENGXNGKVXXNX

SEQ ID NO: 203480 - protein, 115 aa, Triticum aestivum
  unsure (1)..(115): unsure at all Xaa locations
  Clone ID: PAT_TA_97898.pep
MAENPIYGPFFGVMGAASAIIFSALGAAYGTAKSGTGIAAMSVMRPELIMKSIIPVVMAGIIAIYGLVVAVLIAGSLDAPSNNYTLYKGFIHLGAXGLAVSFSGLXAGFAIGILX

SEQ ID NO: 203481 - protein, 115 aa, Triticum aestivum
  unsure (1)..(115): unsure at all Xaa locations
  Clone ID: PAT_TA_97899.pep
SRKRRNGGRAKHGRGHVKAVRCTNCARCVPKDKAIKKFVIRNIVEAAAVRDINEASVYASFQLPKLYAKLHYCVSCAIHSKVVRNRSKKNRRIRTPPKXSTFPRDMQRPQNVQRK

SEQ ID NO: 203482 - protein, 82 aa, Triticum aestivum
  unsure (1)..(82): unsure at all Xaa locations
  Clone ID: PAT_TA_97900.pep
VMYRRQMAPALATPVLAGALCPPSASRDGRSALRFALTLPCLRTTPAKRRPLVPTDVFNXTXIQPNXGTKXFTAFFFNIFLL

SEQ ID NO: 203483 - protein, 74 aa, Triticum aestivum
  Clone ID: PAT_TA_97901.pep
MGLLAAIAVNVVGGAVIYGTGGLLAPVVAPMLGFGSAGIAAGSTAAAAQAYYGNLAAGSIISQLTAAAMVAPTP

SEQ ID NO: 203484 - protein, 151 aa, Triticum aestivum
  unsure (1)..(151): unsure at all Xaa locations
  Clone ID: PAT_TA_97902.pep
LDNLRARFSAGYIYTYVGSILIALNPFKFYPIYNPKYVKLYQNKRIGGSSLPPHIFAVADAAYHCMLRERTNQCIVISGESGSGKTESTNFLLHHLTALSQKGSHGSGVEQTILSAGPXVLEAFGNAKTAHNNNSSRFGKFIQVNYKGEWD

SEQ ID NO: 203485 - protein, 39 aa, Triticum aestivum
  Clone ID: PAT_TA_97903.pep
TTVNLWVYKSIQCIFEFFSYCYQTFRIMLGFLIVIQICN

SEQ ID NO: 203486 - protein, 124 aa, Triticum aestivum
  Clone ID: PAT_TA_97904.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFRVH

SEQ ID NO: 203487 - protein, 90 aa, Triticum aestivum
  Clone ID: PAT_TA_97905.pep
VWEVFCLGDRILSRSTHTRNAVANTVLTQDVRYQGTNAIIVLAVRVNVVGASQGATASVVDGALGRNFITIRLQSARGRGFNYIVEIWGR

SEQ ID NO: 203488 - protein, 97 aa, Triticum aestivum
  Clone ID: PAT_TA_97906.pep
MARLSVVCIALLVILAYLEVSYAARIARSPQYFGGYGRPPPPLPPPHGFGPGCGPFGPQRPDFDDHRGHGHHSHGHHGHESKYDIPEGGSIKYFEDD

SEQ ID NO: 203489 - protein, 132 aa, Triticum aestivum
  unsure (1)..(132): unsure at all Xaa locations
  Clone ID: PAT_TA_97907.pep
MKLLAVTLLAFAAVVSARNIDLEDVIDLEDITAYDYHTKIGIPLAEKIRLAEEEAERNPSRIVGGSNSNLGAFPYQAGLLASFSGGQGVCGGSLLNVRRVLTAAHCWFDGPNQASNFTVVLXGXVRLFSGGD

SEQ ID NO: 203490 - protein, 56 aa, Triticum aestivum
  unsure (1)..(56): unsure at all Xaa locations
  Clone ID: PAT_TA_97908.pep
SPKQKDEXIIEGNSLEDXSSSXALIQQSTTVKNKDIRKXXDGXYVFXKTTVXAXEI

SEQ ID NO: 203491 - protein, 53 aa, Triticum aestivum
  unsure (1)..(53): unsure at all Xaa locations
  Clone ID: PAT_TA_97909.pep
IIKIIYNSNKLMDWLQNSTVRXVSVGDLASLINACCVRLFLXFFLLFLFFFLL

SEQ ID NO: 203492 - protein, 60 aa, Triticum aestivum
  unsure (1)..(60): unsure at all Xaa locations
  Clone ID: PAT_TA_97910.pep
NSIYLAKILKWQHLIKVSTXDLNRLLSGSFSCLHCNFRTIIKTSHYXKXFISFHFTISQV

SEQ ID NO: 203493 - protein, 138 aa, Triticum aestivum
  unsure (1)..(138): unsure at all Xaa locations
  Clone ID: PAT_TA_97911.pep
MSGGLDILALNEEDVTKMLAATTHLGSENVNFQMETYVYKRRADGTHVINLRRTWEKLVLAARAVVAIENPADVFVISSRPFGQXRAVLKFAAHTGATPIAGRFTPGAFTNQIQAAFREPSLLIVLDPGQEHQANTEX

SEQ ID NO: 203494 - protein, 138 aa, Triticum aestivum
  unsure (1)..(138): unsure at all Xaa locations
  Clone ID: PAT_TA_97912.pep
MALKRINRELQDLGRDPPAQCSAGPHGEDLFHWQATIMGPVDSPYQGGVFFLTIHFPTDYPFKPPKVAFTTRIYHPNINSNGSICLDILRSQWSPALTISKVLLSICSLLCDPNPDDPLVPEIAXIYKTXREKYNELT

SEQ ID NO: 203495 - protein, 139 aa, Triticum aestivum
  unsure (1)..(139): unsure at all Xaa locations
  Clone ID: PAT_TA_97913.pep
MSAKLQDYKDSLERGLNDKSKPWTKYFETAEQKTGVNRVYIFVGMVAFTGLYLVFGFGAELICNSIGFVYPAYMSMKALESPQKDDDTKWLTYWVVYACFSVVEYFSDFIVGWFPLYWANKXCSSVIWCYLPTDFNGSP

SEQ ID NO: 203496 - protein, 143 aa, Triticum aestivum
  unsure (1)..(143): unsure at all Xaa locations
  Clone ID: PAT_TA_97914.pep
MKFFVAFVAVLAVAAAQYRPQAQPGKPIAVTSRVNNNDAAANVLRYDSDSAPDGSYNYALEIDNGIAAQAQGTPRDFGGNPPIVPVVSQGSFSWTSPEGXSPSSISYIADENGYQASGDAIPTPPXNPEGNARSLGLTPRKGK

SEQ ID NO: 203497 - protein, 102 aa, Triticum aestivum
  unsure (1)..(102): unsure at all Xaa locations
  Clone ID: PAT_TA_97915.pep
MKSFVALLAVVAVVAADVSHLSAHPDAAAQILKQDADVLPDQFQYAYETSNGIAAQESGVLQKVGDQEAIAVQGSNSYTAPGGEQIXLSYVADANGYQPQGG

SEQ ID NO: 203498 - protein, 148 aa, Triticum aestivum
  unsure (1)..(148): unsure at all Xaa locations
  Clone ID: PAT_TA_97916.pep
MGIDINHKHDRKVRRTEVKSQDVYLRLLVKLYRYLARRTNAKFNQIILRRLFMSRINRPPLSLSRLARHMKKPTREGMIAVVVGSITNDVRLYKVPKLTVAALHVTEKARARILAAGGEILTFDQLALRAPNGAKTVLLQGPRNXREG

SEQ ID NO: 203499 - protein, 41 aa, Triticum aestivum
  Clone ID: PAT_TA_97917.pep
LVFSQILNHLSTKFHFEQFSSCIPSTCDFTCFLKNFLPGTG

SEQ ID NO: 203500 - protein, 152 aa, Triticum aestivum
  unsure (1)..(152): unsure at all Xaa locations
  Clone ID: PAT_TA_97918.pep
KLAKMVNNRVPSVFSKTYVTPRRPFEKARLDQELKIIGEYGLRNKREVWRVKYTLARIRKAARELLTLEEKDPKRLFEGNALLRRLVRIGVLDEKQMKLDYVLGLKIEDFLXERRLQTQVFKGGLAKSIHQARFLIKQKTKSAFRKASCEQS

SEQ ID NO: 203501 - protein, 107 aa, Triticum aestivum
  unsure (1)..(107): unsure at all Xaa locations
  Clone ID: PAT_TA_97919.pep
MNSLLRKAAIEYLKTNARSSTHAATAGGHGGGYKLWKKMTFFVAFPAVGLGMLNAYLAHQEHAHAAQPEFVPYDFMRIRSKRFPWGDGQKSLFHNPHVNALPXGYEH

SEQ ID NO: 203502 - protein, 136 aa, Triticum aestivum
  Clone ID: PAT_TA_97920.pep
LNTQHPLEQKGIVVKQIFTKIGKMKFVISLVVLSCAVFEARGYPYAYYPSYGNVDTFSYGDASRGGMALSRYYNPYYNPSAVGGGMAAFMVRQPEAQATPSQSGQYYVPDRRRQTQQEVNYAPPQQNEVYYPQQPG

SEQ ID NO: 203503 - protein, 35 aa, Triticum aestivum
  Clone ID: PAT_TA_97921.pep
FFFFFFFFFFFFFFFFFFFFFFFNVKLPQNICNKS

SEQ ID NO: 203504 - protein, 140 aa, Triticum aestivum
  unsure (1)..(140): unsure at all Xaa locations
  Clone ID: PAT_TA_97922.pep
MGRMHAPGKGISQSALPYRRSVPTWLKLTADDVKEQIFKLGKKGLTPSQIGVMLRDSHGVAQVRFVTGKKILRIMKAMGLAPDLPEDLYYLIKKAVAMRKHLERNRKDKDSKFRLILVESKIHRLARYYKXQRSVLPPNW

SEQ ID NO: 203505 - protein, 137 aa, Triticum aestivum
  Clone ID: PAT_TA_97923.pep
FVRFIIYRKLLVKQVPRAKIALQHNLGLGGAVVVTMYRKGFADITPRAVAASGNPEDFKVFKYMKILEEAMENDTENLIEKVRGIYGFKVRNGPNGSEGYWVINAKEGKGKVTYNGSEKPDVTFTISDEDVVDLISG

SEQ ID NO: 203506 - protein, 62 aa, Triticum aestivum
  unsure (1)..(62): unsure at all Xaa locations
  Clone ID: PAT_TA_97924.pep
VLGLRGCSKRVTAGPGAQRAXRKEQRWVLSQVKSPDNSPSRCPPKSREGGNNWINWFPFKKK

SEQ ID NO: 203507 - protein, 116 aa, Triticum aestivum
  Clone ID: PAT_TA_97925.pep
KMGRYSREPDNPAKSCKARGSNLRVHFKNTYETAMAIRKLPLRRAVRYLKNVTEKKECIPFRRFNGGVGRCAQAKQFGTTQGRWPKKSAEFLLQLLRNAESNADYKGLGMFDKLVI

SEQ ID NO: 203508 - protein, 133 aa, Triticum aestivum
  unsure (1)..(133): unsure at all Xaa locations
  Clone ID: PAT_TA_97926.pep
MKTLLILTIIAVALTTTTANIQVDPSGQVQWPQQQQPFPQPQQPQQIFPQPQQTFPHQPQQAFPQPQQTFLHQPQQQFPQXPQEPQQPFPQQPQQQFPQAQQTXQPFPQQPQQQFPQAQTTXTNNFPKXXQTX

SEQ ID NO: 203509 - protein, 72 aa, Triticum aestivum
  unsure (1)..(72): unsure at all Xaa locations
  Clone ID: PAT_TA_97927.pep
RTAFDVKIEKYXAAPKIKIIKEVRAMTDLGLKEAKELXVEKAPVVVRAGLPKEEAEALAAKLKAAGAAVALE

SEQ ID NO: 203510 - protein, 142 aa, Triticum aestivum
  unsure (1)..(142): unsure at all Xaa locations
  Clone ID: PAT_TA_97928.pep
GRNRGSSGSLPSWTRGRIRARGPLLGCLQAGERGGLXIGRRGRNRCRGGHRRGGGRRWQLATCEHSGHGCSCCKKRTMDMSTRERTREERGDGAGTQGPAGAAACCDGGSGRANQGGAVGSLGWWVEENEENGSRGGSRPGG

SEQ ID NO: 203511 - protein, 84 aa, Triticum aestivum
  unsure (1)..(84): unsure at all Xaa locations
  Clone ID: PAT_TA_97929.pep
PKAGYRXVSKXSLSWVHFGXGRRRXCXSLVKRLSRVHCCXXPTAMTCFVLVGPRIYMSPANPLRLGVRASPPVAPPRRXRKIAA

SEQ ID NO: 203512 - protein, 124 aa, Triticum aestivum
  unsure (1)..(124): unsure at all Xaa locations
  Clone ID: PAT_TA_97930.pep
MKTLLILTILAMAITIATANMQVDPSGQVQWPQQQPFLQPHQPFSQQPQQIFPQPQQTFPHQPQQQFPQXPQQPQQQFLQPRQPFPQQPQQPYPQQPQQPFPQXTQQPQQPFPQSKQPQQPFPQ

SEQ ID NO: 203513 - protein, 142 aa, Triticum aestivum
  Clone ID: PAT_TA_97931.pep
SMATTIRSGVTITICTAWAAIRPCRRLPLDRTRRLLQLQPPYLSTAFSPQVRCQGVWRSRVRCTSDTSGAPPVTAPGTSDAAAADEVLLETPGSFRIYRSGKIDRLNDPTILPAGVDEATGVASKDVVLDAGKGPLRAPLTS

SEQ ID NO: 203514 - protein, 75 aa, Triticum aestivum
  unsure (1)..(75): unsure at all Xaa locations
  Clone ID: PAT_TA_97932.pep
MRECISIHIGQAGIQVGNACWELYCLEHGIQAXDAKMPGDKTVGGGDDAFNTFFSETGAGKHVPRAVFRRRAHCD

SEQ ID NO: 203515 - protein, 76 aa, Triticum aestivum; identical to SEQ ID NO: 185994
  Clone ID: PAT_TA_97933.pep

SEQ ID NO: 203516 - protein, 154 aa, Triticum aestivum
  unsure (1)..(154): unsure at all Xaa locations
  Clone ID: PAT_TA_97934.pep
XIXVQXXQFIXISXXXSTXXIXAXSXSXKKCHNSEPSTWLSTFQRATIHHKIVVQGPPSREQEKWRRSFMTKEHFYLASFLHTVRARFDLVSVGCKSQAMQELAGRXLLCXGGWXARXQEARSMAFXPLPFLLCKXRXNXXYINPLFDNXLPGY

SEQ ID NO: 203517 - protein, 139 aa, Triticum aestivum
  Clone ID: PAT_TA_97935.pep
QGLSLPCPLLLPPLPGTELTPCGKKPGDRYYWCILWSSRQCSEWQEIYPAMLDSVRSWSLPRPPSPASPGLLACNTGACVRKESQSSSVVLFRMDAKHVTPAKASTIVDFSRIALLMLATILMLFVFLLGNVCPDTGQS

SEQ ID NO: 203518 - protein, 123 aa, Triticum aestivum
  unsure (1)..(123): unsure at all Xaa locations
  Clone ID: PAT_TA_97936.pep
MKTFLILALLAIVATTATTAVRVPVPQLQLQNPSQQQPQEQVPLVQEQQFPGQQQPFPPQQPYPQPQPFPSQQPYLQLQPFPQPQLSYPQPQXFRPQQPYPQPQXQXYSQXQQPISQQAGSKQ

SEQ ID NO: 203519 - protein, 97 aa, Triticum aestivum
  unsure (1)..(97): unsure at all Xaa locations
  Clone ID: PAT_TA_97937.pep
QQPPFLQQQQPVLPQQPPFSQQQQQFPQQQQPLLPQQPPFSQQQPPFSQXKQQQPPFSQQQQQPILPQQPPFSQHQQPVLPQQQIPSVQAILSWQAS

SEQ ID NO: 203520 - protein, 109 aa, Triticum aestivum
  unsure (1)..(109): unsure at all Xaa locations
  Clone ID: PAT_TA_97938.pep
EFPLGAARWAVRAATTXFKKGTRFAVAGPSEDKAGFHPGQHSPPPNATPQQPRRPHGHGLRAAPSHGLCPRAPRYHHQGRRLGIQDLDTTSPEIHRYPNQRDEPKGPAF

SEQ ID NO: 203521 - protein, 111 aa, Triticum aestivum
  unsure (1)..(111): unsure at all Xaa locations
  Clone ID: PAT_TA_97939.pep
PSSSGPPSDRRAAAMDQQVFLGVSWGDLLTYLKRNSGMDPELVVYGHNLVLSYVYDYIPDPPVSPIATLSLSGLPWVPDGVERISWLPEKVLRKIVLPGPRQGRRXARGXP

SEQ ID NO: 203522 - protein, 76 aa, Triticum aestivum
  unsure (1)..(76): unsure at all Xaa locations
  Clone ID: PAT_TA_97940.pep
KXXLXNXTATFRRXXNVSGSSGDSACIRASDSSEIRDVAKXFPDLGXPVVGTASTSSSIKDHLHHNRVRSFELWLP

SEQ ID NO: 203523 - protein, 85 aa, Triticum aestivum
  unsure (1)..(85): unsure at all Xaa locations
  Clone ID: PAT_TA_97941.pep
SIPFGPSISLSPSPILLQPRPPPRPGRRGGAPSPPIHPPAPPSSSPSPNPPXPSTPPSPAPPSPATKHHSASPHLTPTKTWAQGV

SEQ ID NO: 203524 - protein, 103 aa, Triticum aestivum
  unsure (1)..(103): unsure at all Xaa locations
  Clone ID: PAT_TA_97942.pep
MXTFLIFALLAVAATSAIAQMETSHIPSLEKPLQQQPLPLXQILWYQXXXPIQXXPXPFPQQPPCSQQXQPPLSXQXQEPPFSQXQPPFXMQQHXVLXQEXPF

SEQ ID NO: 203525 - protein, 121 aa, Triticum aestivum
  unsure (1)..(121): unsure at all Xaa locations
  Clone ID: PAT_TA_97943.pep
SAIAQMETSHIPSLEKPLQXQPLPLQQILWYQQQQPIQQQPQPFPQQPPCSQQQQPPLSQQQQPPFSQQQPPFLQQQQPVLPQQPPFSQXQQQQFPQATTFTGTNNQVLPQQQSVQAILAA

SEQ ID NO: 203526 - protein, 112 aa, Triticum aestivum
  Clone ID: PAT_TA_97944.pep
MKTLLIVTILAMATTIATANMQVDPGYQVQWPQQQPSSQVSYQQPQEQYPSGQGSFQSSQQNPQAQGSVQPQQLPQFQEIRNLALQTLPAMCNVYIPPYCSTTIAPFGIFRY

SEQ ID NO: 203527 - protein, 126 aa, Triticum aestivum
  unsure (1)..(126): unsure at all Xaa locations
  Clone ID: PAT_TA_97945.pep
MKTFLILALLAIVATTATIAVRVPVPQLQPQNPSQQQPQEQVPLVQQQQFPGQXQQPFPPQQPYPQPQPFPSQQPYLQLQXPFPXPQLPYPASRIYHIRRPQPFSXHKXPYPTNXQPNSSAKQKFQ

SEQ ID NO: 203528 - protein, 115 aa, Triticum aestivum
  unsure (1)..(115): unsure at all Xaa locations
  Clone ID: PAT_TA_97946.pep
MAPKAAEKKPVEKTPAGKKPKAEKKVPASKEGGGEKKGKXKAMKSVEXYNIYIFKVLKQVHPDIXISSXAMSIMXSFIQRHLLSAGSGAPPVIKCLISLSRKSSGVPHGFCPPFS

SEQ ID NO: 203529 - protein, 127 aa, Triticum aestivum
  unsure (1)..(127): unsure at all Xaa locations
  Clone ID: PAT_TA_97947.pep
MSGRKKTREPKEENVTLGPAVREGEHVFGVAHIFASFNDTFIHVTDLSGRETLVRITGGMKVKADRDESSPYAAMLASQDVAVRCKELGITGSAQLSSVATGGNKTXTXPGPGASSXRLRALGTFWA

SEQ ID NO: 203530 - protein, 126 aa, Triticum aestivum
  unsure (1)..(126): unsure at all Xaa locations
  Clone ID: PAT_TA_97948.pep
PQQQQIPQQPQXFPQQQFPQXQQFPQQQEFPQQQFPQQQFHQQQLPQXQFPQXQFPQQXFPQXQQFPQQXQXNATTFPPXTASPLNRXQFPQQXFPQXPXXRXFPQAXNFQXPVPTPRQXTRXFPH

SEQ ID NO: 203531 - protein, 92 aa, Triticum aestivum
  unsure (1)..(92): unsure at all Xaa locations
  Clone ID: PAT_TA_97949.pep
MKGAKSKGAVKADTKLAVKSKGAEKPAAKGKKGKXGXDPNXPXRXPSAFFVFMGEXFREEFXQKXXKNXVPSPARKKPGPVEGGLTFVKKWP

SEQ ID NO: 203532 - protein, 88 aa, Triticum aestivum
  unsure (1)..(88): unsure at all Xaa locations
  Clone ID: PAT_TA_97950.pep
KKQWYDIKAPLLFTSRNVGKTLVSRTQGTKIASEGLKHRVFEVSLADLQNDEDXAYRKIRLRAEDVQGMNVLNNFWGMDFNTDKAVPL

SEQ ID NO: 203533 - protein, 139 aa, Triticum aestivum
  unsure (1)..(139): unsure at all Xaa locations
  Clone ID: PAT_TA_97951.pep
MAPTVMASSATSVAPFQGLKSTAGLPVSRRSNGASLGSVXSNGGRIRCMQVWPIEGIKKFETLSYLPTLXXEXLLKAXGXLIRSKWVXCLEFXXVRFIFRXKMXXPGXKXGRYXXTMXELAMFGXPAPXXXXNEVEEGK

SEQ ID NO: 203534 - protein, 119 aa, Triticum aestivum
  unsure (1)..(119): unsure at all Xaa locations
  Clone ID: PAT_TA_97952.pep
PSIQARXPGXKGQQGQLXQXSSTTGQXKGQQGXYPSLFSSSQDKGQQRXYPAXLQQXPGQGQQGHYTASLQQXGQGQQGHYPASLQQVGQGQQIGQLGQRQQPGQGQQTRQGQQLEQGQ

SEQ ID NO: 203535 - protein, 94 aa, Triticum aestivum
  unsure (1)..(94): unsure at all Xaa locations
  Clone ID: PAT_TA_97953.pep
DSLLLPRRVIKASKLLWXSXAASXLKISAFPKXFSXVLKXXKYXETXEWVKXXGDSAIXGITXXAQDQLGXVXYVELPKVGXAXVXXGXNFGCC

SEQ ID NO: 203536 - protein, 69 aa, Triticum aestivum
  unsure (1)..(69): unsure at all Xaa locations
  Clone ID: PAT_TA_97954.pep
PXEXXPXXRPLXIXGGATTXQQPXDGXEERGRGGAGGRRAGXDPVTRXXLPYXAASMLESREAGGRGLR

SEQ ID NO: 203537 - protein, 136 aa, Triticum aestivum
  unsure (1)..(136): unsure at all Xaa locations
  Clone ID: PAT_TA_97955.pep
MAPTVMASSATSVAPFQGLKSTAGLPVSRRSNGASLGSVSNGGRIRCMQVWPIEGIKKFETLSYLPPLSTEALLKQVDXLIRSXKWVPCLEVQQRVGFNLPLSKNASPGVTNERAGLLQLLESCLCFGLPTPKQGD

SEQ ID NO: 203538 - protein, 108 aa, Triticum aestivum
  unsure (1)..(108): unsure at all Xaa locations
  Clone ID: PAT_TA_97956.pep
MKTFLILALLAIVATTATTAVRVPVPQLQPQNPSQQQPQEQVPLVQQQQFLGQQQPFPPQQPYPQPQPFPSQQPYLQXLQPFPXPQLPYSQXQPFRTTNHIPQTGNQQ

SEQ ID NO: 203539 - protein, 108 aa, Triticum aestivum
  unsure (1)..(108): unsure at all Xaa locations
  Clone ID: PAT_TA_97957.pep
QQHSIAYGSSQVLQQSTYQLVQQLCCQQLWQIPEQSRCQAIHNVVHAIILHQQQQQQQQQQQKQPLSQVSFQQPQQQYPSGQGSFQPSQXKNPQAQGSVQPQQTGPKF

SEQ ID NO: 203540 - protein, 130 aa, Triticum aestivum
  Clone ID: PAT_TA_97958.pep
EGLKKLKKSAVDGDINESIDDESNKASERGKGIERLSAISDLMEKINKARTEEDLKPCLEMKTQLFNLDEGASVKDLQDNEMHENETVVTDVVPAEGLDYSLPKFVTTTEIDLETLNTIDKHFSTDIEQL

SEQ ID NO: 203541 - protein, 53 aa, Triticum aestivum
  unsure (1)..(53): unsure at all Xaa locations
  Clone ID: PAT_TA_97959.pep
GLDGQHXWIKXHXXXVDXGDEXXPLGXVDAVGXSLDRLPHLAPPKTKXQNPSR

SEQ ID NO: 203542 - protein, 110 aa, Triticum aestivum
  unsure (1)..(110): unsure at all Xaa locations
  Clone ID: PAT_TA_97960.pep
PPVHAAAHQRRRRRRRRSRPAAAQNHQAHSPPLPGRQEAAASPCRRGRPGTRXXEEEDEKDLAELRKNEEEERLEETQSXAAWXAXPKRPRRGEATRDPGGRKXRXIKRA

SEQ ID NO: 203543 - protein, 105 aa, Triticum aestivum
  unsure (1)..(105): unsure at all Xaa locations
  Clone ID: PAT_TA_97961.pep
MKTFLVFALIAVVATSAIAQMXXXCISGLERPWQQQPLPPQQSFSQXPPFSQQQQQPLPQQPSFSQATTTIFXQQXILSQGTTIFTSNNNQVLPQQSPFSEQQXN

SEQ ID NO: 203544 - protein, 129 aa, Triticum aestivum
  unsure (1)..(129): unsure at all Xaa locations
  Clone ID: PAT_TA_97962.pep
MKTLFILTILAMATTIATANMQVDPSGQVQWPQQQPFRQPQQPFYQQPQQTFPQPQQAFPHQPQQQFPQPQQPQQQFPQPQQPQQPFPQPQQAQLPFPQQPQQPFPQPQQPQQPFPQSQXPQQPFPQAP

SEQ ID NO: 203545 - protein, 140 aa, Triticum aestivum
  unsure (1)..(140): unsure at all Xaa locations
  Clone ID: PAT_TA_97963.pep
TFPPRFWAGGAXLQRXPRTAGCAVSPGKKEKAERPRERXPFSTPLXFGDAARACPXRFPVPXFCPXPQFIPVASVGERRACRGWSGRQLVGREREEREKPRRLPEPGELLIYTTAVRGRAGARVHAYSAQSGEESGGKQG

SEQ ID NO: 203546 - protein, 119 aa, Triticum aestivum
  unsure (1)..(119): unsure at all Xaa locations
  Clone ID: PAT_TA_97964.pep
ARCRVGKINRSPQRFFSFFAGSCFLTTTKQSLPGSLIITRVTDGLGLRIVLPCLAQRHPCARRGCSLLRQRSSSTRRDSTRSTVVLLVPLDHYNNGPSNIWLGSTXTLLATLIRNNQGP

SEQ ID NO: 203547 - protein, 136 aa, Triticum aestivum
  unsure (1)..(136): unsure at all Xaa locations
  Clone ID: PAT_TA_97965.pep
MAAPRGAAVVLAMVLAAMVVAPPATVHAAISCSTVYSTLMPCLQYVQQGGSPARGCCTGIQNLLAEANNSPDRRTICGCLKNVANGASGGPYITRAAALPSKCNVALPYKXKPQRRTATRFTERTEAAFGPLFRRY

SEQ ID NO: 203548 - protein, 108 aa, Triticum aestivum
  unsure (1)..(108): unsure at all Xaa locations
  Clone ID: PAT_TA_97966.pep
XGGFXXCWGKYLLGKLMXMGGLXXGEXXXLEKXLWXLGDLLVHGGXXVXAGRFVXCENSRCSNXXWGXCCXWELLLGGLXXLGEMXLLGEXLLGELLWRAGGFDXXGG

SEQ ID NO: 203549 - protein, 148 aa, Triticum aestivum
  unsure (1)..(148): unsure at all Xaa locations
  Clone ID: PAT_TA_97967.pep
MKTFLVFALIAVVATSAIAQMETSCISGLERPWQQQPLPPQQSFSQQPPFSQQQQQPLPQQPSFSQQQPPFSQQQPILSQQPPFSQXQQQPXVLPQQSPFSXKQQQLVLPPQQQXQQQLVQTSKIPIGSSHPVLQQAXPMAKYSSQVA

SEQ ID NO: 203550 - protein, 153 aa, Triticum aestivum
  unsure (1)..(153): unsure at all Xaa locations
  Clone ID: PAT_TA_97968.pep
QPQQPQQPFPQPQQPFPWQPQQPFPQTQQSFPLQPQQPFPQQPQQPFSQPQLQFPQQPEQIIPQQPQQPFLLESQQPFPQXXPQQPFSQPQQLIPMQPQQXXSPRXXQQSQQTFSRGPNNYFLXLXQPIPQATNKQTXSPLQTGXQPFPPSWQ

SEQ ID NO: 203551 - protein, 125 aa, Triticum aestivum
  unsure (1)..(125): unsure at all Xaa locations
  Clone ID: PAT_TA_97969.pep
MARTKQTARKSTGGKAPRKQLATKAARKSAPATGGVKKPHRFRPGTVALREIRKYQKSTELLIRKLPFQXRLVREIAQDFKTDLRFQSSAVSALQGGAXXYLVRASFEXHQPIQAKGHQSWPKNP

SEQ ID NO: 203552 - protein, 143 aa, Triticum aestivum
  unsure (1)..(143): unsure at all Xaa locations
  Clone ID: PAT_TA_97970.pep
LLILTILAMATTIATANMQVDPSGXVQWPQQQPFPQPQQPFCQHPQQTIPQPHQTFHHQPQXQTFPQPQQTYPHQPQQQFPQTQXPQXPFPQPQANIPPXKPPTTNFPNNPXQPXPPSLKXPQKXHFPQVTTXXPTXLXXQGP

SEQ ID NO: 203553 - protein, 67 aa, Triticum aestivum
  unsure (1)..(67): unsure at all Xaa locations
  Clone ID: PAT_TA_97971.pep
IGXARXIGXXXPQENPLFLIRASQKISLGPKTSRSNLDRGSQINPIAAEKPGQGALNKKTTISTFRP

SEQ ID NO: 203554 - protein, 115 aa, Triticum aestivum
  unsure (1)..(115): unsure at all Xaa locations
  Clone ID: PAT_TA_97972.pep
MARGLKKHLKRLNAPSHWMLDKLGGAFAPKPSSGPHKARECLPLILILRNXRLKYALTYREVQSILXXRHIMVXGKVRTXKTYPAGFKXNNSXPKTGEEXXLXYDXKGLAICQGM

SEQ ID NO: 203555 - protein, 138 aa, Triticum aestivum
  unsure (1)..(138): unsure at all Xaa locations
  Clone ID: PAT_TA_97973.pep
FLXXXSAPPRGFSXNTRPPLXFVXDNGRAPXPSGSXXVCWXGFXXFLCXXXCRRLLLGFXNLDGGRXLDFGLHRRGGFLRLRDLLGGDRLLHRGRXPPSARPMGSGHQRWPLPSWMQENDRSGRGWLAEASATLIREC

SEQ ID NO: 203556 - protein, 89 aa, Triticum aestivum
  unsure (1)..(89): unsure at all Xaa locations
  Clone ID: PAT_TA_97974.pep
MGGGNAQKSKMARERNLEKLKGGKGSQXLEANKKAMNIQVQDMHADFHAPTSESKVRSTPGKHPKATSLPPQRDICQIGEKGNQYSRLV

SEQ ID NO: 203557 - protein, 87 aa, Triticum aestivum
  unsure (1)..(87): unsure at all Xaa locations
  Clone ID: PAT_TA_97975.pep
IGCFIGYRKGITLQTRWQDKEIFKARTSRXLYSMVTIFMSILYKRLIWTXRITXTLMXQQLTPSLESSKXANTXISKIDVLDQXFQX

SEQ ID NO: 203558 - protein, 107 aa, Triticum aestivum
  Clone ID: PAT_TA_97976.pep
MGKEKTHINIVVIGHVDSGKSTTTGHLIYKLGGIDKRVIERFEKEAAEMNKRSFKYAWVLDKLKAERERGITIDIALWKFENTKYYCTRHLMLLGNRDFNQRNKIYW

SEQ ID NO: 203559 - protein, 149 aa, Triticum aestivum
  unsure (1)..(149): unsure at all Xaa locations
  Clone ID: PAT_TA_97977.pep
VHPSILXQLNPCKVFLQQXCXPVAXPQSLARSQMLXXSSCHVMQQQCCQQLPXIPQQSRYEAIRAIIYSIILQEQXQVQGSIQTPQQQPQQLGQCVSQXQQQSQQXLGQQPQQQQLAQGTFLQPQQXILSFEVMTSNALRXTLPTMCRX

SEQ ID NO: 203560 - protein, 135 aa, Triticum aestivum
  unsure (1)..(135): unsure at all Xaa locations
  Clone ID: PAT_TA_97978.pep
QPPFSQQQQPPFSQQQQQPPFTQQQQQQQQQQPFTQQQQPPFSQQPPISQQQQPPFLQQQRPPFSRQQQIPVIHPSVLQQLNPCXVFLQQQCILWQMQAMSLARVPNGWQAAICQWWMSQQWFAVCGPGNPPWSP

SEQ ID NO: 203561 - protein, 115 aa, Triticum aestivum
  unsure (1)..(115): unsure at all Xaa locations
  Clone ID: PAT_TA_97979.pep
MGRRPARCYRQIKNKPYPKSRYCRGVPDPKIRIXDVGMKKKGVDEFSHCVHLVSWEEGECXSEALEAARIAXCTSYMTKALQGKDAFHLKGSRGSTRSNVPLSNRLLFLAPGIAT

SEQ ID NO: 203562 - protein, 116 aa, Triticum aestivum
  unsure (1)..(116): unsure at all Xaa locations
  Clone ID: PAT_TA_97980.pep
ASRQILHASPAAAPPTSPPPPRPAVAPDKTGRPPPXPDPHATRDSPTHPLPPPPSHLPARLPPPPPAGTLARRAGAQXAGPPRXADGGGGVTLPIFAVLRRDRLLLHGLSSPGLDG

SEQ ID NO: 203563 - protein, 146 aa, Triticum aestivum
  unsure (1)..(146): unsure at all Xaa locations
  Clone ID: PAT_TA_97981.pep
MKTFLVFALLAVAATSAIAQMETRCIPGLERPWQQQPLPPQQTFPQQPLFSQQQQLFPQQPSFSQQQPPFWQXQQPPFSQXQQPILPQETTIFRSNNKLVXLPQQPTIFTSXQXNQVFTFQKQSPFPXNNNNHQQWGAKKPGWFKP

SEQ ID NO: 203564 - protein, 123 aa, Triticum aestivum
  unsure (1)..(123): unsure at all Xaa locations
  Clone ID: PAT_TA_97982.pep
MARGAAAAAAAAKGKKKGSVSFVIDCTKPVEDKIMEIASLEKFLQERIKVAGGKAGXSGDSVTVTRDKSKVTVNSDGAFSKEGTSSTLTKKYFKEXQTWGDWLRXVXQPTKERXXFXSGYXNX

SEQ ID NO: 203565 - protein, 118 aa, Triticum aestivum
  unsure (1)..(118): unsure at all Xaa locations
  Clone ID: PAT_TA_97983.pep
MARTKQTARKSTGGKAPRKQLATKAARKSAPTTGGVKKPHRYRPGTVALREIRKYQKSTELLIRKLPFQRLVREIAQDFKTDLRFQSHAVLXALQEAAEAYLVXGLFEDTKPCAPSTP

SEQ ID NO: 203566 - protein, 54 aa, Triticum aestivum
  Clone ID: PAT_TA_97984.pep
KCHFVAIDIFNGKKLEDIVPSSHNCDVPHVDRQDYQLIDITDDGICQPSQLKSG

SEQ ID NO: 203567 - protein, 96 aa, Triticum aestivum
  unsure (1)..(96): unsure at all Xaa locations
  Clone ID: PAT_TA_97985.pep
SAALSCGQVDSKLAPCVAYLTGRASSISKECCSGVQGLNGLARSSPDRKIACRCLKSLATSIKSINMGKVSGVPGKCGVSVPFPIXSMSTNCNNVN

SEQ ID NO: 203568 - protein, 74 aa, Triticum aestivum
  unsure (1)..(74): unsure at all Xaa locations
  Clone ID: PAT_TA_97986.pep
RIXKKXXXKXXXGXVNNREXRKKTXXVIPXXKTXXTXWMIXFXPLGDALVLADRHGCRCGWSGGAAASGGLSVG

SEQ ID NO: 203569 - protein, 130 aa, Triticum aestivum
  unsure (1)..(130): unsure at all Xaa locations
  Clone ID: PAT_TA_97987.pep
MAAPRGAAVVLAMVLAAMVVAPPATVHAAISCSTVYSTLMPCLQYVQQGGSPARGCCTGIQNLLAEANNXSPDRRTICGCLKNVANGASGGPYITRAAALPSXXANVALPYXIKPQAVECNSXQNELKRL

SEQ ID NO: 203570 - protein, 93 aa, Triticum aestivum
  unsure (1)..(93): unsure at all Xaa locations
  Clone ID: PAT_TA_97988.pep
RNASIAFDESEEEEEDETNDLWFVIGQEEVACERSCIAALAKPLNTLLYGGFAEARRDHIDFSRDGISARGMRAVAXLQADTXRLDDFPPDTM

SEQ ID NO: 203571 - protein, 131 aa, Triticum aestivum
  unsure (1)..(131): unsure at all Xaa locations
  Clone ID: PAT_TA_97989.pep
HQSTLKTFLVFALLALAAXSAVAQISQQQQAPPFSQQQHPPFSQQQXPPFSQQQXSPFSQQXXXTTICRSXQQPPFSQQPPXSQQQQPPFSQATAXHIXHRHXXPPYSQXXQAPYSQQQXPPFSVKNQPIR

SEQ ID NO: 203572 - protein, 131 aa, Triticum aestivum
  unsure (1)..(131): unsure at all Xaa locations
  Clone ID: PAT_TA_97990.pep
MKTFLVFALLAVAXTSAIAQMXTRCIPXLXRPWQQXPLPPQXXFPQQPLFSQXQQLFPQQPSFSQQQPPFWXATTTIFSXXQPXLPQQXPFSXQQQRVLPXQPPFSQXTTSQFYLPQQSXFSTTSNHHQPC

SEQ ID NO: 203573 - protein, 126 aa, Triticum aestivum
  unsure (1)..(126): unsure at all Xaa locations
  Clone ID: PAT_TA_97991.pep
MXRLNSKAVAAAVVLAAVVLMMAGREASAALSCGQVDSKLAPCVAYVTGRASSISKECCSGVXGLNGLARSSPDRKIACRCLKSLATXSIKSIXNMGKVSGVPGQVAGVXSVPSPSSMSTTCNNVN

SEQ ID NO: 203574 - protein, 126 aa, Triticum aestivum
  unsure (1)..(126): unsure at all Xaa locations
  Clone ID: PAT_TA_97992.pep
MANPRVFFDMTVGGAPAGRIVMELYKDAVPRTVENFRALCTGEKGVGKSGKPLHYKGXSAFHRVIPDFMCQGGDFTKGATAPEAXSIYGEXFADEXFXPQGXTNPGESXPWXNXGAXXQRXPXFFL

SEQ ID NO: 203575 - protein, 79 aa, Triticum aestivum
  unsure (1)..(79): unsure at all Xaa locations
  Clone ID: PAT_TA_97993.pep
CRPSVPXGLDXEXVVVPGLPHHRRANQSTDHSINQTDSRRSGAGSRAPPPPEISCCCCCSASRRGGRGGGMGGRRGCGG

SEQ ID NO: 203576 - protein, 132 aa, Triticum aestivum
  unsure (1)..(132): unsure at all Xaa locations
  Clone ID: PAT_TA_97994.pep
MARLNSKAVVAAVVLAAVVLMMAGREASAALSCGQVDSKLAPCVAYVTGRASSISKECCSGVQGLNGMARXSSDRKIACXCLKEASPTXSIKVQSTMGKVXRRGPAKCXVKCAFPXXAMSNKLANTVQSSNI

SEQ ID NO: 203577 - protein, 90 aa, Triticum aestivum
  unsure (1)..(90): unsure at all Xaa locations
  Clone ID: PAT_TA_97995.pep
MARGVAAATKGGAGAGKKKGSVTFVIDCTKPVDDKIMEIASLXXFLQERIXVAGGKXGXSGDXVTVAXDKSXVTVTSGRGLLQXXYLKYL

SEQ ID NO: 203578 - protein, 147 aa, Triticum aestivum
  unsure (1)..(147): unsure at all Xaa locations
  Clone ID: PAT_TA_97996.pep
QQPFPQTQQPQQPFPQLQQPQQPFPQPQQQLPQPQQPQQSFPQQQRPFIQPSLQQQLNPCKNILLQQCKPASLVSSLWSIIWPQSDCQVMRQQCCQQLAQIPQQXSKCAAIHSVVHSIIMQQQQQQQQXKQGMHXFLPLSKXANRVG

SEQ ID NO: 203579 - protein, 134 aa, Triticum aestivum
  unsure (1)..(134): unsure at all Xaa locations
  Clone ID: PAT_TA_97997.pep
MKTLLILTILAMATTIATANMQVDPSSRVQWPQEQPPPQSQQPFSQQPQQIFPQPQQTFPHQPQQAFPQPQXTFPRRPQQQFPQPQQPQXNHFLSPXQPQLPFPQQPXXSFPQPQQPPTTNFPKSQQPTTTFFP

SEQ ID NO: 203580 - protein, 111 aa, Triticum aestivum
  Clone ID: PAT_TA_97998.pep
EISPSPKPSPPPWPQPPPPPSHSRAPPPPPPPYPNPPASLSRATSPPRAARSPPASSGAAPRPPPPPPSRLPPPRSGRGAPPSPAKGADILVELERCHRRRLRLLGGRVQW

SEQ ID NO: 203581 - protein, 78 aa, Triticum aestivum
  Clone ID: PAT_TA_97999.pep
RLYTRMPSSSGVVGAFVEDLDAALHLVHLHPRLPHRRRRGRPPRHREAPSRAGRGGPQLLHSSRLAALISSAVVSVLC

SEQ ID NO: 203582 - protein, 94 aa, Triticum aestivum
  unsure (1)..(94): unsure at all Xaa locations
  Clone ID: PAT_TA_98000.pep
MSDTDEHHFESKADSGASKTYPQQAGAIRKGGHIVIKARPCKVVEVSTSKTGKHGHAKCHFVAIDIFNGKKLEDIVPSSXNCDVPHVDRQRLTS

SEQ ID NO: 203583 - protein, 90 aa, Triticum aestivum
  unsure (1)..(90): unsure at all Xaa locations
  Clone ID: PAT_TA_98001.pep
AQAIPVFSMSCFKLPEXSLCDHIKSFIRKFWWGCKQGERKPAWVSWDVMTRPKHLGGLGFXDLEIFNLSLLVRQAWRLLQEPTSLEWQKY

SEQ ID NO: 203584 - protein, 102 aa, Triticum aestivum
  unsure (1)..(102): unsure at all Xaa locations
  Clone ID: PAT_TA_98002.pep
IKARPCKVVEVSTSKTGKHGHAKCHFVAIDIFNGKKLRDXVPSSPQTCDVXPHVDRQDYQXLIDITDDGYVNLLTXEXGTLRDDLXLPTDXVLLGQXXTGIC

SEQ ID NO: 203585 - protein, 50 aa, Triticum aestivum
  Clone ID: PAT_TA_98003.pep
LHSEQVQPLIHQLTKKCLFLIRNNNEIGLERKVNAAKKGREVSSLTLQKR

SEQ ID NO: 203586 - protein, 128 aa, Triticum aestivum
  unsure (1)..(128): unsure at all Xaa locations
  Clone ID: PAT_TA_98004.pep
MATTAMALSPSSFAGKAVKDLPSSALFGEARVTMRKTAAKAKPVSSGXSPWYGSDRVLYLGPLSGDPPSYLTGEFPGDYGXWDTAGLSADPETFAKKRGAGGDHCRWAMLGAXLGCVFPGACPRKRSL

SEQ ID NO: 203587 - protein, 151 aa, Triticum aestivum
  unsure (1)..(151): unsure at all Xaa locations
  Clone ID: PAT_TA_98005.pep
REREREREREREREREISXXXLPPFSQXQSPFSQQQQIVLQQQPPFLQQQQPSLPQQPPFSQQQQXLXLPXQQIPFVHPSILXQLNPCKVFLQAAIAPLWALPQSLARSAHVXXRSSCHVAATXTVXXQVCRQNPPSQSPLIEAXXLLIHX

SEQ ID NO: 203588 - protein, 148 aa, Triticum aestivum
  unsure (1)..(148): unsure at all Xaa locations
  Clone ID: PAT_TA_98006.pep
PLPPSSISLPPQPPQTLAPFPTIQPSLPLLHPTSIVSRRRRYGSSVHRLRPCRWPVSFRLDLLHGLPSSPPIPCCPRCSSSQVVRKAAWGMEPPRRARWGEAFGFXQGGLPGGPKEGVCGGVRAXRTLLAXXRPQLKFGESWLPAIXX

SEQ ID NO: 203589 - protein, 145 aa, Triticum aestivum
  unsure (1)..(145): unsure at all Xaa locations
  Clone ID: PAT_TA_98007.pep
GXXRXXSXAVXPSRRAAAXPXQSDDXDERLRASARXDAARAMANCTEASKGSLAAPDADEDTAVRHAAGYGVDEQMAVMFTPDASVDETTVTLPPRTLEAVVSCCSPAVARAASVARASTMATASCVRRRQLVPPCIPIVPAAKR

SEQ ID NO: 203590 - protein, 120 aa, Triticum aestivum
  unsure (1)..(120): unsure at all Xaa locations
  Clone ID: PAT_TA_98008.pep
MARLNSKAVAAAVVLAAVVLMMAGREASAALSCGQVDSKLAPCVAYVTGRASSISKECCSGVQGLNXLARXXPDRKIXCXXLKXSLXTXIKSINMGKVSRXXPGXCGVXXXPSPIXMFQP

SEQ ID NO: 203591 - protein, 109 aa, Triticum aestivum
  unsure (1)..(109): unsure at all Xaa locations
  Clone ID: PAT_TA_98009.pep
MASIAGSAVSFAKPVKAINTNSLSFSGARRGNAFLRLQPXVPMRFAVCCSXKXDTXVEKVCEIVKKXLAVPEXXKVCGTXKFSXDLGAXSXGXVQXCXGALRREFXXXV

SEQ ID NO: 203592 - protein, 104 aa, Triticum aestivum
  unsure (1)..(104): unsure at all Xaa locations
  Clone ID: PAT_TA_98010.pep
MDYLKTVVPSQLLAERGSNLVVINPGSMNVRMGFASQDVPFNIPHCIARHKNDAPKLSVRDQXLNCRAGSTHNAERERAYDIIASXLKIPFLGEVSPSXEPITS

SEQ ID NO: 203593 - protein, 112 aa, Triticum aestivum
  Clone ID: PAT_TA_98011.pep
NPVSLVSSLVSMILPRSDCQVMQQQCCQQLAQIPRQLQCAAIHSVVHSIVMQQEQQQGIQILRPLFQLVQGQGIIQPQQPAQYEVIKIGIEPPRGTARGKTDRREGHGFPCG

SEQ ID NO: 203594 - protein, 126 aa, Triticum aestivum
  unsure (1)..(126): unsure at all Xaa locations
  Clone ID: PAT_TA_98012.pep
LFSSHHLTTSGRADTVLAKPTSTXPSSPPLPSPPTNSRTGTTPLQRSKPHLDSYSSSPFLPPPLSPNLPPARFHRQPRPPPAPSPCATPVPPPPRXLRAPPCTGPTPRPGSGYAYSLRAVLLLPKP

SEQ ID NO: 203595 - protein, 80 aa, Triticum aestivum
  Clone ID: PAT_TA_98013.pep
DVCSCGMIYYKHCVLAGKQSNLTNFEAKCYLCGGICEFMFLRQAIYIFYWAIIMARFLSLPKFQNNSSILQSNVNVPCKI

SEQ ID NO: 203596 - protein, 126 aa, Triticum aestivum
  unsure (1)..(126): unsure at all Xaa locations
  Clone ID: PAT_TA_98014.pep
MATTAMALSPSSFAGKAVKDLPSSALFGEARVTMRKTAAKAKPVSSGSPWYGSDRVLYLGPLSGEPPXSYLTGEFPGDYXWDTAGLSADPETFXKNREXLEVIQWRWAMLGXLGCXFPXLLARKRG

SEQ ID NO: 203597 - protein, 142 aa, Triticum aestivum
  unsure (1)..(142): unsure at all Xaa locations
  Clone ID: PAT_TA_98015.pep
FLQQQCSPVAMPQSLARSQMLQQSSCHVMQQQCCQQLPQIPQQSRYEAIRAIIYSIILQEQQQVQGSIQTXXQQPQQLGQCVSQPQQXQSQQQLGQQPQQQQLAQGTFLQXHTKIAQLEVVTSIALXTLPTXCRCCCRKTHC

SEQ ID NO: 203598 - protein, 103 aa, Triticum aestivum
  unsure (1)..(103): unsure at all Xaa locations
  Clone ID: PAT_TA_98016.pep
KGTGGIKPKWQGFGLGQAISVQFPGFSSAPPSPPPPAAATSIPPGSXARRGRSEAHLPVRRGRDLLPPRPPRDXPPNWSPHXPSPRTPADXRXGXXPXKELGT

SEQ ID NO: 203599 - protein, 140 aa, Triticum aestivum
  unsure (1)..(140): unsure at all Xaa locations
  Clone ID: PAT_TA_98017.pep
EEPIPSRTNHTPRRRRGPPRRPWRTPSSSRSSTTTSPTRTRLTPRQPRPPRSPPCPTPGPPPPPPGAGAGARPPPSPGAAASRAASTCPTSXSAAAARAAWIRVEGRHGPPVQTLEGQHHDAPAALPRPERPRRFRSPSK

SEQ ID NO: 203600 - protein, 107 aa, Triticum aestivum
  unsure (1)..(107): unsure at all Xaa locations
  Clone ID: PAT_TA_98018.pep
PARPXLLXGAPWPPXSQAAAGCHLLGLLDLDGGSRPLDLGLGRRGGLLRLRDLLGGDGRLHRGRLLRQRGRRVLGHQRWPLPSWMQENARSGRGWLAEASATVIHRA

SEQ ID NO: 203601 - protein, 103 aa, Triticum aestivum
  unsure (1)..(103): unsure at all Xaa locations
  Clone ID: PAT_TA_98019.pep
MLVYQDKLSGDELLSDSFPYRELENGVLWEVDGHWVVQGAVDVDIGANPSAEGGGDDEGXXXXAVXVVDIVDTFRLQXXKPAFDKXQFXSSHALSKPLKLEGG

SEQ ID NO: 203602 - protein, 122 aa, Triticum aestivum
  unsure (1)..(122): unsure at all Xaa locations
  Clone ID: PAT_TA_98020.pep
SCKKLCXQQLXWQIPEQSRXCQAIHNVVHAIILHQQQQQQQQQQQQPLSQVSFQQPQQQYPSGQGSFQPSQQNPQAQGSVQPQQLPQFEEIRNLALETLPAMCNVYIPPYCTIAPVGIFGTN

SEQ ID NO: 203603 - protein, 95 aa, Triticum aestivum
  unsure (1)..(95): unsure at all Xaa locations
  Clone ID: PAT_TA_98021.pep
GADDEVRKVAIQIIALFFNISLSLPKQKTSANDIDLESSYGALSSLEDIXVSIIRRASVDQXXVFHRSCLLLCVFLLSKDELGCPGYNSLATLSR

SEQ ID NO: 203604 - protein, 142 aa, Triticum aestivum
  unsure (1)..(142): unsure at all Xaa locations
  Clone ID: PAT_TA_98022.pep
MKKFLVLALIVVAATTTAAEPFTAFRSAWEPQHPSSPEHQPTPQPQEHPVPHQKLNPCRDALLQQCSPXVADMSFLRSQVVQHSSCXVMWEAXAVKQLKAIPKQVKDXXAIQQRWCXPIXXQXQQQLVKATXTQTSXXRQQQ

SEQ ID NO: 203605 - protein, 87 aa, Triticum aestivum
  unsure (1)..(87): unsure at all Xaa locations
  Clone ID: PAT_TA_98023.pep
XQLPFPXQXXXSFPQPQQPQQPFPQSQQPQQPFPQPQQPQQSFPQQQQPLIQPYLXQQMNPCKNYLLQHCXPVSLVSSLVSXILPXT

SEQ ID NO: 203606 - protein, 131 aa, Triticum aestivum
  unsure (1)..(131): unsure at all Xaa locations
  Clone ID: PAT_TA_98024.pep
MSAAAANVAVIGAGMTGAVCASLLAARGVAVTLFDSGRXPGXRMAQRRKVMDEXNGXXVPTTGRPNXTLXNEXXLRVXGXLEGPGLLXQWKGMFXACFXXXXXKFKDFXXEGTMXKYVXVPGMNSICKSLX

SEQ ID NO: 203607 - protein, 79 aa, Triticum aestivum
  Clone ID: PAT_TA_98025.pep
MEHKETGCQSREGPILCVNNCGFFGSAATMNMCSKCHKEMAMKQEQAKLAASSFDKHRQRWRCRQRTSLLLARGWQVCS

SEQ ID NO: 203608 - protein, 128 aa, Triticum aestivum
  Clone ID: PAT_TA_98026.pep
HCGGAACYWCCLKLLQWLLSDTSKSGRLTICTHRSDLIKALLKALGSATYSPANPARSQSSNDNSLPMSLSLIFQNVGKFGGDIYFSSVTVMSEIIHKDPTCFPALKELGLPDAFLSSVTAGVIPSCK

SEQ ID NO: 203609 - protein, 119 aa, Triticum aestivum
  Clone ID: PAT_TA_98027.pep
MKTFLVFALLAVAATSAIAQMETRCIPGLERPWQQQPLPPQQTFPQQPLFSQQQQLFPQQPTSAATTPTVGPRCLPTPTTTEASSDKCFQQPQQQQLGQWASTTTSTPGYLVAGKPNST

SEQ ID NO: 203610 - protein, 144 aa, Triticum aestivum
  unsure (1)..(144): unsure at all Xaa locations
  Clone ID: PAT_TA_98028.pep
EREHREEGHLHCTPERQCCSFLNICQMFHAGSGPLFWWFYPSNVSMRSIRMISTCMRKILGAGNNNSQGSLRSDSKMEEFENFHTICSFRSAVLKNAWTNYXRXQVMSTFQLNCCXXTARRMNWXCLTPSNGFPTPXRIXXXGX

SEQ ID NO: 203611 - protein, 119 aa, Triticum aestivum
  unsure (1)..(119): unsure at all Xaa locations
  Clone ID: PAT_TA_98029.pep
MVYIKNQKTRAYSKRFQVKFKRRRQGKTDYRARLRLTXKDKNKYNTPKYRFVVRFTNKDVTAQIVYATIAGDIVMAAAYSQELPRYGLEVGLTXYAAXYCTGLLLXXXVXKNXDXDEEV

SEQ ID NO: 203612 - protein, 142 aa, Triticum aestivum
  unsure (1)..(142): unsure at all Xaa locations
  Clone ID: PAT_TA_98030.pep
TITLEVESSDTIDNVKAKIQDKEGIPPDQQRLIFAGKQLEDGRTLADYNIQKESTLHLVLRLRGGMQIFVKTLTGKEHHPGXWSPRDNIXNVKGXIQDKGGXPPDQQRLIXAGXXLXDGXTLGXLNIQXXLPLNXXLRLXXG

SEQ ID NO: 203613 - protein, 144 aa, Triticum aestivum
  unsure (1)..(144): unsure at all Xaa locations
  Clone ID: PAT_TA_98031.pep
WAMLGALGCVFPELLARNGVKFGEAVWFKAGSQIFSEGGLDYLGNPSLVHAQSILAIWACQVVLMGAVEGYRVAGGPLGEIVDPLYPGGSFXPLGLXEDPEXFAELKVKEIKNGRLXMFSMFGFFLARATSXXRGPWEKLADQX

SEQ ID NO: 203614 - protein, 133 aa, Triticum aestivum
  unsure (1)..(133): unsure at all Xaa locations
  Clone ID: PAT_TA_98032.pep
MKTFLILALLAIVATTATTAVRVPVPQLQPQNPSQQQPQEQVPLVQQQQFLGQXQPFPPQQPYPQPQPFPSQQPYLQLQPFPQAQLTYSQXQQSFXPTNNQYPQPEPXXFRXXKEPNFKSRKXTXNXXQQXNS

SEQ ID NO: 203615 - protein, 57 aa, Triticum aestivum
  unsure (1)..(57): unsure at all Xaa locations
  Clone ID: PAT_TA_98033.pep
HXSGXCPKRLPXLXIXXYXNXHMXXTTTESXEXPXSPSFAHARVNEGRQTDVLCFVL

SEQ ID NO: 203616 - protein, 108 aa, Triticum aestivum
  Clone ID: PAT_TA_98034.pep
MSLIAGEEFQHILRVLNTNVDGKQKIMFALTSIKGVGRRFSNIVCKKADIDMNKRAGELSAEEMDRLMAVVHNPAPSSRCRDWFLNRKKDYKGTGGFSQGPCPTPLGQ

SEQ ID NO: 203617 - protein, 120 aa, Triticum aestivum
  unsure (1)..(120): unsure at all Xaa locations
  Clone ID: PAT_TA_98035.pep
MSGRGKGGKGLGKGGAKRHRKVLRDNIQGITKPAIRRLARRGGVKRISGLIYEETRGVLKIFLENVIRDAVTYTEXARRKNVTXAMDVVYALKAPXEAPCTGFRAPPGALLGGPLTLGVQ

SEQ ID NO: 203618 - protein, 135 aa, Triticum aestivum
  unsure (1)..(135): unsure at all Xaa locations
  Clone ID: PAT_TA_98036.pep
QIRLRSPSCPPARVQVHPSPPRRARTRPPPTRIQIRPAAAAAAAQGGAMAGTGGLSESVMRKVLLSYCYVAVWIFLSFAVIVYNKYILDPKMYNWPFPISLTMVHMSFCSSLAXGLVRVLRVVEPASSPAHERQL

SEQ ID NO: 203619 - protein, 100 aa, Triticum aestivum
  unsure (1)..(100): unsure at all Xaa locations
  Clone ID: PAT_TA_98037.pep
MSRGGSAGGGQSSLGYLFGDGEPXKPAAAPAAKPAPAEKPALAAADVTKQIPAGIXQXSRAXNYYRAXGQXTGNFLTXRPSXKVHAAPGGGSSLGYMVWK

SEQ ID NO: 203620 - protein, 129 aa, Triticum aestivum
  unsure (1)..(129): unsure at all Xaa locations
  Clone ID: PAT_TA_98038.pep
MAPTVMASSXTSVAPFQGLKSTAGLPVSRRSNGASLGSVSNGGRIRCMQVWPIEGIKKFEXXLSYLPPLSTXALLXQVDYLIRSKWVPCLEFXKVGFIFRXHNXSPGYYDGRVLDQLWGCIVRPRRRLK

SEQ ID NO: 203621 - protein, 85 aa, Triticum aestivum
  unsure (1)..(85): unsure at all Xaa locations
  Clone ID: PAT_TA_98039.pep
PSPPASAAAMADGANPNPTSTPRQKAVPDWLNSPIWSAPAPSPRHRSPPRAPSPPPPXPPKPQHDPTPPPPRQPARRGASSDSDS

SEQ ID NO: 203622 - protein, 108 aa, Triticum aestivum
  unsure (1)..(108): unsure at all Xaa locations
  Clone ID: PAT_TA_98040.pep
XXYXFPGXXRMGXQTHFFTXLLETGSSQRTLXGLPXHSDPSGPFAHLSSSGGXPGHSRRSPSSATLACLSGLAFPPCFDMADGAGGEAGGRGRETLAGSATTGEGRKV

SEQ ID NO: 203623 - protein, 134 aa, Triticum aestivum
  Clone ID: PAT_TA_98041.pep
QSPLSSAAVSALCSIQEVLGSSPRRPYFCLLFTFFAHHTASRLGLARFCCCCCLAHRALYIYLPLACVARAALDSSPFRFFPVLFFHLNFQCLHIYSKCHHFKMLITKCPCIQIKHVIYVKCSEFYLLSKSTNF

SEQ ID NO: 203624 - protein, 116 aa, Triticum aestivum
  unsure (1)..(116): unsure at all Xaa locations
  Clone ID: PAT_TA_98042.pep
HPPAAIHPSLAAPAAMPAGQQPPXREPDGGDSNHHPHPPPPXPALPSEVVPXXPPXVSEDDESWVWXHIKAXARXDADAXXGAXASFLYGNRCXXTPLXCXXLCSSXLXSQRAPSL

SEQ ID NO: 203625 - protein, 102 aa, Triticum aestivum
  unsure (1)..(102): unsure at all Xaa locations
  Clone ID: PAT_TA_98043.pep
MVKAVAVLTGSEGVKGTIFFTQEGEGPTTVTGSVTGLKEGLHGFHVHALGDTTNGCMSTGPHFNPAGHVHGAPEXDEIRHAGDLGNVTAGVGWVLLSNQIIT

SEQ ID NO: 203626 - protein, 128 aa, Triticum aestivum
  unsure (1)..(128): unsure at all Xaa locations
  Clone ID: PAT_TA_98044.pep
MKTFLVFXLXAXVGTSAIAXMETSCIPXLARPWQXQPLQQKETFPQQPPSSQQQXPFPQQPPFLXQQPSFSQQPLFSQKQQPXVLPQQPAFSQQQQTVLPQQPSIFAAXTPXRLLXQQXPLLFIHPNF

SEQ ID NO: 203627 - protein, 84 aa, Triticum aestivum
  unsure (1)..(84): unsure at all Xaa locations
  Clone ID: PAT_TA_98045.pep
MAKTQPRGPTAAEPLLPPPPYLXPHSPSHLHDADLHDSYVLLVPVRLRRRLRGGCXXXRXAAXLAALALLXXAFLLWPSXSASV

SEQ ID NO: 203628 - protein, 108 aa, Triticum aestivum
  unsure (1)..(108): unsure at all Xaa locations
  Clone ID: PAT_TA_98046.pep
FFFLFFFFFFFFFFFFFFFSTQQKNRYLNTILKRMHTTEWSKLQNXKIVXCITSFYISRTCQHFQVYKQNQGKGRGKDGLTPSXPRRVNPERXNPXPPXSGTLXXXPE

SEQ ID NO: 203629 - protein, 145 aa, Triticum aestivum
  unsure (1)..(145): unsure at all Xaa locations
  Clone ID: PAT_TA_98047.pep
MKTLLILTILAMATTIATANMQVDPSGQVQWPQQQPFPQPQQPFCQQPQQTIPQPHQTFHHQPQQTFPQPQQTYPHQPQQQFPQTQQPQQPFPQAPNKTFPXQPQLTISXQPQQPFPQASAXPXNXFPKSQQXQXPFXQAQQKXP

SEQ ID NO: 203630 - protein, 65 aa, Triticum aestivum
  Clone ID: PAT_TA_98048.pep
ELSLGAKQLAIFPYVNLQHLHNLTPQAHNSSPCVNGVSWDFILASPKIVNSKLLQFEPRRDYMLV

SEQ ID NO: 203631 - protein, 53 aa, Triticum aestivum
  unsure (1)..(53): unsure at all Xaa locations
  Clone ID: PAT_TA_98049.pep
FQSLLXXPRILASWNCLXVQLFXLXXSXVKPGIVQPINLFIFHSMNSMPSLLF

SEQ ID NO: 203632 - protein, 89 aa, Triticum aestivum
  unsure (1)..(89): unsure at all Xaa locations
  Clone ID: PAT_TA_98050.pep
PQPSPSLARITTNALSPRPASGTRPPSPSPPXWPPPSPSPPPPRPSPPPRPRARXAPTRRXRPPAARGLRKALSGLRPRARVGEVSEVL

SEQ ID NO: 203633 - protein, 114 aa, Triticum aestivum
  unsure (1)..(114): unsure at all Xaa locations
  Clone ID: PAT_TA_98051.pep
MLVYQDKLSGDELLSDSFPYRELENGVLWEVDGHWVVQGAVDVDIGANPSAEGGGDDEGXDDXAVKXVDIVDNFRLQEQPAFDKKXFIXQNEXLNXRTXPASXEGEXPKXFKKK

SEQ ID NO: 203634 - protein, 138 aa, Triticum aestivum
  unsure (1)..(138): unsure at all Xaa locations
  Clone ID: PAT_TA_98052.pep
MARTKQTARKSTGGKAPRKQLATKAARKSAPATGGVKKPHRFRPGTVALREIRKYQKSTELLIRKLPFQXRLVREIAQDFKTDLRFQXSSAVSALXEXAXGXLLXVFXENNLWAIQAKRVXIMPKDIXXARRIRGXRA

SEQ ID NO: 203635 - protein, 125 aa, Triticum aestivum
  unsure (1)..(125): unsure at all Xaa locations
  Clone ID: PAT_TA_98053.pep
MARGLKKHLKRLNAPSHWMLDKLGGAFAPKPSSGPHKARECLPLILILRNRLKYALTYREVQSILMQRHIKVDGKVRTDKTYPAGFKDIISIPKTGENYRLLYDTXGRFRLXSVXDXXAKFXLCX

SEQ ID NO: 203636 - protein, 138 aa, Triticum aestivum
  unsure (1)..(138): unsure at all Xaa locations
  Clone ID: PAT_TA_98054.pep
SSLACLAMPPVLGSMRHLALASCKGAMKAVLPSKAIHHGSWASVVSATVGSATPPDIDVAVLFGRSDNIVAELSGTGSXFSPSGXXAALXRLSLAPARSQTTPMSXPFWRGXXWXLGXMPLXAXNKXGXXLVXFLXHG

SEQ ID NO: 203637 - protein, 140 aa, Triticum aestivum
  unsure (1)..(140): unsure at all Xaa locations
  Clone ID: PAT_TA_98055.pep
MALPNQNTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRXCENIPIVLCGNKVDVKNXXVKXKQVT

SEQ ID NO: 203638 - protein, 138 aa, Triticum aestivum
  unsure (1)..(138): unsure at all Xaa locations
  Clone ID: PAT_TA_98056.pep
MKTFLIFALLAVAATSAIAQMETSHIPSLEKPLQQQPLPLQQILWYQQQQPIQQQPQPFPQQPPCSQQQQPPLSQQQQPPFSQHQQPXLPQQQIPSVQAIYLAAAKPMHPPSKQPGMASPGVVGGKRLCCGNNGRELA

SEQ ID NO: 203639 - protein, 49 aa, Triticum aestivum
  Clone ID: PAT_TA_98057.pep
GFFAHRCLYGKTTLLDDNCWRVIRLDLFCLGHEHLTSMADHAVPASICC

SEQ ID NO: 203640 - protein, 124 aa, Triticum aestivum
  unsure (1)..(124): unsure at all Xaa locations
  Clone ID: PAT_TA_98058.pep
MKFIAAYLLAYLSGNASPSAEDLTSILESVGCEIDNEKMELMLSQVKGKDITELLAAGXEKFAAVPSGGGGVAVSTAAPAXAGGAAGPAAESKXEXEKVRGXRKESDEXNGASLRTVCWGHFVS

SEQ ID NO: 203641 - protein, 105 aa, Triticum aestivum
  unsure (1)..(105): unsure at all Xaa locations
  Clone ID: PAT_TA_98059.pep
MAPTVMASSATSVAPFQGLKSTAGLPVSRRSNGASXLGSVSNGGRIRCMQVWAHRGALRSSKTLSYLPPAQXREGLLKQVELPXSAPKWXVPCLXVQARVGFIFP

SEQ ID NO: 203642 - protein, 143 aa, Triticum aestivum
  unsure (1)..(143): unsure at all Xaa locations
  Clone ID: PAT_TA_98060.pep
MKTFLIFALLAVAATSAIAQMETSHIPSLEKPLQQQPLPLQQILWYQQQXPIQQQPQPFPQQXPPCSQQQQPPLSQATINHHFHNXQPPFLQQTTTAVLPQQTPIFRKXXQQFPASXQQPTFTXNNHQFFAXKQPTNFSQASR

SEQ ID NO: 203643 - protein, 89 aa, Triticum aestivum
  unsure (1)..(89): unsure at all Xaa locations
  Clone ID: PAT_TA_98061.pep
PPPLPNPRPSRRAAPLPLLPPRRLPAAPPHPAVHRTAPAARXFPTDXIDCATTVLQAVXENXRGXGXDXGSTTXXTAQXXSXHPIXIXQ

SEQ ID NO: 203644 - protein, 130 aa, Triticum aestivum
  unsure (1)..(130): unsure at all Xaa locations
  Clone ID: PAT_TA_98062.pep
MKTFLVFALLAVAATSAIAQMETRXIXXXVXAWXXHALXXDXAFPXXGXFSXXQXVFPQXTSFSEXXNHQFWEXTTNIFLKQTXKFYQRKPPIFGRQXXNXVXTXNXPTNFQREXTNPFSLQKKNHPFSH

SEQ ID NO: 203645 - protein, 102 aa, Triticum aestivum
  unsure (1)..(102): unsure at all Xaa locations
  Clone ID: PAT_TA_98063.pep
MGLQRRPAAAAAASARGEGQPPGGQRVIHCDXXPAPRAWPGMQMLALAAVLVLGGXQFLPGTHFRHPADPSRTWGSFILAPTPKDLQRLNMVGCTHPICGFP

SEQ ID NO: 203646 - protein, 152 aa, Triticum aestivum
  unsure (1)..(152): unsure at all Xaa locations
  Clone ID: PAT_TA_98064.pep
PPPAXINIVYDLTIFSSIRRRHHHSLDLTIFSSTGNHEHCPDLTIFSSIHRRHFHSLDMFALVNPSSMCFLLCXDCGILRHRRTAPSGPFPTHHSRLARPSSFYILDXDGEIQXXKASMGNLIGSSAVKXRSGYSSXGIXSXGPKTPXHXFH

SEQ ID NO: 203647 - protein, 148 aa, Triticum aestivum
  unsure (1)..(148): unsure at all Xaa locations
  Clone ID: PAT_TA_98065.pep
QPQQAFPHQPQQQFPQPQQPQQQFPQPQQPQQPFPQPQQAQLPFPQQPQQPFPQPQQPQQPFPQSQQPQQPFPQPQQPQQSFPQQQQPLIQXPYLQQQXNPCKNYLLQQCNPVSLXSSLVSMILPRSDCQGXCKQQCWQQLAQVPXQA

SEQ ID NO: 203648 - protein, 133 aa, Triticum aestivum
  unsure (1)..(133): unsure at all Xaa locations
  Clone ID: PAT_TA_98066.pep
MKTFLIFALLAVAATSAIAQMETSHIPSLEKPLQQQPLPLQQILWYQQQQPIQQQPQPFPXQPPCSQQQQPPLSQQQQPPFSQQXPPFLQQQXPVLPQQPPFSXHQXPXSARNNNYQAISSNPIGPKANPPCW

SEQ ID NO: 203649 - protein, 147 aa, Triticum aestivum
  unsure (1)..(147): unsure at all Xaa locations
  Clone ID: PAT_TA_98067.pep
MKTFLVFALLAVAATSAIAQMETRCIPGLERPWQQQPLPPXQTFPQXPLFSQQQQLFPQQPSFSQQQPPFWXQQQPPFSQXQQPILPQAXPFSQANNNSXLPQXPPFSQQXQQPVLPPQXSPFPXQATTPTWVQTKSLLFKPIHFCR

SEQ ID NO: 203650 - protein, 94 aa, Triticum aestivum
  unsure (1)..(94): unsure at all Xaa locations
  Clone ID: PAT_TA_98068.pep
LLLLPPIPNQGGTRREEGKGREEEITEPSARTGQPRSAEMGLTFTKLFSRLFAXKEMRILMVGLDAAGXTTILYXQSSGEIHHQSPQSVCAGSR

SEQ ID NO: 203651 - protein, 66 aa, Triticum aestivum
  Clone ID: PAT_TA_98069.pep
HLFLAPKFLNSQFIEFYWAVITEIFFKTWFLRPPPKEGIFRPPPKNRDCETLEQVHYYFFMQSGEE

SEQ ID NO: 203652 - protein, 120 aa, Triticum aestivum
  unsure (1)..(120): unsure at all Xaa locations
  Clone ID: PAT_TA_98070.pep
MRECISIHIGQAGIQVGNACWELYCLEHGIQPDGQXMPGDKTVGGGDDAFNTFFSETGAXGKHVPRAVFVDLEPTVIDEVRTGXYRQLFQPEASLSSGQGGCNQQTFARGSLHQLAKEIG

SEQ ID NO: 203653 - protein, 89 aa, Triticum aestivum
  unsure (1)..(89): unsure at all Xaa locations
  Clone ID: PAT_TA_98071.pep
FPRIPHWRQRASRWCGSSGWACTLARGGSWGGGGGGGGGAAMGMAAANSCGGGWXTAGGGDGGGGSLRSMSRCGXRSMANRGSGSRSSS

SEQ ID NO: 203654 - protein, 128 aa, Triticum aestivum
  unsure (1)..(128): unsure at all Xaa locations
  Clone ID: PAT_TA_98072.pep
MKTLLILTILAMAITIGTANIQVDPSGQVQWLQQQLVPQLQQPLSQQPXQXTFPXPXQTFPHQPHQHVPQPQXQPXQPFLQPQQAFPQQXQQPFPQTQXPQXPFSPAXTNKHFPXTXQLPXXPFXQPT

SEQ ID NO: 203655 - protein, 122 aa, Triticum aestivum
  unsure (1)..(122): unsure at all Xaa locations
  Clone ID: PAT_TA_98073.pep
MKTFLVFALLALAAASAVAQISQXQQAPPFSQQXQPPFSQXXQPPFSXQQQSPFSQQHQXPPFAQQQQPPFSQQPPXSQQQXPPFSQQQQXPXFSQQQHPXYXRXQQQPPYSXQEQPPFSQH

SEQ ID NO: 203656 - protein, 54 aa, Triticum aestivum
  unsure (1)..(54): unsure at all Xaa locations
  Clone ID: PAT_TA_98074.pep
HHHYRHMXLRTSXSNSKLVFGTIRLNPCLNYKPTCLPGTFQNENATRSGRYHVQ

SEQ ID NO: 203657 - protein, 136 aa, Triticum aestivum
  unsure (1)..(136): unsure at all Xaa locations
  Clone ID: PAT_TA_98075.pep
SFSSKGGAXGSAXGSQAXXFSFTSSAXRRALXSATASFGLCLGPRRAXSASGSAAAAGSGSFVSSASTAAGASSLVSSTSTGAGASTSASTGAGASSVFATSSAATGFSTAGASSVSAADGFWTSAVAIAVVDARK

SEQ ID NO: 203658 - protein, 109 aa, Triticum aestivum
  unsure (1)..(109): unsure at all Xaa locations
  Clone ID: PAT_TA_98076.pep
AATGRWAEPSARPSPSKPHAAGKRPPAXRSPPRPTPSRPSXPPRASHALRPSNRPSPKQGTRQXQXPPAXRPXARPKTSRXVRPATSWALEGRSPKRPRKPSRPRSNGG

SEQ ID NO: 203659 - protein, 145 aa, Triticum aestivum
  unsure (1)..(145): unsure at all Xaa locations
  Clone ID: PAT_TA_98077.pep
QPQQTFPHQPQQQFPQPQQPQQQFLQPQQPFPQQPQQPYPQQPQQPFPQTQXPQQLFPQSQQPXQQFSXAPXNNXPQPXQPQQSFPQQQPPFIQPSLQXQVNPCKNFLLQQCKPVSLVSSLWSMIWPQSDXQVMRXQMLPSHKIP

SEQ ID NO: 203660 - protein, 61 aa, Triticum aestivum
  unsure (1)..(61): unsure at all Xaa locations
  Clone ID: PAT_TA_98078.pep
KKTIGPNLNSALGAGSVVAHHGPTSTGPARWAAAGQLDGRTRWTLCLAQXRGLGRGQRSLG

SEQ ID NO: 203661 - protein, 120 aa, Triticum aestivum
  unsure (1)..(120): unsure at all Xaa locations
  Clone ID: PAT_TA_98079.pep
MKTFLIFALLAVAATSAIAQMENSHIPGLERPSQQQPLPPQQTLSHQQPQQPIQQQPQQFPQQQPCSQQQQQQQQQQQQQQQQQXQQQQQXQQQQPLSRQHRKVIISLLAIVGDHRHNCS

SEQ ID NO: 203662 - protein, 145 aa, Triticum aestivum
  unsure (1)..(145): unsure at all Xaa locations
  Clone ID: PAT_TA_98080.pep
MKTFLVFXLLAVAATSXIAQMETRCIPGLERPWQQQPLPPXQTFPQQPLFSQQQQLFPQQXSFSQQXPPFWQXQPPFSQXQQPILPQQPPFXXXNKQLVLPQQPPFSQQQQPXVLPPQQXSPFPQQXXHQXAGXQQQKXWXXQPS

SEQ ID NO: 203663 - protein, 116 aa, Triticum aestivum
  unsure (1)..(116): unsure at all Xaa locations
  Clone ID: PAT_TA_98081.pep
MAPPPAATEKKKTFVLYPSLGVGHLNPMVELAKHLLRRGHSAVVAVVDPPDGDPTSAAAVARLAEANPSIALRLLPAPPSPDPAGAPHQARPRHPSASPNPALRXFLXGWRAPAQA

SEQ ID NO: 203664 - protein, 127 aa, Triticum aestivum
  unsure (1)..(127): unsure at all Xaa locations
  Clone ID: PAT_TA_98082.pep
MKTFLIFALLAVAATSAIAQMETSHIPSLEKPLQQQPLPLQQILWYQQQQPIQQQPQPFPQQPPCSQQQQPPLSQQQQPPFSQHQQPXVLPQQQIPSVQPSILXQLNPCXVFLQQQXSPVAMPHXLC

SEQ ID NO: 203665 - protein, 123 aa, Triticum aestivum
  unsure (1)..(123): unsure at all Xaa locations
  Clone ID: PAT_TA_98083.pep
ALGQPGLKRSVRVGETGFREVAAYLLDYDNFANVPPTVLVKISHPVFNVNEGVGSTNKKASVGDPRTVSKIASFQQFAPHDFDASDLGTSSFPVSXIHRIGILDIXRIFNTDRHXGNLLXRKG

SEQ ID NO: 203666 - protein, 142 aa, Triticum aestivum
  unsure (1)..(142): unsure at all Xaa locations
  Clone ID: PAT_TA_98084.pep
AVSSPPGSPALRPARAAAPHRRGGPPPIPRERXEPRSSEXEEEESSPSALTPCPPSKAPPXPPDPIQPPPPAPASRPLSLPVGSLSPILTESAAPFSHPRPAPPGPCPCRRSKQQVGDWRVCGVGLIPGAPRAPSPGSPSLG

SEQ ID NO: 203667 - protein, 89 aa, Triticum aestivum
  Clone ID: PAT_TA_98085.pep
MTSGASGRTATAGTAALLPLLFLLLQVSAGAGAGADCHFPAVFNFGDSNSDTGGLSAAFGAAPPPNGRTFFGKAAGRYCEGPPSSDFNR

SEQ ID NO: 203668 - protein, 119 aa, Triticum aestivum
  unsure (1)..(119): unsure at all Xaa locations
  Clone ID: PAT_TA_98086.pep
MAEQTFIMIKPDGVQRGLIGEVISRFEKKGFYLKGLKLQNVEKSFAEQHYSDLSSKPFFAGLVEYIVSGPVVAMVWEGXKSVVATXGRKIIGATNPLDSEPRHQSVVTFARRQSRRSIH

SEQ ID NO: 203669 - protein, 96 aa, Triticum aestivum
  unsure (1)..(96): unsure at all Xaa locations
  Clone ID: PAT_TA_98087.pep
MKTFLVFALLALAAXSAVAQISQQQQAPPFSQQQQPPFSQXQQPPFSQQQQSPFSQQXQQXPXFAQQQHXPXSQHAXXFTAGNXXPFXQVIIAFSG

SEQ ID NO: 203670 - protein, 135 aa, Triticum aestivum
  unsure (1)..(135): unsure at all Xaa locations
  Clone ID: PAT_TA_98088.pep
PQXQQPQQPFPQPQQTFPQQPQLPFPQQPQXPFPQPQQPQQQFPQXQQPQQPFPQPQHQFLQPQQPQQSFPQHXQPLIQLSLQXKMNPCKNFLLQQCNPVSLGSSLXSMILPRXGSAKGGCNNQWLANKGFLQSK

SEQ ID NO: 203671 - protein, 141 aa, Triticum aestivum
  unsure (1)..(141): unsure at all Xaa locations
  Clone ID: PAT_TA_98089.pep
PQQPQQPFPQSQQPQQPFPQPQQPXQSFPQQQQPLIQPYLQQQMNPCKNYLLQQCNPVSLVSSLVSMILPRSDCQVMQXQQCCQQLAQIPRQXSKCAAIHXVXVHSIVMQQEXTTXAYKILPAWFARPKVGSSNLQQQYGG

SEQ ID NO: 203672 - protein, 146 aa, Triticum aestivum
  unsure (1)..(146): unsure at all Xaa locations
  Clone ID: PAT_TA_98090.pep
MKTLLILTILAMATTIATANMQVDPSGQVQWPQQQPFPQPQQPFCQQPQQTIPQPHQTFHHQPQQTFPQPQQXTYPHQPQQQFPQTQQPQQPFPQPQQTFPQQXPQLPFPXQPQQXFPPSLXKPXTTHFPQSXNXQQQTFXPRPQK

SEQ ID NO: 203673 - protein, 116 aa, Triticum aestivum
  unsure (1)..(116): unsure at all Xaa locations
  Clone ID: PAT_TA_98091.pep
QQSHXXFLLQPQXPFPQQPQQSFLLGPXQPFPQQPEQSQQSFPQPQPQQPQQPSILQPQQPLPXQPQQPFLQPQXXLSQQPRAXNFPAXPKQPHQPXQPISTXXNHMXSLTKHRVG

SEQ ID NO: 203674 - protein, 107 aa, Triticum aestivum
  unsure (1)..(107): unsure at all Xaa locations
  Clone ID: PAT_TA_98092.pep
MVKAVAVLTGSEGVKGTIFFTQEGDGPTTVTGSVTGLKEGLHGFHVHALGDTTNGCMSTGPHFNPAGHVHGXXQEDEIRHAGGSWEMQLGAGCLLSVTLGNIPPYWG

SEQ ID NO: 203675 - protein, 148 aa, Triticum aestivum
  unsure (1)..(148): unsure at all Xaa locations
  Clone ID: PAT_TA_98093.pep
TFLILALLAIVATTATTAVRVPVPQLQLXNPSQQQPQEXVPLVQEQQFXQGKQQPFPPQQPYPQPQPFPSQQPYLQLQPFPQPQLSYPQXQPFRXPQQPYPQPQPQXYSXPQQPISQAXKQATSKQTTXNNXNKILXQIFTNKLSMGD

SEQ ID NO: 203676 - protein, 147 aa, Triticum aestivum
  unsure (1)..(147): unsure at all Xaa locations
  Clone ID: PAT_TA_98094.pep
SAMATTTIIYVAMVLAVFAVMSYSAHADDDFISRTCKKTKNAELCVDVLHQNIDSDDASSELDLANISLKIAXATADLNVEYTKDWVRHSRXSPSGEALVACRLAYADAVNDLKASRPYPRFHKGTMGGDKSVFGLPKGGRLMLCET

SEQ ID NO: 203677 - protein, 104 aa, Triticum aestivum
  unsure (1)..(104): unsure at all Xaa locations
  Clone ID: PAT_TA_98095.pep
SRKADELQGRWEEFKEAHKFWGGVELWRFEADIKVMVTGLLHGGGRSGVAYLYSWGVQLPRCSGRRPMGLHXEGPPPEFLNAGKMGFMXKRRXXKTXGXGFGXX

SEQ ID NO: 203678 - protein, 80 aa, Triticum aestivum; identical to SEQ ID NO: 106963
  Clone ID: PAT_TA_98096.pep

SEQ ID NO: 203679 - protein, 133 aa, Triticum aestivum
  unsure (1)..(133): unsure at all Xaa locations
  Clone ID: PAT_TA_98097.pep
MKTFLILALLAIVATTATTAVRVPVPQLQLQNPSQQQPQEQVPLVQEQQFPGQQQPFPPQQPYPQPQPFPSQQPYLQLATFPQPQLSYPXKPQPFRPQQPFPQPATTSYSQPTTTNFRKXAXKQASKQTNKQP

SEQ ID NO: 203680 - protein, 53 aa, Triticum aestivum
  unsure (1)..(53): unsure at all Xaa locations
  Clone ID: PAT_TA_98098.pep
TTAXAAATXPRDGARXAQRTXAGAVAARGXPRXPSGAGPHCGGMWQRSMGXRS

SEQ ID NO: 203681 - protein, 87 aa, Triticum aestivum
  unsure (1)..(87): unsure at all Xaa locations
  Clone ID: PAT_TA_98099.pep
MENSAPPVIIVGAGPSGLAASACLARRGVDSIVLERDDCVGSLWQKRAYDRLXLHLPKQAKRAPPPCPHARRRRRPNPSPANQLSSR

SEQ ID NO: 203682 - protein, 108 aa, Triticum aestivum
  unsure (1)..(108): unsure at all Xaa locations
  Clone ID: PAT_TA_98100.pep
QXFPQPQQQFPQPQXPQXSFPQQQRPFIQPSLQQRLXPCKNILLQXCKPASLVSSLWSIIWPQXDCQVMQXQCCXEXAXVPQQLXCAAIHSVVHSIIGAISNRHPIIY

SEQ ID NO: 203683 - protein, 99 aa, Triticum aestivum
  unsure (1)..(99): unsure at all Xaa locations
  Clone ID: PAT_TA_98101.pep
FSTNXXXXDVVLXPTNPRDEYQHWFKDMRXSNRINDEXXYPAFISVXKVTGQGIXHXQXRXAPXLRLVPYXXXYHHXSVVCLGAYRRGRGSRGDSRGNH

SEQ ID NO: 203684 - protein, 146 aa, Triticum aestivum
  unsure (1)..(146): unsure at all Xaa locations
  Clone ID: PAT_TA_98102.pep
NCXHXLXFGXXSLAFFQXFNNRSPPPYGXRAXGXRXXAXPPXYXAPGRRXGXCSDSARTXPTRRKITGPXTNPPTRNSAFSFSKGRLPXEPPQLHSYFIYQTGNXSFPHLPPRRSGPAEGGKPASRRRRIXSNGEGEKIASPTVAG

SEQ ID NO: 203685 - protein, 84 aa, Triticum aestivum
  unsure (1)..(84): unsure at all Xaa locations
  Clone ID: PAT_TA_98103.pep
DQPCKEYNGASRTIILNGRIGGSPLKTATCRRNCGVLSSFLIGLRKMGWLCCSGRLALGSLSSSDQETSACHEEEGEXNXXPXH

SEQ ID NO: 203686 - protein, 141 aa, Triticum aestivum
  unsure (1)..(141): unsure at all Xaa locations
  Clone ID: PAT_TA_98104.pep
FQFGRAGPPSLGRACPMCHSSSFLFXQXIPPLAEYTLSSFSSVSLLQHCVTPPSSSWTTSTSAQCTPAWKRRLHRHIICAHSYPFLSQKRTLTHYPSDERQMNVPFFSYDLLASILISILPPFLFIFLFVVTLRMILSCTE

SEQ ID NO: 203687 - protein, 118 aa, Triticum aestivum
  unsure (1)..(118): unsure at all Xaa locations
  Clone ID: PAT_TA_98105.pep
KIVLKEGEGCERPNDGAVVXXGXIXKLXXXTXFTXKGHEXDXPFQFKTDEEXVIQGXXTXVLTMKKXEVASXXXPPEHAFXXTXXKLDFAVGPSSKGSYKNWGPVFLKRKKSLGLFKN

SEQ ID NO: 203688 - protein, 117 aa, Triticum aestivum
  unsure (1)..(117): unsure at all Xaa locations
  Clone ID: PAT_TA_98106.pep
PRRQGEFAAGGRRRPSSWRGCQELQAEAAREVAEAGAAQGHHQPLRRGVNGCPSGSRPCSSGRSRTRGRATXEPXVKNGLXGAVXKAGXYSLRKEFKIATNRLYMDYTFHFICPNDS

SEQ ID NO: 203689 - protein, 138 aa, Triticum aestivum
  unsure (1)..(138): unsure at all Xaa locations
  Clone ID: PAT_TA_98107.pep
PKPTTGGGAAQLEEGGSWKFLKPGKXVILLQGXYAGKKAVIVRXFXEGTRDRPYGHCLVXGLAKYPXKVIRKDSAKKTGKKSRVKVFLKLVNFTHLMPNPLPSERPQRRVLRGAPRTPLNSKGQRKVGRKPGRPRAKA

SEQ ID NO: 203690 - protein, 107 aa, Triticum aestivum
  unsure (1)..(107): unsure at all Xaa locations
  Clone ID: PAT_TA_98108.pep
QAXXQXGQQLAQGQXRASIQAQVQQGQRPAQGQQGXQPGQGQQGQQLGQGQQXQQPGQGQQGQQXAHGQQXSNQGQXQQGQXSPXXGQTRSSKPRDQGASNGDKASH

SEQ ID NO: 203691 - protein, 145 aa, Triticum aestivum
  unsure (1)..(145): unsure at all Xaa locations
  Clone ID: PAT_TA_98109.pep
LXXQQPFPQQPEQIISQQPQQLFSQSQQPFPQQPQQPFPLQPQQPFPQQPAQIIAQQPQQPSPLQPQQPFLRQPQQSFLQQPQQPFPQPQQVVQXKFPGNPQQPFSXKSRQPFSPRNPKQPFPTGNPXTIISPQQQQNYFLKPPN

SEQ ID NO: 203692 - protein, 137 aa, Triticum aestivum
  unsure (1)..(137): unsure at all Xaa locations
  Clone ID: PAT_TA_98110.pep
SRPPVSAHLLRLRRRRTHRGSSDSPDQERRAGRKSTYAGGEEMGLTFTKLFIRLFAKKEMRILMVGLDAPGKTXILLQAXSSAKIVTTIPTXIGFNVETVVTKNHQLHLSGDWRSRKDSGPGRDLSNTKGPLLGKGR

SEQ ID NO: 203693 - protein, 112 aa, Triticum aestivum
  unsure (1)..(112): unsure at all Xaa locations
  Clone ID: PAT_TA_98111.pep
MASKRILKELKDLQKDPPTSCSAGPVGEDMFHWQATIMGPSDSPFTGGLFLVNIHFPPDYPFKPPKVSFRTKVFHPNINKQXGAFCLDILKEQWIPALTIIKRSCCQILVCL

SEQ ID NO: 203694 - protein, 142 aa, Triticum aestivum
  unsure (1)..(142): unsure at all Xaa locations
  Clone ID: PAT_TA_98112.pep
AGVGFKAGVKDYKLTYYTPEYETKDTDILAAFRVSPQPGVPPEEAGAAVAAESSTGTWTTVWTDGLTSLDRYKGRCYHIEPVAGEDSQWICYVAXHXTYXKEGSVTKKVTFNXXGNVIWFKSLRAPTFWEGSTNFPLFKNLS

SEQ ID NO: 203695 - protein, 132 aa, Triticum aestivum
  unsure (1)..(132): unsure at all Xaa locations
  Clone ID: PAT_TA_98113.pep
NTYPTSLLPRPNPPPPXPPASSPTSSPTRPAPVLHPEPPPLPSHLLRRTHPPPPSPPSPARCGPPRAAIPPSPPSPARRXPPRSRRPXLHTISGVAGPIPSHRPHXXPXHXPXLLRVXAXXXLSRSQPSFSR

SEQ ID NO: 203696 - protein, 140 aa, Triticum aestivum
  unsure (1)..(140): unsure at all Xaa locations
  Clone ID: PAT_TA_98114.pep
AVPNNCKRVSERGPAIPLFSTTYSPLSPPLLSRIASQPASASQSRTHSARASQLSPEKEEEEEAEEQRQRKSNHSSESEEQVFLASAPLRPPCPLVTRLLPPPPPSSKLLSSLRXXLCFSGPLPISSXASLPPFPLLNLL

SEQ ID NO: 203697 - protein, 88 aa, Triticum aestivum
  unsure (1)..(88): unsure at all Xaa locations
  Clone ID: PAT_TA_98115.pep
MVGXGVXXXKARNFATFRLFPRDXXAXPNDRVFVRVDNNAYTIPGFGDDEDPSLSPXXGXDQFPSSXSGXLPDXXRQQXLELGLPDDG

SEQ ID NO: 203698 - protein, 88 aa, Triticum aestivum
  unsure (1)..(88): unsure at all Xaa locations
  Clone ID: PAT_TA_98116.pep
MARLNXKAVVAAVVLAAVVLMMAGREASAALSCGQVDSKLAPCVAXXTGXASXXNKECCSXVQGLNXMXRNNSDRKITFKCLKPPHQH

SEQ ID NO: 203699 - protein, 49 aa, Triticum aestivum
  unsure (1)..(49): unsure at all Xaa locations
  Clone ID: PAT_TA_98117.pep
MXGXXVGGRKARNFATFRLFPRDGAADXNDXVFVRVDNNAYTIPGFGDR

SEQ ID NO: 203700 - protein, 113 aa, Triticum aestivum
  unsure (1)..(113): unsure at all Xaa locations
  Clone ID: PAT_TA_98118.pep
MEAGTWAVVVAAAAAYLAWFWRMSRGLSGPRVWPLVGSLPGLLQHAEDMHEWIVGNLRRTGGTYQTCIFAVPGVARRGGLVTVTCDPRNLEHVLKXAXFDNYPKGXPSGHGRL

SEQ ID NO: 203701 - protein, 152 aa, Triticum aestivum
  unsure (1)..(152): unsure at all Xaa locations
  Clone ID: PAT_TA_98119.pep
LWKDRRPVDFGFPXPPASXKXGXSFWSRSXGWYXCFAVPFPPCLGWEXRRRLGAKCRGHSXWPEGPPGRGSRDSCGDRGXVTTLEDSTPYPARGSCGGGGGGMDAEKPQRSGCANKGVLCXRGGVSMRRRWSSTGGRGREDPAVRGPWPSRV

SEQ ID NO: 203702 - protein, 43 aa, Triticum aestivum
  Clone ID: PAT_TA_98120.pep
LVRCRLVRVRIEHVDQTCLGPSFPSSNWHLVSELIVQLFIRFG

SEQ ID NO: 203703 - protein, 150 aa, Triticum aestivum
  unsure (1)..(150): unsure at all Xaa locations
  Clone ID: PAT_TA_98121.pep
QQGQQPGQGHQPGQGQQGQQPGQGQQPGQGQQGQQLGQGQQGYYPXSLQQSGXGQPGYYPTSLQQLGQGQSGXYPTSPQXQPGQGQQPGQLQXPAQGQXPXXGQHGXQXGQGQXRASQPSTXGSXPGTXGPPXGLLPNLLPQSXXXTKGX

SEQ ID NO: 203704 - protein, 40 aa, Triticum aestivum
  unsure (1)..(40): unsure at all Xaa locations
  Clone ID: PAT_TA_98122.pep
HALSCKNPNYTSSNLGNKRQTHVLSCXRMVNLSSNPGAQF

SEQ ID NO: 203705 - protein, 127 aa, Triticum aestivum
  unsure (1)..(127): unsure at all Xaa locations
  Clone ID: PAT_TA_98123.pep
MKTFLVFALLAVAATSAIAQMETRCIPGLERPWQQQPLHHNRXFPQXPLFSQQQQLFPQQPSFSQQQPPFWQQQPPFSQXQPILPQXPPFSQQQQLXVLPQQPPFSXGTKTRFYPHKKTFPQSDNQP

SEQ ID NO: 203706 - protein, 142 aa, Triticum aestivum
  unsure (1)..(142): unsure at all Xaa locations
  Clone ID: PAT_TA_98124.pep
SQDNCQQRKGPANQDQGTKVQAARDGTNQFRTRTNLLTPTSLANSPGQGQQLGQGQPGYLPXLSQQSEQGQQPGQGKQPGQGQQGYYPTSPQQSGQGQQLGQGQPGYYPTSPQQSGQGQQSGQGQQGYYPTSPQQSGQGQQP

SEQ ID NO: 203707 - protein, 145 aa, Triticum aestivum
  Clone ID: PAT_TA_98125.pep
PTPQPQEHPVPHQKLNPCRDALLQQCSPVADMSFLRSQVVQHSSCLVMWEQCCQQLKAIPKQSRCEAIHNVVHAIILQQQQQLVQATSTQPQAAATTRSTTNRVWVLAHNNSHKLDSGVGAVIGDMGWSRNPGLPNAMVPTTLHP

SEQ ID NO: 203708 - protein, 96 aa, Triticum aestivum
  Clone ID: PAT_TA_98126.pep
PSSMDMAGGEDRRPRTLVHFSTSDCSLPLCSSASSASSSSFSGGGARAVGARLAGAGWLAGDPREKGRRERGVGGREERNGWPPLAHPLAVVGHGA

SEQ ID NO: 203709 - protein, 122 aa, Triticum aestivum
  unsure (1)..(122): unsure at all Xaa locations
  Clone ID: PAT_TA_98127.pep
MAAAAAPRPSSPPLRTSIALLLLALALSALVPSSDAYDSLDPVGNITIKWDVKKWREDGYMATVSLYNYQQXRHIQAPGWKLGWVWAGKEIIWKMAGRPKPTEQGELAPGSREGRPPAIGDG

SEQ ID NO: 203710 - protein, 137 aa, Triticum aestivum
  unsure (1)..(137): unsure at all Xaa locations
  Clone ID: PAT_TA_98128.pep
MKTFLVFALLAVAATSAIAQMETRCIPGLERPWQQQPLPPQQTFPQQPLFSQQQQLFPQQPSFSQQQPPFWQQQPPFSQQQPXLPQQPPFSQQQQLVLPQQHQFFTSNNNPVXLPPQQSTFFHKQPSTQAWGQTKSP

SEQ ID NO: 203711 - protein, 55 aa, Triticum aestivum
  unsure (1)..(55): unsure at all Xaa locations
  Clone ID: PAT_TA_98129.pep
XFFFCRXNPVYCMSXXLSTGTKRTDSXKLHRNVTNXHRYMADIHSXGQQYITXLW

SEQ ID NO: 203712 - protein, 142 aa, Triticum aestivum
  unsure (1)..(142): unsure at all Xaa locations
  Clone ID: PAT_TA_98130.pep
SGYFPTSRQQSGQGQQPGQGQQSGQGQQGQQPGQGQQAYYPTSSQQSRQRQQAGQWQRPGQGQPGYYPTSPQQPGQEQQSGQAQQSGQWQLVYYPTSPQQPGQLQQPXAQGQQPAQGQQSSTKSNRPGQGATIKDNGQVTKL

SEQ ID NO: 203713 - protein, 109 aa, Triticum aestivum
  Clone ID: PAT_TA_98131.pep
PGQFLLRARRRLTTLTLATAAAGSSAAAAGASSGAAGASSATAGASGSAGGAASSFTSSGAAGSASATASLVSVSTTAGASVSLGASASGSAAAAGSGSLASSVSAAAG

SEQ ID NO: 203714 - protein, 144 aa, Triticum aestivum
  unsure (1)..(144): unsure at all Xaa locations
  Clone ID: PAT_TA_98132.pep
QGQQSVQGQQGQQPGQGQQAYYPTSSQQSRQRQQAGQWQRPGQGQPGYYPTSPQQPGQEQQSGQAQQSGQWQLVYYPTSPQQPGQLQQPXAQGQQPAQGQQSAQEQQPGQSPTIKGQWXTXXYYPTSPQQKDGQQVLNPTFSTK

SEQ ID NO: 203715 - protein, 100 aa, Triticum aestivum
  unsure (1)..(100): unsure at all Xaa locations
  Clone ID: PAT_TA_98133.pep
CPFHTXQFTFYTPTAETHTHNSGEFGSHLKHLREFRPEGTTTWLTHTHTHTYIHTPVSELSVRAAPANMLQKGLQNKGEDVGYKTRSPPLQWERAAHDKD

SEQ ID NO: 203716 - protein, 131 aa, Triticum aestivum
  unsure (1)..(131): unsure at all Xaa locations
  Clone ID: PAT_TA_98134.pep
CREIVTSPEFCGKLTFPVSLKQPGPRDXMIQCFIKRDKSKSTYHLYLCLTNAVLVENGKFLLSAKRIRRTTCTEYVISMDAENISXSSSTYIXKLRSNFLGTXHFIXYDTQPPYNGAFSSSGWDRPIQLKG

SEQ ID NO: 203717 - protein, 98 aa, Triticum aestivum
  unsure (1)..(98): unsure at all Xaa locations
  Clone ID: PAT_TA_98135.pep
FDRSYRFHPFHQRSECRLGSPQQRQRHHAAVRVRARGPRPPGAAGRGRRRILREGEGGEAAGADAGGGAGGPGRRGGVERXVRVRGEGRRCXXSXWRG

SEQ ID NO: 203718 - protein, 107 aa, Triticum aestivum
  unsure (1)..(107): unsure at all Xaa locations
  Clone ID: PAT_TA_98136.pep
XRWGRXKLYILGXRRIYXIXDDDGEEEEXPHRPRSSRTAAPSASPTPTNRXRPRRRPSLXPSPSXSPAPPPPRXSGSGWAVAGCXIARRGGEGGGVGVDLLGERRRI

SEQ ID NO: 203719 - protein, 143 aa, Triticum aestivum
  unsure (1)..(143): unsure at all Xaa locations
  Clone ID: PAT_TA_98137.pep
GQQGQQPGQGQQGQQPGEGQQGQQPGQGQQPGQGQPGYYPTSLQQSGQGQQPGQWQQPGQGQPGYYPTSSLQPEQGQQGYYPTSQQQPGQXGPQPGQWQQSGQGXQKGTTPTSPQQSXTRGQQPRDNWLATKDNWAAIKGNLP

SEQ ID NO: 203720 - protein, 92 aa, Triticum aestivum
  unsure (1)..(92): unsure at all Xaa locations
  Clone ID: PAT_TA_98138.pep
VVSQQQQQQILQQILQQQLIPCRDVVLQQHNIAHASSQVLQQSSYQQLQQLCCQQLFQDXEQSRCQAIHNVVHAIILHHHQQQQQQPSSQVS

SEQ ID NO: 203721 - protein, 76 aa, Triticum aestivum
  unsure (1)..(76): unsure at all Xaa locations
  Clone ID: PAT_TA_98139.pep
LAERRASRAGFSIPKIDTSRVGSSTVIRSPIAIPPGLSPTTLLESPVFLYNAMXKPSPTTGKLFVAPEANSTMPPR

SEQ ID NO: 203722 - protein, 133 aa, Triticum aestivum
  unsure (1)..(133): unsure at all Xaa locations
  Clone ID: PAT_TA_98140.pep
MSPQTETKAGVGFKAGVKDYKLTYYTPEYETKDTDILAAFRVSPQPGVPPEEAGAAVAAESSTGXTWTTVWDXDDLPSLDRYKGRCYHIEPVAGEDSQWICYVAXPLNLFEEGSVTNMFTSIVGXVFGFXSPC

SEQ ID NO: 203723 - protein, 141 aa, Triticum aestivum
  unsure (1)..(141): unsure at all Xaa locations
  Clone ID: PAT_TA_98141.pep
STEKKKKKKKKRKKKKKKKKKKKKKKNKKKKMFADMGFSFSAYSSSPSDYSYSYSPVFSHPHSDYSSVFSPSSSAALAQPSSLSLPLLHQQHQATVVAAPNXVXAARHVPPPRETWGQAIPDIKSMTLXAKRRPVQRLRGA

SEQ ID NO: 203724 - protein, 141 aa, Triticum aestivum
  unsure (1)..(141): unsure at all Xaa locations
  Clone ID: PAT_TA_98142.pep
PRCDDAGARREVDFGASHVMQERKRREKLNERFIVLRSLVPFVTKMDKASILGDTIEYVKQAXKRIQDLESSTVRGPAMSKEKRALPTGMEGASSSSGSTPXPRDVQVSIIESXALLELRCPDTHGLLVTIMQAPGASSGS

SEQ ID NO: 203725 - protein, 83 aa, Triticum aestivum
  unsure (1)..(83): unsure at all Xaa locations
  Clone ID: PAT_TA_98143.pep
GSLSTIYFLSRAVPHGINRRRPCCPREGFLAGXEDRRRVPLVASGATTPREVCGLGHGRHAYVTSSAGRRRXGNXRGAGGHRL

SEQ ID NO: 203726 - protein, 126 aa, Triticum aestivum
  unsure (1)..(126): unsure at all Xaa locations
  Clone ID: PAT_TA_98144.pep
MGKEKTHINIVVIGHVDSGKSTTTGHLIYKLGGIDKRVIERFEKEAAEMNKRSFKYAWVLDKLKAERERGITIDIALWKXETXKYYCTVIDAPWSTLTSSKXMITGTSQAGLVLCSTIDSXTGGFE

SEQ ID NO: 203727 - protein, 135 aa, Triticum aestivum
  unsure (1)..(135): unsure at all Xaa locations
  Clone ID: PAT_TA_98145.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFRXEHNASPWVLTNGPGIWDKLWEACLCFGGALDQQQG

SEQ ID NO: 203728 - protein, 94 aa, Triticum aestivum
  unsure (1)..(94): unsure at all Xaa locations
  Clone ID: PAT_TA_98146.pep
ISXPNSSLVXTAEDEVEATTTFSDASRGKTXPSDSVCCFRPSPIIMXAPDLGKTDAFDRGDSRSGCDWSPAPRIPDLDATGRPHLGFQIWMETH

SEQ ID NO: 203729 - protein, 129 aa, Triticum aestivum
  unsure (1)..(129): unsure at all Xaa locations
  Clone ID: PAT_TA_98147.pep
SSLPWTNRPGFGLKALPLVSCLDPRGASWLFGRLGLRLGRKLAWLGLLWPPSVSAGARPPSSLGRLNLDGGKXPRPRPPPARGPPPSSGPPRRPPASPPRAPPPSARPSGSGHQRWPLPSWMQENARSG

SEQ ID NO: 203730 - protein, 102 aa, Triticum aestivum
  unsure (1)..(102): unsure at all Xaa locations
  Clone ID: PAT_TA_98148.pep
KTSRRLLPQDXASPDSTTAISSXLLVFXTXAXRXXACWGARITSVLGSKLSRLISVLKHQXEANNKXKLEGKTFSQDSSKDRLSMXTKKDGVLSWXCGXFXX

SEQ ID NO: 203731 - protein, 132 aa, Triticum aestivum
  unsure (1)..(132): unsure at all Xaa locations
  Clone ID: PAT_TA_98149.pep
HPAVGCFVTHCGWNSALESIACGVPVAAVPQWTDXXTVAWLVEECAGVGVRAQADGEAVAERGELQRCVETVMGDGEAAVEIRSXAAKWMERAREALAAGGTPWRRXLRXFLSWFLKEGTYALCNEDFATWS

SEQ ID NO: 203732 - protein, 141 aa, Triticum aestivum
  unsure (1)..(141): unsure at all Xaa locations
  Clone ID: PAT_TA_98150.pep
MKTFLILALLAIVATTATTAVRVPVPQLQPQNPSQQQPQEQVPLVQQQQFPGQQQQFPPQQAIXPKPQPFPSQQPYLQXLQPFPQAGNHFRQQLPISRKPANQFSNQQQTQXSTNKQPTVFLQTXNXQFSQXTKAQQPTNN

SEQ ID NO: 203733 - protein, 52 aa, Triticum aestivum
  Clone ID: PAT_TA_98151.pep
QNATTRARVAAFAQSQDSFFSSWAGSFARLTSLGVKTGSAGEVRRLCSSVNG

SEQ ID NO: 203734 - protein, 95 aa, Triticum aestivum
  unsure (1)..(95): unsure at all Xaa locations
  Clone ID: PAT_TA_98152.pep
MSDTDEHHFESKADSGASKTYPQQAGAIRKGGHIVIKARPCKVVEVSTSKTGKHGHAKCHFVAIDIFNGKXKLEDIVPSSHNCDVPHVDRXDYQD

SEQ ID NO: 203735 - protein, 94 aa, Triticum aestivum
  Clone ID: PAT_TA_98153.pep
MSCIAFMIIIFQLHSCDLLACILLIAVDKWGSRTELMFTVLPMTTVTTNCLISTCIPMFFSQCRSAKELMACISSDPTVWLNNWFLIEGACKLD

SEQ ID NO: 203736 - protein, 150 aa, Triticum aestivum
  unsure (1)..(150): unsure at all Xaa locations
  Clone ID: PAT_TA_98154.pep
KQPGQGQQGYYPTSPQQSGQGQQLGQGQPGYYPTSPQQSGQGQQSGQGQQGYYPTSPQQSGQGQQPGQGQSGYFPTSRQQSGQGQXQPGQGQQSGTXATKVKQPRTRDNKAYYPTSSATVKDKXQQGKDNWQRPGNKGNQGXYPTSPQAS

SEQ ID NO: 203737 - protein, 105 aa, Triticum aestivum
  unsure (1)..(105): unsure at all Xaa locations
  Clone ID: PAT_TA_98155.pep
ERDXHRXIHXSQXHISFPMAPIKIGINGFXXIGXLVGQGCAPXXLCXXRRXQSXLHHQPYXMILHXSXFYXXPLXKFQXLLXXXLKGXQRTLPLSGHKXXVSXSL

SEQ ID NO: 203738 - protein, 81 aa, Triticum aestivum
  unsure (1)..(81): unsure at all Xaa locations
  Clone ID: PAT_TA_98156.pep
MASIAGSAVSFAKPVKAINTNSLSFSGARRGNAFLRLQPVPXRFAVCCSAKQDTVEKVCEIVKKQLAVPEGTEVCGTNQVF

SEQ ID NO: 203739 - protein, 136 aa, Triticum aestivum
  unsure (1)..(136): unsure at all Xaa locations
  Clone ID: PAT_TA_98157.pep
MKTFLILALLAIVATTATIAVRVPVPQLQPQNPSQQQPQEQVPLVQQQQFPGQQQPFPPQQPYPQPQPFPSQQPYLQLQPFPQXPQLPNPQXPQLPYPQPQLPYPQXQPFRPKQPYPQSQPQFSQPQQPISXXQQA

SEQ ID NO: 203740 - protein, 124 aa, Triticum aestivum
  unsure (1)..(124): unsure at all Xaa locations
  Clone ID: PAT_TA_98158.pep
QLKIDELRLFIGRRHTADLKDGWVQDPRFGPERTPTDRRYILGISKKKKRGLVSLLEVPLRSQSQDEEDQEPSTMEKRLRSAPSVALKKLHDLIASLDEEKYSMXSKMDFGGLLELNTLMGGTP

SEQ ID NO: 203741 - protein, 136 aa, Triticum aestivum
  unsure (1)..(136): unsure at all Xaa locations
  Clone ID: PAT_TA_98159.pep
RPSDKPLRLPLQDVYKIGGIGTVPVGRVETGVIKPGMVVTFGPTGLTTEVKSVEMHHXXLLEALPGDNVGFNVKNVAVKDLKRGFVASNSKDDPAKEAANFTSQVIIMNHPGQXGEPLTPXMLGTAHTSHIAFKFA

SEQ ID NO: 203742 - protein, 97 aa, Triticum aestivum
  Clone ID: PAT_TA_98160.pep
NSTHIKLLEIQIPESKPIPTSISYLPSRPDPTHLKNQASYFASLGMSFHVAQSLTMLDAKHLSYTNAICFSYSSGHLRNQQPQECIVMNKYKGSHFI

SEQ ID NO: 203743 - protein, 94 aa, Triticum aestivum
  unsure (1)..(94): unsure at all Xaa locations
  Clone ID: PAT_TA_98161.pep
MAGGRGGARRGAVAVAAAALAVACCCVGVASAATYYVGDVGGWSLXSGSWPNGKQFRAGDVLXVFKYXPLMXNVVXXGXDXTTFHARAGVEGPN

SEQ ID NO: 203744 - protein, 76 aa, Triticum aestivum
  Clone ID: PAT_TA_98162.pep
EENNSSTRYMKHRFLSPWFGRCSGEKIMWHALSCKNPNYTSSNLGIKDKHRSCLQKKKKKKKKKKKKKKKKKKKKK

SEQ ID NO: 203745 - protein, 76 aa, Triticum aestivum
  Clone ID: PAT_TA_98163.pep
CCLAASQIRNVGNNFACELAWHLLPLRLSQVINRRYHGYRVGWHLLFQQPCYYIRPKITSSIQIKKKKKNSRLVLS

SEQ ID NO: 203746 - protein, 76 aa, Triticum aestivum
  unsure (1)..(76): unsure at all Xaa locations
  Clone ID: PAT_TA_98164.pep
MTFKRXNGGRNKHGRXXVKYIRCSNCXKCCXXDXAIKRFLVXEHRXRNAAVXDVQXEACXHDXYVLPKAWLYAIGF

SEQ ID NO: 203747 - protein, 142 aa, Triticum aestivum
  unsure (1)..(142): unsure at all Xaa locations
  Clone ID: PAT_TA_98165.pep
EPRWSSLFLNSPFHATSPCPSTHTGLWCVFSGPLAAAFKHVPASAAGGRGRAPQGASTHGHRKPGSELAGTLPAAALAPAGRHRIDLHRPPPCSMADWPRPAWLQPAAAKAAARAHPRPPRVDAXARSRPPRACCSVSPSPS

SEQ ID NO: 203748 - protein, 77 aa, Triticum aestivum
  unsure (1)..(77): unsure at all Xaa locations
  Clone ID: PAT_TA_98166.pep
MHLGYVFXSGXLPITREINTPXEYDEVXLLXFGRVYIXXXKKXYQXYPVXGALKPGTXPDLMGGQPVTNRGPGXXGG

SEQ ID NO: 203749 - protein, 110 aa, Triticum aestivum
  unsure (1)..(110): unsure at all Xaa locations
  Clone ID: PAT_TA_98167.pep
RFGPPSKLASAPALMARPMPPAXLQATKLHGKYFGNRPSFSYNVSXTCQCLTCLLVKXFQLDTXDKTRXSKSLXFGXTXNXLKPXXSLGEXAPPKXXQIPLGPYXETKFL

SEQ ID NO: 203750 - protein, 91 aa, Triticum aestivum
  Clone ID: PAT_TA_98168.pep
GESQMDDLEGPCKSPILPLLVPLLNLPGLNPAFQAAATRQEAAAGGSTSRRLQTASRGGCRRRREEATGGSARRGCGRRRRIEEAATQGGG

SEQ ID NO: 203751 - protein, 68 aa, Triticum aestivum
  Clone ID: PAT_TA_98169.pep
PRCYQPYHSSQPPLQYCRRVFFHNSSFFLLLIGSSVKLSGEVVKPLTDTSPPKLLICRAKKRSPVGEP

SEQ ID NO: 203752 - protein, 134 aa, Triticum aestivum
  unsure (1)..(134): unsure at all Xaa locations
  Clone ID: PAT_TA_98170.pep
RPPPSKSDNLFMQIAVHPDGAVTRPVVPTIPASDAGSGAAVFSRDVPLDTSLGTYIRLYLPNPVPSSTKLPVILYFHGGGFVVFNADTAFYHASCEAMAAGVPGIVASLEXASQPKQRLAAAYDDPLAGVIWLR

SEQ ID NO: 203753 - protein, 68 aa, Triticum aestivum
  unsure (1)..(68): unsure at all Xaa locations
  Clone ID: PAT_TA_98171.pep
RGIDPRCFQGRNVEXAPKYLLXSKLKDLQFFVGESMHDDGGVVFAYYKEGAADPTFLYFAHGLKEVKC

SEQ ID NO: 203754 - protein, 133 aa, Triticum aestivum
  unsure (1)..(133): unsure at all Xaa locations
  Clone ID: PAT_TA_98172.pep
FDDSRTGVNRKLELWRQTLKSKGXEYMMCGFSTNRHKEEEVCLDEQVVPQKDIFRYLGSMLQKDGDIDEDVNHRIKAGWMKWHKASSILCDKRVPQKLKGKFYRTAVRPTMLYGAECWPTKRQYVQQLGVPEM

SEQ ID NO: 203755 - protein, 134 aa, Triticum aestivum
  unsure (1)..(134): unsure at all Xaa locations
  Clone ID: PAT_TA_98173.pep
EGASYYGYASGXATGIASRARVAMYKALWDEGDYASDIIAAIDSAISNGVDVLSLSFGFDDVPLYEDPVAISHRFQANGRKGIFVSNVKQGKRRGFPWEDFTMGITMGNPWLAGNLGPISRLLKPNGVQTGKVP

SEQ ID NO: 203756 - protein, 130 aa, Triticum aestivum
  unsure (1)..(130): unsure at all Xaa locations
  Clone ID: PAT_TA_98174.pep
MKTFLIFALLAVAATSAIAQMETSHIPGLEKPSQQQPLPLQQILWYHQQQPIQQQPQPFPQQPPCSTATTXHHYRKQQQPPFSQXQQTTILASKELPILPQQPTIFXQQQQPQFSXKQQQPFPQQQQPLT

SEQ ID NO: 203757 - protein, 137 aa, Triticum aestivum
  unsure (1)..(137): unsure at all Xaa locations
  Clone ID: PAT_TA_98175.pep
PPSLSRPPVSAHLLRLRRRRTHRGSSDSPDQERRAGRKSTYAGGEEMGLTFTKLFSRLFAKKEMRILMVGLDAPGKTXILYKLKLGEIXTXXPTIXGFNVETVXEXKNIXFTXWDVXGSRXKLRPLXXRHYFQNTXX

SEQ ID NO: 203758 - protein, 59 aa, Triticum aestivum
  unsure (1)..(59): unsure at all Xaa locations
  Clone ID: PAT_TA_98176.pep
NXXQKLNYSCHQMDNXNNFTCDIGVEVGCKSXQWQSVGMALXKLVITVAPQKLETLPFK

SEQ ID NO: 203759 - protein, 140 aa, Triticum aestivum
  unsure (1)..(140): unsure at all Xaa locations
  Clone ID: PAT_TA_98177.pep
MKTFLILALLAIVATTATIAVRVPVPQLQPQNPSQQQPQEQVPLVQQQQFPGQQQPFPPQQPYPQXPQPFPSQXQPYLQLQTISGKPAXYQYPAGRQPTNYPGQXRXPISGPTXNPIIPTNXQIPQGXSXTXQTKPIFRQ

SEQ ID NO: 203760 - protein, 130 aa, Triticum aestivum
  Clone ID: PAT_TA_98178.pep
MKTFLILALLAIVATTATTAVRVPVPQLQPQNPSQQQSQEQVPLVQQQQFLGQQQPFPPQQPYPQAQPFPSQQPYLQAGKHFRQAATQYSASQQPISDPTTNPIFQQTRQTNLFRQPNHSKFSTKPKPQN

SEQ ID NO: 203761 - protein, 64 aa, Triticum aestivum
  unsure (1)..(64): unsure at all Xaa locations
  Clone ID: PAT_TA_98179.pep
MSKQGGKAKPLKQAKVPEKDYDENDLAYLQKKKDEQKALKELKAKAGXKGXLGGSGLKEEWGKK

SEQ ID NO: 203762 - protein, 134 aa, Triticum aestivum
  unsure (1)..(134): unsure at all Xaa locations
  Clone ID: PAT_TA_98180.pep
IVPASHAFSLVGSNGFTNHTHLVRTCNLFXSLYFFFDSCRIPCNYSSSFILARLHIIRMEQDVASFIYLYGDCIQSSLITNSSQSGIPPGTLISSLILEYTSPWTQRNFAVTTEHGERNQPVKHTGQRHGSRAF

SEQ ID NO: 203763 - protein, 50 aa, Triticum aestivum
  Clone ID: PAT_TA_98181.pep
SSPVPMYSHMHHISPSVIFSCRDEKQYTMIWSYNQGLHGKTTDYRMKCML

SEQ ID NO: 203764 - protein, 69 aa, Triticum aestivum
  Clone ID: PAT_TA_98182.pep
SFFLPEKRSLLHVTNIVHWYKTDRQLQLQEMSQIGTDTWLSTFQRATIHHKIVVQGAASREQRNGGDHL

SEQ ID NO: 203765 - protein, 122 aa, Triticum aestivum
  unsure (1)..(122): unsure at all Xaa locations
  Clone ID: PAT_TA_98183.pep
MKKFLVLALIVVAATTTAAEPFTAFRSAWEPQHPSTPEHQPTPHSXXYPVPHQKLNPCRDALLQQCSPVADMSFLRSQVVQHSSCLVMWEQCCQQLKAIPKQSRCEAIHNVVHAIILQQQQQ

SEQ ID NO: 203766 - protein, 68 aa, Triticum aestivum
  Clone ID: PAT_TA_98184.pep
PAPARVPPQPPILRSASAPRASPPPPPPPPHRGAHARTRPPPTRIQDPRGGGGAGEGEGEGSAPAACR

SEQ ID NO: 203767 - protein, 94 aa, Triticum aestivum
  unsure (1)..(94): unsure at all Xaa locations
  Clone ID: PAT_TA_98185.pep
RSXLGLGPCPRWFGVLQIXVCVLVQPQGXQHFWHPPEQQNDXCWLHLPPRARTRHLVILVHSTMVHCFSIRSLLLFSSYVVRSFFFSSRGDHVG

SEQ ID NO: 203768 - protein, 131 aa, Triticum aestivum
  unsure (1)..(131): unsure at all Xaa locations
  Clone ID: PAT_TA_98186.pep
MKKFLVLALIVVAATTTAAEPFTAFRSAWEPQHPSSPEHQPTPQPQXIQVPHQKLNPCRDALLQQCSPVADMSFLRSQVVQHSSCLVMXXQCCQQLKAIPKQSRCEAIHNVCARHLFCKQQQQFGKPFNPT

SEQ ID NO: 203769 - protein, 126 aa, Triticum aestivum
  Clone ID: PAT_TA_98187.pep
QLPPFSQQQSPFSQQQQIVLQQQPPFLQQQQPSLPQQPPFSQQQQQLVLPQQQIPFVHPSILQQLNPSKGIPPSNGPGGNGNKSPWLAAKWFARGFANVDCKQTFAASLAKFPPSNSPLLKRGNQS

SEQ ID NO: 203770 - protein, 147 aa, Triticum aestivum
  unsure (1)..(147): unsure at all Xaa locations
  Clone ID: PAT_TA_98188.pep
HQSTXKTFLVFALLALAAASAVAXXSQQQQAPPFSQXQQPPFSQXQQPPFSQXQXSPFSQQQQHSTICACXQQPPFSQQPXFSQXQYPPFSQHQXPQXFSQHXQPPYSQXQXRPXYSQGXXXHHFXQASKQPPFSXAXXNXPPFTQQ

SEQ ID NO: 203771 - protein, 131 aa, Triticum aestivum
  unsure (1)..(131): unsure at all Xaa locations
  Clone ID: PAT_TA_98189.pep
MKTLLILTILAMAITIGTANIQVDPSGQVQWLQQQLVPQLQQPLSQQPQQTFPQPQQTYPHQPQQQFPQTQQPQQPFXKPQQTFPQQPQLPFPQXPQQPFPQPQKPXQQFPPVHKXQQXTFFPRPQKTISW

SEQ ID NO: 203772 - protein, 125 aa, Triticum aestivum
  unsure (1)..(125): unsure at all Xaa locations
  Clone ID: PAT_TA_98190.pep
QQAQQQQQQQQQQILQQILQQQQLIPCRDVIVLQQHNIAHESSQVLQQSSYQVLQQLCCQQLRQIPEXQSRCQAINNVVHAIILHQQQQXXGTXXQSSQVSYQQPQQXXPSGQGLLXAISKIHRA

SEQ ID NO: 203773 - protein, 110 aa, Triticum aestivum
  unsure (1)..(110): unsure at all Xaa locations
  Clone ID: PAT_TA_98191.pep
PQHPSSPEQQPTLQPQEHPVPHQKLNPCRDALLHQCSPXVADMSFLRSQVVQHSXCLVMXKQCCQQLKAIPKQVXCEAIHNVVHAIILQQAKTIXTRVFKPTSSKQQQQT

SEQ ID NO: 203774 - protein, 143 aa, Triticum aestivum
  Clone ID: PAT_TA_98192.pep
NKLTGGIPTSVSKLCNLVQIKLSGNILSGDIAKVAKSLFPCMKRLQVLELSGNKLTGNLSGWLEGMSGLRILDLSANSLSGVVPHGIGNLSSLTYLDISFNRFKGTLSELHLANLSRLDTLNLASNSFEIVIKQSWLPPFQLI

SEQ ID NO: 203775 - protein, 51 aa, Triticum aestivum
  Clone ID: PAT_TA_98193.pep
RSTRVHSTVISMFKCSYQLLITIHVCNQTSGEICFHDDKTSYAGNQKKKKK

SEQ ID NO: 203776 - protein, 91 aa, Triticum aestivum
  unsure (1)..(91): unsure at all Xaa locations
  Clone ID: PAT_TA_98194.pep
YDRTKRMVIPDALKVLRLQPGHRYCLLGQLSKEVGWNYADTIRELEEKXKEKANISYYRRKQLAXLRVKAENAXEGEVGNSSWRSLAPIXS

SEQ ID NO: 203777 - protein, 105 aa, Triticum aestivum
  unsure (1)..(105): unsure at all Xaa locations
  Clone ID: PAT_TA_98195.pep
MADRGGYVQVXHGQYXGGHHGGQQQHGRQMGEQXKGMLXXKAPSASQALTVATLFXAGTWLLLDCRSLAGAVVAWAHAWFLLFPRLPAPHHGWPVHRFHPHAWGG

SEQ ID NO: 203778 - protein, 119 aa, Triticum aestivum
  unsure (1)..(119): unsure at all Xaa locations
  Clone ID: PAT_TA_98196.pep
QLQQPQQPFPQPQQQLPQPQQPQQSFPQQQRPFIQPSLQQQLNPCKNILLQQCKPASLVSSLWSIIWPQSDXQVMRQQMLPNLATRFLKQAPRLRKAIPIVGNSNQSAKASKNQNKGWQ

SEQ ID NO: 203779 - protein, 64 aa, Triticum aestivum
  unsure (1)..(64): unsure at all Xaa locations
  Clone ID: PAT_TA_98197.pep
PHPRGYYKCSXVRGCPARKHVERCVDDPAMLIVTYEGDHNHNHNQAAAAXPGSMSRGASTTPRC

SEQ ID NO: 203780 - protein, 42 aa, Triticum aestivum
  unsure (1)..(42): unsure at all Xaa locations
  Clone ID: PAT_TA_98198.pep
MEDERSTQSYQGGEAAEQVEVTDRGLLGNLLGKKKAEEDKEX

SEQ ID NO: 203781 - protein, 143 aa, Triticum aestivum
  unsure (1)..(143): unsure at all Xaa locations
  Clone ID: PAT_TA_98199.pep
QPGYYPTSQQSEQGQQPGQGKQPGQGQQGYYPTSPQQSGQGQQLGQGQPGYYPTSPQQSGQGQQSGQGQQGYYPTSPQQSGQGQQPGQGQSGYFPTSRQQSGQGQQPGQGXQSGQGQXGQQPGQRTNKRSTQTSSPQSTKGRA

SEQ ID NO: 203782 - protein, 94 aa, Triticum aestivum
  unsure (1)..(94): unsure at all Xaa locations
  Clone ID: PAT_TA_98200.pep
GGGXETMEQXARNLGRRSNPXGXXRXVGXPRRRRPXAGXRRRXGAARARTXPGXPSWAWTWASARRRAAGRRRIGWRRRRASWLLLPVVLGASG

SEQ ID NO: 203783 - protein, 129 aa, Triticum aestivum
  unsure (1)..(129): unsure at all Xaa locations
  Clone ID: PAT_TA_98201.pep
MKTFIILALLAIVATTATTAVTVPVPQLQPQNPSQQQPQKQVPLVQQQQFLGQQQPFPPQQPYPQPQPFPSQQPYPQPQPFLPQLPYPRPQPFLPQXXYPXPEPQVSANHNNPISPQXASNHPNHQSTK

SEQ ID NO: 203784 - protein, 108 aa, Triticum aestivum
  unsure (1)..(108): unsure at all Xaa locations
  Clone ID: PAT_TA_98202.pep
MKTFLIFALLAIVATSAIAXXXNSHIPGLXRPSQXQPLPPXXTLSHHXQXQPIQQQPQPFSXQXPCSQQQXQPLSQQXPSHHFHNXXSPFSXXXXQQPLSXHXQPPFS

SEQ ID NO: 203785 - protein, 106 aa, Triticum aestivum
  unsure (1)..(106): unsure at all Xaa locations
  Clone ID: PAT_TA_98203.pep
MKTFLILALLAIVATTATTAVRVPVPXLQPQXPSQASAKKSKFQLGTTNNXFLGAXXNQFPTNNNQYPQARQPFPSQQPYPAAGKPFPEAAITIFRSQTIRTSQNP

SEQ ID NO: 203786 - protein, 139 aa, Triticum aestivum
  unsure (1)..(139): unsure at all Xaa locations
  Clone ID: PAT_TA_98204.pep
PPPCAAASSMRRRRPQPPPCAAARSLLATPSAASSRCRMQPPRRVATGHSLLMRSRRLKSWISPRQVKKWNEAEGKWEICRALLNHPFEILLSCFCVSAIAVLCSNLVPPVMVLFSKXSLQXTYVMFFPVAQYXXXAMX

SEQ ID NO: 203787 - protein, 122 aa, Triticum aestivum
  unsure (1)..(122): unsure at all Xaa locations
  Clone ID: PAT_TA_98205.pep
MADRGGYVQVQHGQYGGGHHGGQQQHGRQMGEXQMKGMFQGEGADVGDXFPLGGLLXLVLSGPGAGGQPVVGAGPLGQRPCSLLFKPQXLVPGPRLNNRGLGPFRGFPPGLGGLGGPLPLKR

SEQ ID NO: 203788 - protein, 134 aa, Triticum aestivum
  unsure (1)..(134): unsure at all Xaa locations
  Clone ID: PAT_TA_98206.pep
ANLNIAHXLVLSLXLSKSLGINLXRNIHRHRLLDRRSEPVENGDGGADRCGIVSYAVAMRSAGNQFLRCARIKSRIHPLAYTTIRLAQPKDNRTRQGGAAANAWRSWGEKAAGNGVVTELVVEATAVAAGGEVA

SEQ ID NO: 203789 - protein, 136 aa, Triticum aestivum
  unsure (1)..(136): unsure at all Xaa locations
  Clone ID: PAT_TA_98207.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVXARHRFAXSNKQFGTRYFHPNLKQQ

SEQ ID NO: 203790 - protein, 146 aa, Triticum aestivum
  unsure (1)..(146): unsure at all Xaa locations
  Clone ID: PAT_TA_98208.pep
ELVSEFFCLRQGMLIMTSSTALPWLLPRSSDESSGVHRAAVYLGLYLVALGTGGIKPCATALGADQFDVAVPAERVAKGSFFNWYYFSINIGSLLSATFLVWVQDNIGWXVGLAIPTVLIGFGLARNPWPGEDIKGYKPMGSGKVT

SEQ ID NO: 203791 - protein, 147 aa, Triticum aestivum
  unsure (1)..(147): unsure at all Xaa locations
  Clone ID: PAT_TA_98209.pep
SSPLRLLPVSPPAIPFPFPAGRRAASRSSMPLPQTTGAMLPPSPVPPPSSALQLPVVEPHAAGNRRSARSWQPPNVQQVGVVISSTTTKRYCELLPHVLLTCLIFSHLASLPPRQSEREPAEALNCLNLGVGQVPASSXGTGIRKIT

SEQ ID NO: 203792 - protein, 132 aa, Triticum aestivum
  unsure (1)..(132): unsure at all Xaa locations
  Clone ID: PAT_TA_98210.pep
EPQHPSSPEHQPTPQPQEHPVPHQKLNPCRDALLQQCSPVADMSFLRSQVVQHNXCLVMWEQCCQQLKAIPKQSRCEGHPQTFVHAIFLQQXTTIGXKLLSTQPXXAXKKQGSTNNNXVWGSSQPQQQTQLD

SEQ ID NO: 203793 - protein, 152 aa, Triticum aestivum
  unsure (1)..(152): unsure at all Xaa locations
  Clone ID: PAT_TA_98211.pep
PLRPPLPPRRRQSRPRPPPRRPPLPPXQAPVNAPAVPAPTTTPAAPAPVVKAPATPAPXPRRPPLQLPPPRRSRPQPPLRPRPRRSPLPSLPPPSLPPPQAPPXPLPSPRPRPLLQAPTAKXTAPAPAALPPNVEAPAGAAANARSPRCLPX

SEQ ID NO: 203794 - protein, 56 aa, Triticum aestivum
  unsure (1)..(56): unsure at all Xaa locations
  Clone ID: PAT_TA_98212.pep
MLVYQDKLSGDEXLLSDSFPYRELENGVLWEVDGHWVVQGAVDVDIGANPSAEGGW

SEQ ID NO: 203795 - protein, 134 aa, Triticum aestivum
  unsure (1)..(134): unsure at all Xaa locations
  Clone ID: PAT_TA_98213.pep
MATTAMALSPSSFAGKAVKDLPSSALFGEARVTMRKTAAKAKPVSSGSPWYGSDRVLYLGPLSGDPPSYLTGEFPGDYGWETAGLSXEPQNFAKKRELXVXCRWAMXGALRXSSPNWXXANGXNSGXXXWVKGR

SEQ ID NO: 203796 - protein, 79 aa, Triticum aestivum
  unsure (1)..(79): unsure at all Xaa locations
  Clone ID: PAT_TA_98214.pep
MSCCGGNCGCGSGCKCGNGCXGCKMXPXMDXGVTXXSXTLIMGVXPSKGTPSXQGAXXNGAXNRGXKLRLQLAPSNCFK

SEQ ID NO: 203797 - protein, 124 aa, Triticum aestivum
  unsure (1)..(124): unsure at all Xaa locations
  Clone ID: PAT_TA_98215.pep
MAAAGDAGEKKMITLKSSDGEEFEVEEAVAMESQTIRHMIEDDCADNGIPLPNVNSKILSKVIEYCNKHVQXAKPADGAAAGAGAGASDAAPAAPAXDLKNWDXSSSKVDXANXFELILGCQTT

SEQ ID NO: 203798 - protein, 146 aa, Triticum aestivum
  unsure (1)..(146): unsure at all Xaa locations
  Clone ID: PAT_TA_98216.pep
FPLQPQQPFSQPQLQFPQQPEQIIPQQPQQPFLLESQQPFPQQPQQPFSQPQQLIPMQPQQPFPQQSQQSQXPFPGPQQLFPELQQPIPQQPQQPFPLQPXQPFPQQSQQPFPQXPQXPFPXXPQXXFPQQTPIPPNQEASFPPKA

SEQ ID NO: 203799 - protein, 95 aa, Triticum aestivum
  unsure (1)..(95): unsure at all Xaa locations
  Clone ID: PAT_TA_98217.pep
KWFPRVDELEIEIAAGTFLKQSQVRIMGAGGSIQDPDKTTVTIDLVPLGQKFDRTSALLISNRFLRKKVPIKSSIFGXDYDVTYVHYPGLPSSGT

SEQ ID NO: 203800 - protein, 52 aa, Triticum aestivum
  Clone ID: PAT_TA_98218.pep
ISPGWRHVLAAHRVLRKLDKEHNAVFTIHIQIQPNELVQPVHRFSYLGRRED

SEQ ID NO: 203801 - protein, 142 aa, Triticum aestivum
  unsure (1)..(142): unsure at all Xaa locations
  Clone ID: PAT_TA_98219.pep
MARTKQTARKSTGGKAPRKQLATKAARKSAPATGGVKKPHRFRPGTVALREIRKXYQKSTELADSASLPFQAPGWEDSPQRTKNRTFRLSKKLRPFSACKGGPEVLTSGLPKEKPGPQSRGVQPKGNQPERGKGLKLTPFGF

SEQ ID NO: 203802 - protein, 128 aa, Triticum aestivum
  unsure (1)..(128): unsure at all Xaa locations
  Clone ID: PAT_TA_98220.pep
MQIFVKTLTGKTITLEVESSXDTIDNVKAKIQDKEGIPPDQXQRLIFAGKQLEDGRTLADYNIXKESTLHLVLXLRGGMXIFVKTLTGKTITLEVESSDTIDNXKXKXQDKXXIPPGXKRLIFXGKAT

SEQ ID NO: 203803 - protein, 65 aa, Triticum aestivum
  unsure (1)..(65): unsure at all Xaa locations
  Clone ID: PAT_TA_98221.pep
NGPFIVHRGIILLLILAGNCMPHMNIAIYLGFIPFTGFRNQRNRKGKGLKKKKKXKKKKXKKKKK

SEQ ID NO: 203804 - protein, 74 aa, Triticum aestivum
  unsure (1)..(74): unsure at all Xaa locations
  Clone ID: PAT_TA_98222.pep
ELQSPQQSFSHQQQXFPQQPYPQQPYPSXQPYPSQQPFPTXQPQFPQXXSNXQFXQPQHPIPLQPQXPFPQVSP

SEQ ID NO: 203805 - protein, 117 aa, Triticum aestivum
  unsure (1)..(117): unsure at all Xaa locations
  Clone ID: PAT_TA_98223.pep
MVKAVAVLTGSEGVKGTIFFTQEGDGPTTVTGSVTGLKEGLHGFHVHALGDTTNGCMSTGPHFNPAGHVHGAPEDEIRHAGDLVNVTAGADGVANINVTGLAXIPXTGPNSXCLAVA

SEQ ID NO: 203806 - protein, 135 aa, Triticum aestivum
  unsure (1)..(135): unsure at all Xaa locations
  Clone ID: PAT_TA_98224.pep
MKTLFILTILAMATTIATANMQVDPSGQVQWPQQQPFRQPQQPFYQQPQQTFPQPQQAFPHQPQQQFPQXPQQPQQQFPQPQQPQQPFPQPQQAQLPFPQQPQQPFPQPQQPQQPFPQXQQPQQPFPQAQQPQQX

SEQ ID NO: 203807 - protein, 80 aa, Triticum aestivum
  unsure (1)..(80): unsure at all Xaa locations
  Clone ID: PAT_TA_98225.pep
LFYVVCTCLHLFKVSCCCPWVKICCHHXPTKSSSKESSSIFLARQFWAILGSPKQAKQNWERRARICNNXEPLKGGPNGG

SEQ ID NO: 203808 - protein, 91 aa, Triticum aestivum
  unsure (1)..(91): unsure at all Xaa locations
  Clone ID: PAT_TA_98226.pep
XEXXXPFSVAPLSFMLCSHYFINKSQDKSCGTLVRERPMAXXSVGGGAVPFVWKTYXXVEDPXTDGVIGWGNXXXQFLLXXPLXLLRIXCL

SEQ ID NO: 203809 - protein, 141 aa, Triticum aestivum
  unsure (1)..(141): unsure at all Xaa locations
  Clone ID: PAT_TA_98227.pep
VKTLTGKTITLEVESSDTIDNVKAKIQDKEGIPPDQQRLIFAGKQLEDGRTLADYNIQKESTLHLVLRLRGGMQIFVKTXTGKEHQPWRFESSDNIHNXKGKIQGQGGXFPRNXXRSYPRAFEGMGRHPFRVKSRKGSPPG

SEQ ID NO: 203810 - protein, 124 aa, Triticum aestivum
  Clone ID: PAT_TA_98228.pep
DILAAFRVSPQPGVPPEEAGAAVAAESSTGTWTTVWTDGLTSLDRYKGRCYHIEPVAGEDSQWICYVAYPLDLFEEGSVTNMFTSIVGNVFGFKALRALRLEDLRIPPTYSKTFQGPALKGIQV

SEQ ID NO: 203811 - protein, 130 aa, Triticum aestivum
  unsure (1)..(130): unsure at all Xaa locations
  Clone ID: PAT_TA_98229.pep
MKTFLILALLAIVATTATIAVRVPVPQLQPQNPSQQQPQEQVPLVQQQQFPGQXQQPFPPQQPYPQXPQPFPSQQPYLQLQPFPQPQLPYPQPHLPNPQAATISDHNNQYPQTVISQTNNKPNFRSSQPT

SEQ ID NO: 203812 - protein, 141 aa, Triticum aestivum
  unsure (1)..(141): unsure at all Xaa locations
  Clone ID: PAT_TA_98230.pep
KIAYDQKLCQLLEEYTKVLIAVADNVGSKQLQEIRKGLRGDSIVLMGKNTLIRRCIKVHSEKTGNKDFLELNNLLVRYVWLIFNKGDLKEVXQGGXQVKXGAPAXVGLIXXVDVVGPPXNTXLGSXQXFFFQVLSQQRKKG

SEQ ID NO: 203813 - protein, 74 aa, Triticum aestivum
  Clone ID: PAT_TA_98231.pep
MERKTFGFLFLLLLVLASDVTVKRAEAKDCLTRRHGFQGRCLFDRQCAHVCRSDGFIGGQCRGPLRKCFCSRPC

SEQ ID NO: 203814 - protein, 106 aa, Triticum aestivum
  unsure (1)..(106): unsure at all Xaa locations
  Clone ID: PAT_TA_98232.pep
RCQAIHNVVHAIILHQQQQQQQQQQQQPLSQVSFQQPQQQYPSGQGSFQPSQQKPXKAKGSVKPQQLAPSLXEIRNXALEXTLPAMLXVISXQICTXIAXXXFLGX

SEQ ID NO: 203815 - protein, 144 aa, Triticum aestivum
  unsure (1)..(144): unsure at all Xaa locations
  Clone ID: PAT_TA_98233.pep
CQAIHNVVHAIILHQQHHHHQQQQQQLVPQLQQPLSQQPQQTFPQPQQTFPHQPQQQVPXPQQPQQPFLQPQQPFPQXPQQPFPQTXQPQQPFPQQPXQPFPQTQXPQQPXPQXPQQSFPQTXQPHQXFPQSKXPXQPFPKPXQ

SEQ ID NO: 203816 - protein, 121 aa, Triticum aestivum
  unsure (1)..(121): unsure at all Xaa locations
  Clone ID: PAT_TA_98234.pep
MLVYQDKLSGDELLSDSFPYRELENGVLWEVDGHWVVQGAVDVDIGANPSAXGGGDDXGVDYQAXKGGLTFVXTFRPSRXKPXFXXKQFNPXNKRXXKKXPSXALXGMNLNFFKKCLILPK

SEQ ID NO: 203817 - protein, 83 aa, Triticum aestivum
  unsure (1)..(83): unsure at all Xaa locations
  Clone ID: PAT_TA_98235.pep
MEHKETGCXSREGPILCVNNCXFFGSAXNMNMFSKVAKGRMANKXEXGKLGASSFEKQSVKRWANRQKNIFAAWQQGRWLLNV

SEQ ID NO: 203818 - protein, 149 aa, Triticum aestivum
  unsure (1)..(149): unsure at all Xaa locations
  Clone ID: PAT_TA_98236.pep
XXEIXGLGAPIXNPLLNXGASPENXWFSSPRRFXWGTFRSRRVTPFRASSVAASGSIRAAALLSMPTAPDADSSRRRSVLDQASHGEGVGRAASGRRREGGEQLAVGGGRGRPAGCSGLGEERRSKEAPVEGIWIGASVNFFFFDKRGG

SEQ ID NO: 203819 - protein, 148 aa, Triticum aestivum
  unsure (1)..(148): unsure at all Xaa locations
  Clone ID: PAT_TA_98237.pep
RPPVSAHLLRLRRRRTHRGSSDSPDQERRAGRKSTYAGGEEMGLTFTKLFSRLFAKKEMRILMVGLDAAGKTTILYKLKLGEIVTTIPTIXGFNVETVEYKNISFTVWDVGGXDXIXXHXXRHYFQXXKXVXXFVFTNGTVFLQELAP

SEQ ID NO: 203820 - protein, 102 aa, Triticum aestivum
  unsure (1)..(102): unsure at all Xaa locations
  Clone ID: PAT_TA_98238.pep
MSPQTETKAGVGFKAGVKDYKLTYYTPEYETKDTDILAAFRVSPQPGVPPEEAGAAVAAESSTGXTWTTVWTDGLTXLDRYKXRCLXHRACLLGKDSQWDLW

SEQ ID NO: 203821 - protein, 149 aa, Triticum aestivum
  unsure (1)..(149): unsure at all Xaa locations
  Clone ID: PAT_TA_98239.pep
PFSQQQQQPPFAQQQQPPFSQQPPISQQQQPPFSQQQQPQFSQQQQPPYSQQQQPPYSQQQQPPFSQQQQXPPFSQQQQQPPFTQQQQQQQQQQPFTQQQQPPFSQQPPXFTASNNQHFLQATNDHHFPRANKSLFIHGFATKNPMRLP

SEQ ID NO: 203822 - protein, 95 aa, Triticum aestivum
  unsure (1)..(95): unsure at all Xaa locations
  Clone ID: PAT_TA_98240.pep
EQIISQQSQQPFSLQPQQPFSQPQQPLSQQPGQIIPQQSQQPCPLQPQQPFPQPQQAFPEQAEQIIPQQPXQPFPLQPHQPQQPYPQQQPSGVAV

SEQ ID NO: 203823 - protein, 72 aa, Triticum aestivum
  unsure (1)..(72): unsure at all Xaa locations
  Clone ID: PAT_TA_98241.pep
AVDXDAXXPSVRXPPDEGNGELATVHXRERIXQGXEGRNPXEEEGGXEERRLREEKEERWRDASEREKGDXA

SEQ ID NO: 203824 - protein, 151 aa, Triticum aestivum
  unsure (1)..(151): unsure at all Xaa locations
  Clone ID: PAT_TA_98242.pep
SVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPKKPAGKXEARRIXEDKAKQSNINNQVQQQPAVINPPQCARGAPP

SEQ ID NO: 203825 - protein, 153 aa, Triticum aestivum
  unsure (1)..(153): unsure at all Xaa locations
  Clone ID: PAT_TA_98243.pep
KVDLLITPEFVWKDRHHGMSQRWLIIVEDSENDTIYHSELFTLTKKMARGTPTKMSFNIPIFEPHPPQYYIRAVSDSWLHAESIFTVSFHNLTLPQTQITHTELLDLKPLPLSALGNKAYEDLYRXTHFNPIQTQGFPMFLNTLKLKCSWEAT

SEQ ID NO: 203826 - protein, 146 aa, Triticum aestivum
  unsure (1)..(146): unsure at all Xaa locations
  Clone ID: PAT_TA_98244.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPSFYPPXQINFFPTNKPNTNVGATNQPLVVQAIPFLA

SEQ ID NO: 203827 - protein, 87 aa, Triticum aestivum
  unsure (1)..(87): unsure at all Xaa locations
  Clone ID: PAT_TA_98245.pep
RAFPLARRALGCEEFQKXRARTSAAGNELLLRRLVGRKGWQRCPKCRMFVEKSEGCNYMKCRCGNSFCYRCASKLSAENHYCKKCKR

SEQ ID NO: 203828 - protein, 125 aa, Triticum aestivum
  unsure (1)..(125): unsure at all Xaa locations
  Clone ID: PAT_TA_98246.pep
QQLGQGQPGYYPTSQQSEQGQQPGQGKQPGQGQQGYYPTSPQXXGQGQKLGQGQPGXYPTSPQQXXQGQQLXQXQQXFXPTXXQQSRDKGQQTGKKGNXGYFPNFSAAXXGXKGXPXXGQRDKQR

SEQ ID NO: 203829 - protein, 131 aa, Triticum aestivum
  unsure (1)..(131): unsure at all Xaa locations
  Clone ID: PAT_TA_98247.pep
LRLGXSATWXXIPXTVEXXSDXFRSXPXXGHGSLLVLDVGGGPRHGARPPSRHRVRASPAAARRARIRDXLASWQPRGXPSRRGSRARGRSRRADRRRRRYGAGAEQAEAPWCRPWLRPRSRESNDPAAEG

SEQ ID NO: 203830 - protein, 54 aa, Triticum aestivum
  Clone ID: PAT_TA_98248.pep
IVLVPRPAAPPAPPSRPPRPDRASPPPRTPRAARRGAPPPPGAASPSSRSSSEI

SEQ ID NO: 203831 - protein, 134 aa, Triticum aestivum
  unsure (1)..(134): unsure at all Xaa locations
  Clone ID: PAT_TA_98249.pep
XISXLVPVXXVQXFFWXHXPHPKGGXPXSSGXLYCTLLGLNFQFHQXFFFNPEQRLFGXLDVFVVCAATXLNXELCSCLLVKLRMSVYSWCQKLTESDLSLALLNRYKKFIQLEKPCRRCPVSLILVRSGLLTF

SEQ ID NO: 203832 - protein, 109 aa, Triticum aestivum
  unsure (1)..(109): unsure at all Xaa locations
  Clone ID: PAT_TA_98250.pep
MKTFLILALLAIVATTATTAVRVPMPQLQPQNPSQQQSQEQVPLVQQQQFLGQQQQQFPGQQQPFPPQQPYPQPQLFPQPQQFPPQLPYPAARNHFPPXIHNRKPKSKK

SEQ ID NO: 203833 - protein, 126 aa, Triticum aestivum
  unsure (1)..(126): unsure at all Xaa locations
  Clone ID: PAT_TA_98251.pep
MARLNSKAVAAAVVLAAVVLMMAGREASAALSCGQVDSKLAPCVAYVTGRASSISKECCSGVQGLNGLARSSPDXRKIACRCLKSLATNIKSINIGXVSGVXPGNCXVSVPFPIXMSNNWKKCQLF

SEQ ID NO: 203834 - protein, 92 aa, Triticum aestivum
  unsure (1)..(92): unsure at all Xaa locations
  Clone ID: PAT_TA_98252.pep
MRECISIHIGQAGIQVGNACWELYCLEHGIQPDGQMPGDKTVGGGDDAFNTFFXETGAGKHVPRAVFVNFQPNXIDEVRTGRLTAKLQLKQT

SEQ ID NO: 203835 - protein, 95 aa, Triticum aestivum
  unsure (1)..(95): unsure at all Xaa locations
  Clone ID: PAT_TA_98253.pep
MAAPTTVLLLLLLLLCAVVGPHSAYADALPEPVNEEVLGLVVFRSALKDPSXALAAWGESDATPCGWAQVECEPXXXRVVRLAXEGLALSSGSGL

SEQ ID NO: 203836 - protein, 144 aa, Triticum aestivum
  unsure (1)..(144): unsure at all Xaa locations
  Clone ID: PAT_TA_98254.pep
SSSFLSDRPAPPTPFPSAQLHAACASSPSPTVPLPPQRRRPLPCARYRRSLPLACPSASVKIRFSPSGSSXCSGRAXSAXESTNTGRQKLLLPVACKGLLLLVVRSDYEVATGXATTXAGMWRGNSXXVSPTALRLXRQSXTNL

SEQ ID NO: 203837 - protein, 56 aa, Triticum aestivum
  unsure (1)..(56): unsure at all Xaa locations
  Clone ID: PAT_TA_98255.pep
RXPRRCSSSSPPAPPPPRSTXSTSPPSKPRPTLXXITXFHXPDHXGIXXGDLEPSV

SEQ ID NO: 203838 - protein, 145 aa, Triticum aestivum
  unsure (1)..(145): unsure at all Xaa locations
  Clone ID: PAT_TA_98256.pep
MNPCKNYLLQQCNPVSLVSSLVSMILPRSDCKVMRQQCCQQLAQIPQQLQCAAIHGVVHSIIMQQEQQQQQQQQQGIQXMRPLFQXLVQGQGIIQPQQPXAQLEVIRSLVLGTLPTMCNVFVPPECSNTXXPFANIVXDIVGNEK

SEQ ID NO: 203839 - protein, 155 aa, Triticum aestivum
  unsure (1)..(155): unsure at all Xaa locations
  Clone ID: PAT_TA_98257.pep
QDCLGAAVPPRREAGXRXSRRXXGRERRLRLVSRGGARLGSGXARGQXSGGNLAGRDQAPTSVGLALLHRHGGSTVAPTAGYGPQTNTGPLRLGPLSIRSGWGRELLALRGERVATGAGEASGRRREGEAAGGARWGWVAQGTAGMGGGDGCAAQ

SEQ ID NO: 203840 - protein, 146 aa, Triticum aestivum
  unsure (1)..(146): unsure at all Xaa locations
  Clone ID: PAT_TA_98258.pep
GEXTGRXXLXGWXPPQXRPPGXTPPPXEXXERETLXARRQRAXRPGAAGGFRGRQQRRRPRAGAGRSRPPRXPXGTRRCKAPAISRRSXKRMVARMXKVLSAQVSLMDAATARAXAMAVIRWRRXCAREPRAPXSVHMHCTGSGWX

SEQ ID NO: 203841 - protein, 70 aa, Triticum aestivum
  unsure (1)..(70): unsure at all Xaa locations
  Clone ID: PAT_TA_98259.pep
EXXXRTXXARHXXRGPPXAEATPEXXAVAAAXAGHHAHRRGPPWLGGGGGLGAVXLDGGDEGLELEAVAA

SEQ ID NO: 203842 - protein, 148 aa, Triticum aestivum
  unsure (1)..(148): unsure at all Xaa locations
  Clone ID: PAT_TA_98260.pep
AKLCYKTRAKMTRKNQEFRGGRRRRRTGLYICYIYVTGTHRCMSKQAGVDRSILHCKSFPAGXXSGCAAXESRNXRGRXILSSLKNPIGPPAGXSVPRNQXLTXPSSAGPPSIVXXGFGAPLGGPXPFXXLXXRKXQPXSPGPGRGGX

SEQ ID NO: 203843 - protein, 103 aa, Triticum aestivum
  unsure (1)..(103): unsure at all Xaa locations
  Clone ID: PAT_TA_98261.pep
MAPTVMASSATSVAPFQGLKSTAGLPVSRRSNXASLGSVSNGGRXKCMQVWXXRXIXKXENXSXFQRXTTXGLLKASGTTLPLQVGLPCPLKFQRVRGFNPSR

SEQ ID NO: 203844 - protein, 68 aa, Triticum aestivum
  Clone ID: PAT_TA_98262.pep
QCSGVNVMKYTCYIYLFLWFASSILSVQVFDQLCKMLTYCCIDLLCKISTMCVSTLFYKSSLDVFLLS

SEQ ID NO: 203845 - protein, 136 aa, Triticum aestivum
  unsure (1)..(136): unsure at all Xaa locations
  Clone ID: PAT_TA_98263.pep
YLTHYGVEIGRKKKAAAAAKKEAAEGQEAEVAAAATEEAKKSNNVQXKLEKRQQGRTLXDSHIEEQFSGGRLLACISSPPLDKCGKSLMGKILGGQGSLGVPTLRKAPKKKARVPLKGQLHVTWFLKFCVHFAINN

SEQ ID NO: 203846 - protein, 146 aa, Triticum aestivum
  unsure (1)..(146): unsure at all Xaa locations
  Clone ID: PAT_TA_98264.pep
SYWSNLLAMASSSSSVAVAAALLLCILAAHGHGCCAKRSSNSGGKKSHSHHAPPHAHGAPPPSSPPGHRVHRPTGYGFPPPPGCHPRLLLRATPSPXXGPIPSSXKQQMFXAGRAGLQRQGPTGXGAPKGAPGPNEKGGGLXVXER

SEQ ID NO: 203847 - protein, 135 aa, Triticum aestivum
  unsure (1)..(135): unsure at all Xaa locations
  Clone ID: PAT_TA_98265.pep
PPPAPPDPXPPPHPLLSPQPRTTEIQSSPHAATLPPTHRRPRRPPHPPPTSSLPPLTISPYPLPASPASSPDPIDTTPLPPHPVLSTMAASSSSPHQPITPSWGRVRGGYPSTPSPSAPAAPQSPPNPHPPRSRR

SEQ ID NO: 203848 - protein, 142 aa, Triticum aestivum
  unsure (1)..(142): unsure at all Xaa locations
  Clone ID: PAT_TA_98266.pep
XTARAPVKRXVGRTPEGGVPLCCPSRAMLEGRGRRAPEGRSRRAPALSSRRWSEPPPRAMLVARASGKLRRLRVRQARCQRGRPAPRLRGLPAHRLRIRQARPPCSPPVGSPCSPPAHPPSAAALLPARADGLLASAGHGCA

SEQ ID NO: 203849 - protein, 107 aa, Triticum aestivum
  unsure (1)..(107): unsure at all Xaa locations
  Clone ID: PAT_TA_98267.pep
RTLQLDPTGQSPHHPPPRCSPPPPTXLHSPPPPPLRLPXPPCLPPPTSPPVSRGAVTEERDPWSSPATTSSCSPXAPPPGAAPAPRPLSAPGNWQVRLPHQVYRGRD

SEQ ID NO: 203850 - protein, 140 aa, Triticum aestivum
  unsure (1)..(140): unsure at all Xaa locations
  Clone ID: PAT_TA_98268.pep
VAARRRPHRAPPRAGYHVRKRRAWEGRAMAAVSGCHCSRWLRRQRCLALLTRMEQVTDAGGTSRRGARASGVAGRKPTQFPRQARPSKKSLRVGCGVRVVRQEASTRXPQAVGHCYLRPPQPAAALAPTPQLPTSQMGSP

SEQ ID NO: 203851 - protein, 121 aa, Triticum aestivum
  unsure (1)..(121): unsure at all Xaa locations
  Clone ID: PAT_TA_98269.pep
MARGTAATAAAAAKGKXKGSVSFVIDCTKPVEDKIMEXASXEKXLXERIKVPGGKAGNLGDSVTVTRDKSKVXVTXEGXFXXRXLKXFTXKFFKXHNXXEWLXXIXTNKERNXFQXPLXKI

SEQ ID NO: 203852 - protein, 137 aa, Triticum aestivum
  unsure (1)..(137): unsure at all Xaa locations
  Clone ID: PAT_TA_98270.pep
MAATSSAALFSVLPLPTATPVSARAGSSLCRPTRSAAVSPICSAASPDLSPGAPAPAPPKPQIELEFVGPKPGADGSYPVDXAGAVNGEKLLRDVMLENKLXLXAAYGKLMNCXGGGGNFGXCLXQIIHRKELXEPK

SEQ ID NO: 203853 - protein, 142 aa, Triticum aestivum
  unsure (1)..(142): unsure at all Xaa locations
  Clone ID: PAT_TA_98271.pep
XAAPAPSAPLSAPRVPRRSPPQPPACRFRVENGGRRRAHTPMAATAADPLLAAPXPPAXAGSVQHLKPSATSPSGLPSLLPAMADLAPASRCICRLRRARSPCLAFRXRMGKFAAPSPPAGLVSGDALLQPIVVVGDESTCS

SEQ ID NO: 203854 - protein, 135 aa, Triticum aestivum
  unsure (1)..(135): unsure at all Xaa locations
  Clone ID: PAT_TA_98272.pep
VXFLNGXXKSXYXEVXXPXKYRRPXXGAXALEXHRTXGEWMXXCXGQXGPLRRXAXRGRPAVAXREVHDPLRPSPPVLLXHQTDTDTSREFASNRSGSHAFPGDDGDDEFVAVWVRNVGSAAQRILVRSWPSWAA

SEQ ID NO: 203855 - protein, 140 aa, Triticum aestivum
  unsure (1)..(140): unsure at all Xaa locations
  Clone ID: PAT_TA_98273.pep
QRQQPGQGQQLRQGQXFPQQPYPQQPYPSQHPYPSQQPFPTPQQQFPEQSXQPFTQPQQPTPIQPQQPFPXQPQXXQQPFPQPQQPFPWHAQQPFPQDRNNHFPXXPQQXFPQHPXQPFPLQLQQSIPPXNHIXPFPSNK

SEQ ID NO: 203856 - protein, 136 aa, Triticum aestivum
  unsure (1)..(136): unsure at all Xaa locations
  Clone ID: PAT_TA_98274.pep
MKTLLILTILAMXTTIATANMQVDPSGQVQWPQQQPFPQPQQPFCQQPQQXIPQPHQTFHHQPQQTFPQPQQSYPHQPQQQFPQTQQPQQPFPQPQXTFPQTXXTTIFPXQPQXPFPQASSXPNXHFPQKHNKFSP

SEQ ID NO: 203857 - protein, 68 aa, Triticum aestivum
  Clone ID: PAT_TA_98275.pep
SRGGEGTHHGSGNTVGCDRMGVHNRDLVRSVALCDGCCHRQGRRSVKSHVVVSVSGRRHNGCLRGAAY

SEQ ID NO: 203858 - protein, 77 aa, Triticum aestivum
  unsure (1)..(77): unsure at all Xaa locations
  Clone ID: PAT_TA_98276.pep
MKTFLIFALLAIAATSAIAQMETSRVPGLEKPWXQXPLPPQQQPPCSQXQQXFPQXTTXXLLYCNXSPFSXTTKFCR

SEQ ID NO: 203859 - protein, 77 aa, Triticum aestivum
  Clone ID: PAT_TA_98277.pep
VTTYIILTRVINLLIQGNSKNTPSRTGAYARTQARNVQYVNPRYISSRTTQLKLNQHHLLHLNRSTAGPHLAPRPSI

SEQ ID NO: 203860 - protein, 105 aa, Triticum aestivum
  unsure (1)..(105): unsure at all Xaa locations
  Clone ID: PAT_TA_98278.pep
RLEGSVLCLHQLRNLRILTAAQRVQRRLGVNALCLNQLRILTVLQRVHQXTKGKGSLPESTEEPEGPDDRDMKDSMHTXKRKKLDTLGDFVFPSHKPVSPXGFHX

SEQ ID NO: 203861 - protein, 113 aa, Triticum aestivum
  unsure (1)..(113): unsure at all Xaa locations
  Clone ID: PAT_TA_98279.pep
MKTFLVFALLALAAASAVAQXSQQXQAPPFSQQQXPPFSQQXQXPFXQXQXSPFXQXXQXPLFAQQQHXPFSQXSPCFTXSQHPPFSXQQXPXFSQQXQPPLFRSTXQXXXSQ

SEQ ID NO: 203862 - protein, 135 aa, Triticum aestivum
  unsure (1)..(135): unsure at all Xaa locations
  Clone ID: PAT_TA_98280.pep
MKTFLVFALLAVAATSAIAQMETRCIPGLERPWQQQPLPPQQTFPQQPLFSQQQQLFPQXPSFSQQXPPFWQQQPPFSQXQXPILPQXPPFSQATTXLVLPQQPPFXSQQXQAVLPPQQSTXFHXQQQTPSSWGG

SEQ ID NO: 203863 - protein, 146 aa, Triticum aestivum
  unsure (1)..(146): unsure at all Xaa locations
  Clone ID: PAT_TA_98281.pep
VPHHGAFLXFALLAVAXTSAIAQMXTRCIPGLERPWQQQPLPPQQTFPQQPLFSQQQQLFPQXPSFSQQQPPFWQQQPPFSQXXPILPQXPPFSQXQQLVLPXQQPPFSXXQNNXVLXPQQSTFSTTSXXTXRLVXQQNPWLFQPS

SEQ ID NO: 203864 - protein, 131 aa, Triticum aestivum
  unsure (1)..(131): unsure at all Xaa locations
  Clone ID: PAT_TA_98282.pep
SPQTETKAGVGFKAGVKDYKLTYYTPEYETKDTDILAAFRVSPQPGVPPEEAGAAVAAESSTGTWTTVWTDGLTSLDRYKXGRCXHIEPVAXGEDSQWXLXCSXXPLDLFXXGVPVYLTCLTFHLRRFGFP

SEQ ID NO: 203865 - protein, 141 aa, Triticum aestivum
  unsure (1)..(141): unsure at all Xaa locations
  Clone ID: PAT_TA_98283.pep
MKTFLIFALLAIVATSAIAQMXNSHIPXLERPSQQQPLPPXQTLSHHQQQQPIQQQPQPFSQXXPCSQXQQXPLSQXXQPPFSXXQPPFSQXQQLPPFSQQXSPFSQXQQIVLXQQPPFLQQQXPKFYRXQPPFSQQQQQP

SEQ ID NO: 203866 - protein, 109 aa, Triticum aestivum
  unsure (1)..(109): unsure at all Xaa locations
  Clone ID: PAT_TA_98284.pep
QQPVLPQQPSFSQQQLPPFSQQQSPFSQQXQIVLQQQPPFLXQQXPSLPQXPPFSQQQQQLVLPXQQIPFVHPSXLQQLNPCKVFLQQQCSPVGMPQSXAXSQMFARGM

SEQ ID NO: 203867 - protein, 45 aa, Triticum aestivum
  Clone ID: PAT_TA_98285.pep
VQPQRLPQLKEIRNLALQTLPAMCNVYIPPYCSTTIAPFGIFGTN

SEQ ID NO: 203868 - protein, 146 aa, Triticum aestivum
  unsure (1)..(146): unsure at all Xaa locations
  Clone ID: PAT_TA_98286.pep
QPFPQPQQPQQPFPQSQQPQQPFPQPQQPQQSFPQQQQPLIQPYLQQQMNPCKNYLLQQCNPVSLVSSLVSMILPRSDCQVMQQQCCQQLAQIPRQLQCAAIHSVVHSIVMQQEQQXGIQDLRALFQLVQGQGXIIQPQTNQLNRV

SEQ ID NO: 203869 - protein, 87 aa, Triticum aestivum
  Clone ID: PAT_TA_98287.pep
VHPVGIHFTGRDSEFENMACEKDPLGRVYATMRIINHRRGMAESVHVNVKEDSLYDGMDGHKSKYDIDTGSLSMKEYVLLIPACGYL

SEQ ID NO: 203870 - protein, 80 aa, Triticum aestivum
  unsure (1)..(80): unsure at all Xaa locations
  Clone ID: PAT_TA_98288.pep
INYFPPIXILRRGAPPIILXFAEYKNVGIPMGHILXSSRXNLKSLTFKEKFPKPSRGRYFPIXSGYAARGKRIGGGTIWS

SEQ ID NO: 203871 - protein, 82 aa, Triticum aestivum
  unsure (1)..(82): unsure at all Xaa locations
  Clone ID: PAT_TA_98289.pep
MDENLANVLSXLPPPSVSNNASPSSSXNASDDDXRIKWLPXRAPPAXISPRLPNXGRGGGTILFLPAGGKLGVTQSRGKADF

SEQ ID NO: 203872 - protein, 148 aa, Triticum aestivum
  unsure (1)..(148): unsure at all Xaa locations
  Clone ID: PAT_TA_98290.pep
FPQFQQPHQPFPQPQQQFPQPQQPQQSFPQQQRPFIQPSLQQRLNPCKNILLQQCKPASLVSSLWSIIWXPQSDCQVMQATMAAKELXAQIPQASPSGGNQXIGVRGILSIXQASXQQQQQTXQQQQQQXMXILLALSQQQQLGQXYP

SEQ ID NO: 203873 - protein, 131 aa, Triticum aestivum
  unsure (1)..(131): unsure at all Xaa locations
  Clone ID: PAT_TA_98291.pep
MKTFLILAILAIVXTTATTAVRVPVPQLQPQNPSQQQPQEQVPLVQQQQFPGQQQQFPPQQPYPQPQPFPSQQPYPQPQSFPLATSLAWGNHCNNNHHYNKYYTNNNNPSKQQPQTFSQQPPCSQATTTTI

SEQ ID NO: 203874 - protein, 144 aa, Triticum aestivum
  unsure (1)..(144): unsure at all Xaa locations
  Clone ID: PAT_TA_98292.pep
RVIGRDLCHHKQKLKQVLAFKAGVXDYXLTYYTPEYETKDTDILAAFRVSPQPGVPPEEAGAAVAAESSTGTWTTVWTDGLTXLDRYKGRCYHIEPVAGEDSQWICXVAYPLXLFEEGSVTNMFTSXIVGNVFGFKALTCSVWR

SEQ ID NO: 203875 - protein, 102 aa, Triticum aestivum
  unsure (1)..(102): unsure at all Xaa locations
  Clone ID: PAT_TA_98293.pep
SLTVSSQSSPPRNXPPXKGGCLAAAATADAAPAAXAVTAAAGAXCSPTLRPPXAXPXWSCTXPPTRGAXAGSRRTAXRPXAAXAPPASAXRAAXCSCCNLQT

SEQ ID NO: 203876 - protein, 109 aa, Triticum aestivum
  unsure (1)..(109): unsure at all Xaa locations
  Clone ID: PAT_TA_98294.pep
SSLLTVAASSQSSPSSPRHHPPRKGGCLAAAATADAAPAASAATAAAGARCSPTLRPPPAPPPWSCPPPPTXGTPAGFQNGPGGEDRGCDCNHLQATGLAGCLPACKLN

SEQ ID NO: 203877 - protein, 68 aa, Triticum aestivum
  unsure (1)..(68): unsure at all Xaa locations
  Clone ID: PAT_TA_98295.pep
RGIDLDVFQGRIVESSPKVSSLAKLQXFSSFVGESMHDDGGVVFAYYKEGAADPTFLYFAHGLKEVKC

SEQ ID NO: 203878 - protein, 141 aa, Triticum aestivum
  unsure (1)..(141): unsure at all Xaa locations
  Clone ID: PAT_TA_98296.pep
KTREPKEENVTLGPAVREGEHVFGVAHIFASFNDTFIHVTDLSGRETLVRITGGMKVKADRDESSPYAAMLASQDVAVRCKELGITALHIKLRATXGGNKTKTPSPGAQSXRLKLLQRSXNKIXRIEDVTPVPXEQQPPEW

SEQ ID NO: 203879 - protein, 120 aa, Triticum aestivum
  unsure (1)..(120): unsure at all Xaa locations
  Clone ID: PAT_TA_98297.pep
MATQISKKKKFVSDGVFYAELNEMLTRELAEDGYSGVEVRVTPMRTEIIIRATRTQNVLGEKGRKXRELNSVRPRKRFNFXREKGVELYAEKVVNRGLCAIAQAESXRYKLLGGLAVRKA

SEQ ID NO: 203880 - protein, 96 aa, Triticum aestivum
  unsure (1)..(96): unsure at all Xaa locations
  Clone ID: PAT_TA_98298.pep
GNSGDXFXLVLPQXGDPVQIXKIRRGTRTAGTFSRGPQPLRTPGRGXARGXGSSGYGGAPNHTDRKYCAEGTHGDRGSPSSCRHSAAIDRPFPLTF

SEQ ID NO: 203881 - protein, 111 aa, Triticum aestivum
  unsure (1)..(111): unsure at all Xaa locations
  Clone ID: PAT_TA_98299.pep
DTHSSSFTERRTVAGRSQANQQIVSGNSSVKRIYAPVLCRCRGGERTDGRGRRPQWTAAKRKXAPEATSXXARDGXVAPAADTGXGAGASCAETTERAATDRTARTATALD

SEQ ID NO: 203882 - protein, 106 aa, Triticum aestivum
  unsure (1)..(106): unsure at all Xaa locations
  Clone ID: PAT_TA_98300.pep
MARTKQTARKSTGGKAPRKQLATKAARKSAPATGGVKKPHRFRPGTVVLREIRXYQXKSTELLIRTLPFQRLGAXEIAQDFKTVSGSKSSAVFXXAGSPEKPGGCS

SEQ ID NO: 203883 - protein, 52 aa, Triticum aestivum
  unsure (1)..(52): unsure at all Xaa locations
  Clone ID: PAT_TA_98301.pep
STXCPLLPLDGWSRERRXXXEXEASREIISRXRGRCPPYRDGRWGNEMRXVG

SEQ ID NO: 203884 - protein, 103 aa, Triticum aestivum
  unsure (1)..(103): unsure at all Xaa locations
  Clone ID: PAT_TA_98302.pep
QQQQQPLSQQQQPPFSXQQXPPFSQQXQPPFSQQQPPFSQQQQQLXXPQQXXPFVHPSILXQLNPWXVFLXQXCXPVAMPXXLARXQMLQAXAXAXXMXHHCL

SEQ ID NO: 203885 - protein, 64 aa, Triticum aestivum
  unsure (1)..(64): unsure at all Xaa locations
  Clone ID: PAT_TA_98303.pep
SDSNLIASRSETGAPSSGWPMVATPWQDPDAERYQPWPELEENPFTTPTKGRASSLLSCKNXCQ

SEQ ID NO: 203886 - protein, 115 aa, Triticum aestivum
  unsure (1)..(115): unsure at all Xaa locations
  Clone ID: PAT_TA_98304.pep
ESLGLGAXEGXYAXLXPNIXLDANRKXIDARRVRKLIGNRGLKKVPAYSAVEIDGELSSFVADDQAHPRRFEIWDLLGLLADQMGRKPDEEEEEETTFSLHPCNKKNKFENHVTD

SEQ ID NO: 203887 - protein, 76 aa, Triticum aestivum
  unsure (1)..(76): unsure at all Xaa locations
  Clone ID: PAT_TA_98305.pep
LPPALEFDRSWFTSPPADXAXRGRKHWRLAGATCRCXTGSXVAGXTAGIIMHGRXXGGXXXRACSRXRXXXRRXPL

SEQ ID NO: 203888 - protein, 98 aa, Triticum aestivum
  unsure (1)..(98): unsure at all Xaa locations
  Clone ID: PAT_TA_98306.pep
MKTLLILTILAMAITIGTANIQVDPSGQVQWLQQQLVPQLQQPLSQXQPQQTFPQPQQTFPHQPXXQXVPQPXEPXXPFLXAPNXHSPNIXQQPFPXS

SEQ ID NO: 203889 - protein, 127 aa, Triticum aestivum
  unsure (1)..(127): unsure at all Xaa locations
  Clone ID: PAT_TA_98307.pep
ATALSCGQVDXKLAPCVSYVTGKAPSIXKECCSGVQGLNGLXRXSPDRKIACRCXKSLATSIXSINMDXVSXVPGXXRRQACPSPSXMSXXTANNVNLVNPFPTNCKGRFVLGLNVLLGKLNYWKLT

SEQ ID NO: 203890 - protein, 103 aa, Triticum aestivum
  unsure (1)..(103): unsure at all Xaa locations
  Clone ID: PAT_TA_98308.pep
MGKEKTHINIVVIGHVDSGKSTTTGHLIYKLGGIDKRVIERFEKEAAEMNKRSFKYAWVLDKLKAERERGITIDIALWKXFETTXYYCTVNXCPWGNRLHQRK

SEQ ID NO: 203891 - protein, 80 aa, Triticum aestivum
  unsure (1)..(80): unsure at all Xaa locations
  Clone ID: PAT_TA_98309.pep
MKTLFILTILAMATTIATVNMQVXPSGQXQWGQQQPFRQPQXPFYQQPXQXFPQPQXAFPHQPQXXFPQPQXPQQXFPQP

SEQ ID NO: 203892 - protein, 119 aa, Triticum aestivum
  unsure (1)..(119): unsure at all Xaa locations
  Clone ID: PAT_TA_98310.pep
SLLTVAASSQSSPSSPRHHPPRKGGCLAAAATADAAPAASAATAAAGARCSPTLRPPPAPPPWSCPTXPPQGGAPAGSRRSAGXTGXLRXAPTCKVRARPCRLSWASCKLEPGPVGPGG

SEQ ID NO: 203893 - protein, 120 aa, Triticum aestivum
  unsure (1)..(120): unsure at all Xaa locations
  Clone ID: PAT_TA_98311.pep
RRSGLRYHRIRVFDTVAETSRQMTPPPVNPRHVMHLLDLGGKLAASTSKDGMTEMSIFVLQDPEHDVWAFQYRIKLPAMEIRRFQKQGDWWAKVVSEEGDVLVSCYXHLLQYDKKGXFVA

SEQ ID NO: 203894 - protein, 151 aa, Triticum aestivum
  unsure (1)..(151): unsure at all Xaa locations
  Clone ID: PAT_TA_98312.pep
QPQQQFPQPQQPQQPFPQPQQAQLPFPQQPQQPFPQPQQPQQPFPQSQQPQQPFPQPQQPQQSFPQXQQQPLIQPYLQQQMNPCXNYLLQXXCNPVSLVSSLRVNXXLPRXDCQGDASNNGCQQLGTGFPRPSKWCNQSNSGRGISGWQKM

SEQ ID NO: 203895 - protein, 104 aa, Triticum aestivum
  unsure (1)..(104): unsure at all Xaa locations
  Clone ID: PAT_TA_98313.pep
MTVSRCPILLLPLLFLCTLPPLASACDRCVHRTRAAYYASSLTLAAXSCRYGAXXASLNGDXLAGAGPVLYKTRSPACGVLPRCKGSCATAREFFTDRGQSKRG

SEQ ID NO: 203896 - protein, 145 aa, Triticum aestivum
  unsure (1)..(145): unsure at all Xaa locations
  Clone ID: PAT_TA_98314.pep
QQQFPQPQQPQQPFPQQPQQXFPQPQXPQXPFPQXPQXQFPQPQQPQQPFPXPQQPXXPFPQQPXXPFPQPXXPQQPFPQLQXPQQSFPXAPTTXSKPFPXGTXXIXFKPYLXXQXXPXXXXPLGAXGNPVSLGGHSLVQWIAKG

SEQ ID NO: 203897 - protein, 83 aa, Triticum aestivum
  unsure (1)..(83): unsure at all Xaa locations
  Clone ID: PAT_TA_98315.pep
MANPRVFFXMTVGGAPXGRXXMELYKDAVPRTVENFRALCTXXKXRXQXLXMPLXXKRGSAFXXRDSPTSCXKGGXFXPGXGT

SEQ ID NO: 203898 - protein, 86 aa, Triticum aestivum
  unsure (1)..(86): unsure at all Xaa locations
  Clone ID: PAT_TA_98316.pep
MPPLTTPKXXDXLFAXVERILFTLTXGTIXRKLLXDXXKVEEVXKXLDQMGYXIGTXLXDXFLCXSNVSXCADFXEXTADTIXKVS

SEQ ID NO: 203899 - protein, 102 aa, Triticum aestivum
  unsure (1)..(102): unsure at all Xaa locations
  Clone ID: PAT_TA_98317.pep
MVSLAAPAFHSLASQVSXACTTRASSKCESAPGRRGAKARPRAAGTXQAAAVEAXETPRXXWDELGSDLSEPXXXAMXXLSPKLXNRFXAXXPXVXXLSPGE

SEQ ID NO: 203900 - protein, 117 aa, Triticum aestivum
  unsure (1)..(117): unsure at all Xaa locations
  Clone ID: PAT_TA_98318.pep
MKTLLILTILAMATTIATANMQVDPSGQVQWSQQQPFPQPQQPFCQXPQQTIPQPHQTFHHQPXXTFPQPQQXYPHQPQXXFPQTQHPQXPFPQPHYXFPXQPXLXFPXXXPHSLKS

SEQ ID NO: 203901 - protein, 79 aa, Triticum aestivum
  unsure (1)..(79): unsure at all Xaa locations
  Clone ID: PAT_TA_98319.pep
ERWKAAYSELPPGXXPKLAELXERDLADSEAREALPDADNSQLKVSMVVFVSMLYWXTXQXAXGSLPMGXPIKKSAXXA

SEQ ID NO: 203902 - protein, 89 aa, Triticum aestivum
  unsure (1)..(89): unsure at all Xaa locations
  Clone ID: PAT_TA_98320.pep
GFYRAAAGSTGEASKLFIDCKQRPSTNSPAPADPVDQSPAPVHKAVRIFGVDLLTAPASPGCKRAXIHGEAAGXRQAALKKQCIELALA

SEQ ID NO: 203903 - protein, 127 aa, Triticum aestivum
  unsure (1)..(127): unsure at all Xaa locations
  Clone ID: PAT_TA_98321.pep
MKTFLILALLAIVATTATTAVRVPVPQLQPQNPSQQQPQEQVPVVQQQQFLGQQQPFPPQQPYPQPXPFPSQQPYLQLQPFPQPQLPYSQPQPFQPXQPYPQPXQPQYSQPXQPXSQAASSRKQAAG

SEQ ID NO: 203904 - protein, 120 aa, Triticum aestivum
  unsure (1)..(120): unsure at all Xaa locations
  Clone ID: PAT_TA_98322.pep
MKTFLILALLAIVATTATTAVRVPVPQLQLQNPSQQQPQEQVPLVQEQQFXQGQQQPFPPQQAIXPRXQXFPSQQPYLQLQTFPQXPQLSYPEXAXPFRPQQPYPQXQPQFSQPQQPISP

SEQ ID NO: 203905 - protein, 122 aa, Triticum aestivum
  unsure (1)..(122): unsure at all Xaa locations
  Clone ID: PAT_TA_98323.pep
MARLNSKAVVAAVVLAAVVLMMAGREASAALSCGQVDSKLAPCVAYVTGRASSISKECCSGVQGLNGMXRSKXDRKIACRCLKSLATSIXSINMGKVSGRXPAKCGVSVXFPNQHVPNECLN

SEQ ID NO: 203906 - protein, 140 aa, Triticum aestivum
  unsure (1)..(140): unsure at all Xaa locations
  Clone ID: PAT_TA_98324.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQXPVLPPQXSPFPQATTNRLGKQQIPWLVIIL

SEQ ID NO: 203907 - protein, 53 aa, Triticum aestivum
  unsure (1)..(53): unsure at all Xaa locations
  Clone ID: PAT_TA_98325.pep
ERDXEIXLSFXSRSSSSAXSXRSPPPXTAXXTAXEPPXTPPLSPSPPVXCXYG

SEQ ID NO: 203908 - protein, 133 aa, Triticum aestivum
  unsure (1)..(133): unsure at all Xaa locations
  Clone ID: PAT_TA_98326.pep
KNYLLHQCTPVSLXSXLVSXXLATERDCQVMQQQCCQQLAQIPRQLQCAAIHSVVHSIVMQQEQQXGIQILRPLFQLVQGQGIIQPQQPSQYEVIRSLVLXXLPNMCXVVCPTWTAPTIIEPFAQSPGNQLDN

SEQ ID NO: 203909 - protein, 152 aa, Triticum aestivum
  unsure (1)..(152): unsure at all Xaa locations
  Clone ID: PAT_TA_98327.pep
DASAGGGSLDEYPTIDPTSFDVVLCGTGLPESILAAACAAAGKTVLHVDPDPFYGSFYSSIPLPSVPSFLSXPTPPXPARPPQTTTSSATAEYTAVDXERRSLYSEVXETSGTVPEPVQGGFNGSTWVGPRVXLLAPNEGRWTFPSGQEGKP

SEQ ID NO: 203910 - protein, 103 aa, Triticum aestivum
  unsure (1)..(103): unsure at all Xaa locations
  Clone ID: PAT_TA_98328.pep
FPSSXXPHQPFPQPQQQFPQPQQPQQSFPQQQRPFIQXPSLQQRLNPCKNILLQQCKPASLVSSLWSIIWPQXDCQXVMQQQCWQTSTRFLRSSAIQGWNFGG

SEQ ID NO: 203911 - protein, 104 aa, Triticum aestivum
  unsure (1)..(104): unsure at all Xaa locations
  Clone ID: PAT_TA_98329.pep
PLLPRGPQPPSAAAEGRGGRRPPPQAPPAPSPPPVGFDPMASXRILKELKDLQKDLPXHAXAGPXGEDMFPLXXXNYQWXPSXTARSTGGAYFLGWKNSIFPTG

SEQ ID NO: 203912 - protein, 145 aa, Triticum aestivum
  unsure (1)..(145): unsure at all Xaa locations
  Clone ID: PAT_TA_98330.pep
QQEGKARIXESPRKEKXSRAQAPPXRHLXRKERRFEFLGXPXAXPXXTPGRGPFPPTLAGPTXRRLEQATTFKXEVEQAHRNPEXRNPSTLXKSPXAXMEGGIALDQXHPTTGAMPXPSPFVAAAXPCSFLRRRRERRXGSRGGG

SEQ ID NO: 203913 - protein, 100 aa, Triticum aestivum
  unsure (1)..(100): unsure at all Xaa locations
  Clone ID: PAT_TA_98331.pep
MKTFLILALLAIVATTATIAVRVPVPQLQPQNPSQQQPQEQVPLVXQQQFPGQQQPFPPXQXPYPQPQPFPSQQPYLQLQPFPAATTISRPATYHFRQAA

SEQ ID NO: 203914 - protein, 59 aa, Triticum aestivum
  Clone ID: PAT_TA_98332.pep
VLASFRAHRLNDKGLGVILIYELLRSFSELECIRCTTKAGRVSNVTNIKGTKENKSDYE

SEQ ID NO: 203915 - protein, 84 aa, Triticum aestivum
  unsure (1)..(84): unsure at all Xaa locations
  Clone ID: PAT_TA_98333.pep
GFLPPPVRPTRRHGPPQRRRKVFPPCSTCCSSEETXQRQARPSSSTLLTXKSNGGGIIERDLGPTFAQGHGFRYWKVPWRNXGC

SEQ ID NO: 203916 - protein, 93 aa, Triticum aestivum
  unsure (1)..(93): unsure at all Xaa locations
  Clone ID: PAT_TA_98334.pep
VAHNPSGEPVTAGRTRQPRRPTPPPPPPTPAPPPPHMPXLTRLPIPPTAAAQGHGPRPAXYLRXXCPARXXSXPVGSRSTSPHLSPFNMSSCR

SEQ ID NO: 203917 - protein, 140 aa, Triticum aestivum
  unsure (1)..(140): unsure at all Xaa locations
  Clone ID: PAT_TA_98335.pep
MKTLLILTILAMAITIGTANIQVDPSGQVQWLQQQLVPQLQQPLSQXQPQXTFPQPXXTFPHQPQXXVPQXPQQPQXXISPSPKXXFPQQSTNXPFPPKTXXPXXNPFXPXXQXQXISPKXSNNPXXXFPPXXPTXXPFP

SEQ ID NO: 203918 - protein, 103 aa, Triticum aestivum
  unsure (1)..(103): unsure at all Xaa locations
  Clone ID: PAT_TA_98336.pep
RRPDTRTGRARNGARFWTXAKRKXXPEATXAXPARDGXAAPAADTGLGAGASCAETTERAATDRTARTATALDATVEAAIASVGRWXICGGGGGEGLIRIGVE

SEQ ID NO: 203919 - protein, 129 aa, Triticum aestivum
  unsure (1)..(129): unsure at all Xaa locations
  Clone ID: PAT_TA_98337.pep
QQQQQILQQILQQQLIPCRDVVLQQHNIAHASSQVLQQSSYQQLQQLCCQQLFQIPEQSRCQAIHNVVHAIILHHHQQQQQQPSSQVSYQXKPQEQYPSGQGSFQVISSKTHRPKGSVQPQQLPQVPRK

SEQ ID NO: 203920 - protein, 77 aa, Triticum aestivum
  Clone ID: PAT_TA_98338.pep
TPIVVVLSTVAHLSIGHYVAYVRAGRKQQSSGSSSWVCASDRGIKEVPLEEVLGCEAYMLFYERMDDRGICGSLPTN

SEQ ID NO: 203921 - protein, 83 aa, Triticum aestivum
  unsure (1)..(83): unsure at all Xaa locations
  Clone ID: PAT_TA_98339.pep
IPRVAYSTHACSKXQCLLPGFQREISNEAGAGWQARXNFWATRVKNAWVKAKSGPNLINWQLGGGFQKXWRGSNALFGAXFGX

SEQ ID NO: 203922 - protein, 136 aa, Triticum aestivum
  unsure (1)..(136): unsure at all Xaa locations
  Clone ID: PAT_TA_98340.pep
MDXFSSGSGDVRSGSSLTVGEXLCAAFLPFVAVAEAVFFVXADXLADICPSSXXSSRXRXEXSASXFLTGXKXSHHLFRXRVGPGCTSLXLPXPCPPPPRESRCFSVKRSGGAVRCSKKDAAPIITKLNLLEAILI

SEQ ID NO: 203923 - protein, 112 aa, Triticum aestivum
  Clone ID: PAT_TA_98341.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLCQRMPLCKFDAAPFK

SEQ ID NO: 203924 - protein, 116 aa, Triticum aestivum
  unsure (1)..(116): unsure at all Xaa locations
  Clone ID: PAT_TA_98342.pep
IKILPRKSRSSALSLERERVARPSKPIHGDXXVSSPSXVSAPPPSGPPRFPAGGXPXGRXVDGGNSRARRLRTSAPDSAIGPRGTXPPKALKXCWFLCNQRNLGEVIKLTKAVSXN

SEQ ID NO: 203925 - protein, 52 aa, Triticum aestivum
  unsure (1)..(52): unsure at all Xaa locations
  Clone ID: PAT_TA_98343.pep
LLXSYSATFITATSXPRPXMSRVDQVPXXRGLNFXGRDRARSNATPRGGGRY

SEQ ID NO: 203926 - protein, 115 aa, Triticum aestivum
  unsure (1)..(115): unsure at all Xaa locations
  Clone ID: PAT_TA_98344.pep
MDASTTGAGAXAXXGAAGRKAGGPXKKSVTRSVKXGLQFPVXRIXRYLKERAXXKRVGTGGPVXLAAVLQYSPRSLLELAXGNPAKDKQEVSHRAKHLLLAVRNDKKSGXCLAGL

SEQ ID NO: 203927 - protein, 136 aa, Triticum aestivum
  unsure (1)..(136): unsure at all Xaa locations
  Clone ID: PAT_TA_98345.pep
MKTFLILALLAIVATTATTAVRVPVPQLQPQNPSQQQSQEQVPLVQQQXFLGQQQPFPPQXPYPQXQPFPSQQPYLQLQPFPQPQLPXSQPXXHFRPKQPXSNIRQPTNXXQTNXHPXFHKQAXXQXINQXXXKQG

SEQ ID NO: 203928 - protein, 76 aa, Triticum aestivum; identical to SEQ ID NO: 185994
  Clone ID: PAT_TA_98346.pep

SEQ ID NO: 203929 - protein, 128 aa, Triticum aestivum
  unsure (1)..(128): unsure at all Xaa locations
  Clone ID: PAT_TA_98347.pep
MGRVIRAQRKGAGSVFKSHTHHRKGPARFRSLDFGERNGYLKGVVTDVIHDPGRGAPLAKVTFRXPFKXYSNKKELFVAAEGMYNRAIRLTGGRRRQPSPVGKVLPAPLRCLKGRRQFGKGRATTSNR

SEQ ID NO: 203930 - protein, 96 aa, Triticum aestivum
  Clone ID: PAT_TA_98348.pep
RDWAWLARGPPRRCRRSRRACRRQGRTGRGGEVVEVAPGPPVLVRLLRQCGLSPPNPRFPIQAHGDTRTCCGCLPLDFGVKSETKVEEDGDKSGER

SEQ ID NO: 203931 - protein, 74 aa, Triticum aestivum
  unsure (1)..(74): unsure at all Xaa locations
  Clone ID: PAT_TA_98349.pep
MKTFLVFALLAVVATSAIAQMETSCIPGLERPWQXQQPLQQKETFPQQPPFSQHQQPSSTATNTICSAIYLAAS

SEQ ID NO: 203932 - protein, 131 aa, Triticum aestivum
  unsure (1)..(131): unsure at all Xaa locations
  Clone ID: PAT_TA_98350.pep
RAPKFWTRXSRKPPPPTPWRASTGCXAVHTAEGQPARTCATMRRGSGGANPAGAAAPGRKAPRERCRAAGEAPPPPSSAAPRAKPAAASGGGEERGGGGGDGGDGLGFRPSSRPRGRREGERGEVGKIYCS

SEQ ID NO: 203933 - protein, 115 aa, Triticum aestivum
  unsure (1)..(115): unsure at all Xaa locations
  Clone ID: PAT_TA_98351.pep
XXPVLPQQPPFSXQXXPPFSQQXQXSSQQPPFPQQHQQFPQQQIPVVQPSVLQQLNPCKVFLQQXQCXHVAXSQRLARXHXCWQQEXSCHVXXXNKCLNCPANPKPPGSGQRGHR

SEQ ID NO: 203934 - protein, 110 aa, Triticum aestivum
  unsure (1)..(110): unsure at all Xaa locations
  Clone ID: PAT_TA_98352.pep
IGARAFGSAAVNDTAPPVDDAGHGTHTASTAAGNFVENADVRGNAHGTASGMAPHAHLAIYKVCSRNRCSIMDVIAGAXDPPSKDGVDVISMFNRTSPNGILNLLRRPQR

SEQ ID NO: 203935 - protein, 62 aa, Triticum aestivum
  unsure (1)..(62): unsure at all Xaa locations
  Clone ID: PAT_TA_98353.pep
LXAGGWRRTDXTMRAVAIASPGGPEALQVXEVDDLPXPGEGEGXHPQXSILGXNXHXHFHXV

SEQ ID NO: 203936 - protein, 74 aa, Triticum aestivum
  unsure (1)..(74): unsure at all Xaa locations
  Clone ID: PAT_TA_98354.pep
PMPQQPQQPFPQLQQPQXPLPQPQQPQQPFPQQQQPLIQPYLQQQMXPCKNYLLQQCNPXXXVXSLXSMXLARK

SEQ ID NO: 203937 - protein, 65 aa, Triticum aestivum
  unsure (1)..(65): unsure at all Xaa locations
  Clone ID: PAT_TA_98355.pep
MAASMITSPIVAPTSVPSLSRRGSSFAVVCXGXKKXKVDKPLGXGXXLTIHIDANXKESPAKKGV

SEQ ID NO: 203938 - protein, 91 aa, Triticum aestivum
  unsure (1)..(91): unsure at all Xaa locations
  Clone ID: PAT_TA_98356.pep
HKSTMKKFLVLALIVVAATTTAAEPFTAFRSAWEPQHPSSPEHQPTPQAQRTSKFHIKKLNPCKGCPSYNKCXPNLLICQFLRVNRVGANI

SEQ ID NO: 203939 - protein, 123 aa, Triticum aestivum
  unsure (1)..(123): unsure at all Xaa locations
  Clone ID: PAT_TA_98357.pep
LQSHLRNSSQQASPAMSGRGKGGKGLGKGGAKRHRKVLRDNIQGXITKPAIRRLARRGGVKRISGLIYKEXRGVLKIFLENVIRDAVTYNGATPAXRXSTAMDVVYALKAXXGRNPLPAFXGA

SEQ ID NO: 203940 - protein, 144 aa, Triticum aestivum
  unsure (1)..(144): unsure at all Xaa locations
  Clone ID: PAT_TA_98358.pep
GIPLEEXGVXWKPARPNGXELSGXFQPLPRDERXDEPQARSNLRARNFSSXPLDDEDSCESRLSEEEPVGIXRRRRRXAAXGAVGAPVARGGASGAGGHGDGGRGRDGXCDPPDHRXXHFPLLLWRLAAGERGVNEXWRHAGXS

SEQ ID NO: 203941 - protein, 80 aa, Triticum aestivum
  unsure (1)..(80): unsure at all Xaa locations
  Clone ID: PAT_TA_98359.pep
YLTWKDCKGVENKHMGDICRMYLLRYLSLRGTNINVLPPKVCDLEHLXTLDVRATGLAKLPKTLXKLKKLXRLXLPQKGC

SEQ ID NO: 203942 - protein, 60 aa, Triticum aestivum
  unsure (1)..(60): unsure at all Xaa locations
  Clone ID: PAT_TA_98360.pep
PXLLXXCWLLSKNKSPHPLPFPFPQINQSLPPSFTRAGQASPPRFDFASKSLGEGRGXXP

SEQ ID NO: 203943 - protein, 140 aa, Triticum aestivum
  unsure (1)..(140): unsure at all Xaa locations
  Clone ID: PAT_TA_98361.pep
ATKPPSASSPSSHQPTTPPPGYAPPALTPPTAPTPSSPLPLPAPGPWTPPPPPSGEGGTPSSPPSGEGGAPSSPPSGEGGTTPVHGMPYSSPPPPPTTVPLPPVHGVSYSSPPPPLLPPVYGVSYSSPPXPMPGPRGSTG

SEQ ID NO: 203944 - protein, 92 aa, Triticum aestivum
  unsure (1)..(92): unsure at all Xaa locations
  Clone ID: PAT_TA_98362.pep
MQIFVKTLTGKTITLEVESSDTIDNVKAKIQDKEGIPPDQXQRLIFAGKQLEDGRTLADYNIQXKESTLHLVLRLRGGMQIFVKEPHREHQP

SEQ ID NO: 203945 - protein, 73 aa, Triticum aestivum
  unsure (1)..(73): unsure at all Xaa locations
  Clone ID: PAT_TA_98363.pep
SKXXXQGQQGQIXPASQQQPXQGQQGXYPAXLQQPGQGQQGHYPXSLQQLGQGQQTGQPGQKQQPGQGQQTGQ

SEQ ID NO: 203946 - protein, 115 aa, Triticum aestivum
  unsure (1)..(115): unsure at all Xaa locations
  Clone ID: PAT_TA_98364.pep
MKTFLVFALLAVAATSAIAQMETRCIPGLERPWQQQPLPPQQTFPQQPLFSQQQQLFPQQPSFSQQQPPFWQQQPPFSQXXQQQQQQGIQDHAATISAPSKVRASSNLNNQLNWG

SEQ ID NO: 203947 - protein, 128 aa, Triticum aestivum
  unsure (1)..(128): unsure at all Xaa locations
  Clone ID: PAT_TA_98365.pep
MKTFLVFALLAVAATSAIAQMETRCIPGLERPWQXQQPLPPQQTFPQQPLFSQQQQQQQQQEQQQQQQPSSQVSYQQASSNNIHRGKDSSNHLNTHKAKALFNLKNFPNSEIDLTLQANGNVQCLSLQ

SEQ ID NO: 203948 - protein, 105 aa, Triticum aestivum
  unsure (1)..(105): unsure at all Xaa locations
  Clone ID: PAT_TA_98366.pep
TFLIFXLLAIAATSAIAXXETSXVPGLXKPWQQQPLXPHQXPPCSQQQQXFPQHXQPIIILQHSPFSQQQHXVLPXXQPVIILQQPXFSQXQQXVLPQXPPFXXQ

SEQ ID NO: 203949 - protein, 86 aa, Triticum aestivum
  unsure (1)..(86): unsure at all Xaa locations
  Clone ID: PAT_TA_98367.pep
SNGXXSIRXPXDXRNVTKARIXRDPXHXXRXIXDXWXRRISPYXAEGLMEVVVXGGPGEAAHEAAVXRXRHGSLPFSPLRTTETLD

SEQ ID NO: 203950 - protein, 120 aa, Triticum aestivum
  unsure (1)..(120): unsure at all Xaa locations
  Clone ID: PAT_TA_98368.pep
QXXPPFSQXQQQPILPQQPPFSQHQQXVLPQQQIPYVQPSILXQLNPCKVFLQXHCXPVAMPQSLARSQMLWQXSCHVMQXHCCQXQLPXIPRTXXAMXAIRANSRSVPTNQWVRGFPIK

SEQ ID NO: 203951 - protein, 78 aa, Triticum aestivum
  unsure (1)..(78): unsure at all Xaa locations
  Clone ID: PAT_TA_98369.pep
EEAKEGNIVRRKLXRSXSQGRTLDXHIEEQFSVGRXXXCISSPPGQCGRAXDGYILEGKELEFYMRKLQKKNGKGATA

SEQ ID NO: 203952 - protein, 134 aa, Triticum aestivum
  unsure (1)..(134): unsure at all Xaa locations
  Clone ID: PAT_TA_98370.pep
XLCCLHLXXIPXQXXCXAIHXVVHAIILXXQQKKQQQQQQQPSSQVSFQQPQQQYPLGQGSFRPSQQNPQAQGSVQPQXLPQFEEIRNLALXTLPAICNVYIPPYCTIAPFGIFGTNEENSIYMKHRFLSMGFG

SEQ ID NO: 203953 - protein, 83 aa, Triticum aestivum
  unsure (1)..(83): unsure at all Xaa locations
  Clone ID: PAT_TA_98371.pep
TLSFHXPSXIYRACSFKLFHCLRELRISYPNLHGCLGTLIRITWNPQKGAASAFSLQHGLSCHIMYTGVRSSSSPRIHQSRDT

SEQ ID NO: 203954 - protein, 100 aa, Triticum aestivum
  unsure (1)..(100): unsure at all Xaa locations
  Clone ID: PAT_TA_98372.pep
MAAAARRALLLLLAAAAVXLLAAPPAAAARPCGRAXTLLISFSSFSRPNPDPADPSPLTTTVVTVLRVRRLGPHRFXAHXXEPPXDPXPPXSPLLRLAPP

SEQ ID NO: 203955 - protein, 103 aa, Triticum aestivum
  Clone ID: PAT_TA_98373.pep
QLAQIPQQLQCAAIHSVVHSIIMQQEQRQGVQIRRPLFQLVQGQGIIQPQQPAQLEVIRSLVLRTLPTMCNVYVSPDCSTINAPFANISRRHWWPMKNAKSLC

SEQ ID NO: 203956 - protein, 86 aa, Triticum aestivum
  Clone ID: PAT_TA_98374.pep
PPLAPPRPAGAPPPIAERRRPSSPRRRTAYRRHALPWPTLPPRLPLPQVPPHPRPSPASIRATCFSVAGRLQEVAGIAPSSNPLAA

SEQ ID NO: 203957 - protein, 132 aa, Triticum aestivum
  unsure (1)..(132): unsure at all Xaa locations
  Clone ID: PAT_TA_98375.pep
SXREGGPQXSRKXVLFXFEXTIXQGEKXLLDYTLXPKVXTSXIKVPKVKNXSGEPLXXPPRAVGALRVXPRRXPPPPRPRASCAGRRPXPVEERGRGGAGSRGRARPPLAAARGCRQRSACAGGRRRRRDSS

SEQ ID NO: 203958 - protein, 88 aa, Triticum aestivum
  Clone ID: PAT_TA_98376.pep
MVHPSTAGAHIHPRATYIRIRICVYACAIQSAQVISQLVVKEGRRPRHIYISVSHAPKLSVQPCPTKLATPNYVPGCNMIQKMSKWVK

SEQ ID NO: 203959 - protein, 50 aa, Triticum aestivum
  Clone ID: PAT_TA_98377.pep
EGRLNHQGRGRTPPPTCSKHGCKRDPPFTVASLSTAPSSPATTMHFAARS

SEQ ID NO: 203960 - protein, 62 aa, Triticum aestivum
  unsure (1)..(62): unsure at all Xaa locations
  Clone ID: PAT_TA_98378.pep
SNHKFDLMYAKRAFVHLXYLGEGMEEGEFSEAREXXXSLEKDYEEVGAEFDEGEDGDEGDEY

SEQ ID NO: 203961 - protein, 128 aa, Triticum aestivum
  unsure (1)..(128): unsure at all Xaa locations
  Clone ID: PAT_TA_98379.pep
MANGGDGDGDVPENANEHCPGTQSEAAGKAESCAXGCPNQQICATAPKGPDPDLLAIIERMNTVKHKILVLSGXGGVGKSTFSAQLSFALVEMDYQVGLLDIDICGPSXPKMLGLXEGQDIHQSNVWL

SEQ ID NO: 203962 - protein, 50 aa, Triticum aestivum
  Clone ID: PAT_TA_98380.pep
IISNIYIITTFIIIVIHILIICNIKNPSGSFGVLVESFTHVFHYYEHDDC

SEQ ID NO: 203963 - protein, 101 aa, Triticum aestivum
  unsure (1)..(101): unsure at all Xaa locations
  Clone ID: PAT_TA_98381.pep
MSTAEATREENVYMAKLAEQAERYEEMVEFMEKVAKTADVGELTVEEXNLLSVAYKNVIGARRASWRIISSIEQKEESRGERGLVASIKEYRTKIETELNK

SEQ ID NO: 203964 - protein, 132 aa, Triticum aestivum
  unsure (1)..(132): unsure at all Xaa locations
  Clone ID: PAT_TA_98382.pep
PCRAGPARLASYSPRAPDHHSPIASPSLTSKIHPWRTPGRSPTCPSRSPRPSSSFSSYSSPKAGASAASGCRRARRPCGHRPPAPLQEAAPPRAGQPRRGTRXGCCSSASAPAAXSXIXXPAXAEGVPDGSR

SEQ ID NO: 203965 - protein, 105 aa, Triticum aestivum
  unsure (1)..(105): unsure at all Xaa locations
  Clone ID: PAT_TA_98383.pep
MAVPTPQRRLLAAAMALLLVLASSGAVARAGMSGPIKTVVVVVMENRSFDXMLGWMKRLNPAIDGVTGAEWNPANASDPSAGPRVYLGDGAQFVDPGPRGTRYXE

SEQ ID NO: 203966 - protein, 132 aa, Triticum aestivum
  unsure (1)..(132): unsure at all Xaa locations
  Clone ID: PAT_TA_98384.pep
LQTXEPVXFLDGERRQRRVAAEVAGQPGLVGRVQLQQPARQPEQAGCELAGDAVLTSRNTPGSRHAAASCSVSLDSSASRSTVGSSSSSSSHPSASCSMDPLLCWIKRRRSSLMDLDGRTEQSRAAKGTSFT

SEQ ID NO: 203967 - protein, 121 aa, Triticum aestivum
  unsure (1)..(121): unsure at all Xaa locations
  Clone ID: PAT_TA_98385.pep
MKTFLILALLAIVATTATTAVRVPVPQLQLQNPSQQQPQEQVPLVQEQQFPGQXQQPFPPKQPXYPQAQPFPSQQPYLQAANIFNKPQLSYPQAANQFRPTTTNIQKAANKFSANKQTKFS

SEQ ID NO: 203968 - protein, 143 aa, Triticum aestivum
  unsure (1)..(143): unsure at all Xaa locations
  Clone ID: PAT_TA_98386.pep
LEVESSDTIDNVKAKIQDKEGIPPDQQRLIFAGKQLEDGRTLADYNIHKESTLHLXLRLRGGMXIFVKTLTGKTITLEVESSDTIDNVKXXIQDKXWXIPPEQAXLIFRRXATPGIARTLGXTXNXQKFQPSGQRFPGGEFSP

SEQ ID NO: 203969 - protein, 90 aa, Triticum aestivum
  unsure (1)..(90): unsure at all Xaa locations
  Clone ID: PAT_TA_98387.pep
MARLNSKAVAAAVVLAAVVLMMAGREASAALSCGQVDSKLAPCVAYVTGRASXXNKECCSGVQGLXGLAPTXPDRKITFKVQKLPTNQVQ

SEQ ID NO: 203970 - protein, 95 aa, Triticum aestivum
  unsure (1)..(95): unsure at all Xaa locations
  Clone ID: PAT_TA_98388.pep
MSRGGSAGGGQSSLGYLFGDGEPAKPAAAPXAAKPAPAEKPTPAAADVAKQIPTGIPXNRANNYXRANXQKXGNFLKXRXSNKGQXXPXXGSSLX

SEQ ID NO: 203971 - protein, 142 aa, Triticum aestivum
  unsure (1)..(142): unsure at all Xaa locations
  Clone ID: PAT_TA_98389.pep
QPPFSQQQQPPFSQQQPPFSQQQQPVLPQQPSFSQQQLPPFSQQQSPFSQQQQIVLQQQPPFLQQQQPSLPQQPPFSQQQQQLVLPQQQIPFVHPSILQQLNPCKVFLQXAMQPWGXMPQSXARSQMFAXKXLAMXXQQVNQ

SEQ ID NO: 203972 - protein, 61 aa, Triticum aestivum
  unsure (1)..(61): unsure at all Xaa locations
  Clone ID: PAT_TA_98390.pep
RXRRXXXTXEENXGXGXXRGGXEXRRGEEXXHRXRTAEAAGVGGGWRELVGVGRLXDAGLL

SEQ ID NO: 203973 - protein, 81 aa, Triticum aestivum
  Clone ID: PAT_TA_98391.pep
KQQQQPSSQVSFQQPLQQYPLGQGSFRPSQQNPQDQGSVQPQQLPQFEEIRNLALQTLPAMCNVYIPPYCTIAPFGIFGTN

SEQ ID NO: 203974 - protein, 105 aa, Triticum aestivum
  Clone ID: PAT_TA_98392.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKAVKM

SEQ ID NO: 203975 - protein, 140 aa, Triticum aestivum
  unsure (1)..(140): unsure at all Xaa locations
  Clone ID: PAT_TA_98393.pep
FPTATATYSAFRETNKDAAFSLFLRLLPPRVLYLLHLSLSLLTPWKERYERTPPPSPELPPLARAVSSLSQGISWDPSRVAADLVQCVDFRPHLSGDLRVGVGAQEQVSPPENLTGSXNLNKPWVLSIKIXPXXNRXXRX

SEQ ID NO: 203976 - protein, 129 aa, Triticum aestivum
  unsure (1)..(129): unsure at all Xaa locations
  Clone ID: PAT_TA_98394.pep
MRSRALLVLLLCSLLAGAANAEPSPDPTYKDCHPGDKAALLAVKAALGEAXHFASWTPDKPLLRLVRSHLRTXXRXRRRARRLPRSQPQGEQSXRPPRASPTGXNLTLGNFPGVFGPKXGRANGKSSXN

SEQ ID NO: 203977 - protein, 35 aa, Triticum aestivum
  unsure (1)..(35): unsure at all Xaa locations
  Clone ID: PAT_TA_98395.pep
FFVFXFFFFXFFFFFFFFFFFFFFFFFFFFLQKIT

SEQ ID NO: 203978 - protein, 140 aa, Triticum aestivum
  unsure (1)..(140): unsure at all Xaa locations
  Clone ID: PAT_TA_98396.pep
MKTLLILTILAMAITIGTANIQVDPSGQVQWLQQQLVPQLQQXPLSQQPQQTFPQPQQTFXPHQPQQQVPQPXANHNNQFXXAPXXQFPPKQTXKQXISPQXXKQPXTNXFSPGKPTNXPIFPXXQKNPKKNQFSPKXXK

SEQ ID NO: 203979 - protein, 123 aa, Triticum aestivum
  unsure (1)..(123): unsure at all Xaa locations
  Clone ID: PAT_TA_98397.pep
AFPLLKGVVATTDVVEACTGVNVAVMVGGFPRKEGMERKDVMTKNVSIYKAQASALEAHAAPNCKVLVVANPANTNALILKEFAPSIPEKNIXCLTRLNHKQGHSVKFLXRLGVQXSDVXKCY

SEQ ID NO: 203980 - protein, 115 aa, Triticum aestivum
  unsure (1)..(115): unsure at all Xaa locations
  Clone ID: PAT_TA_98398.pep
MPVSRIAVGSHREVYEVGALKAALAEFISTLIFVFAGQGSGMAFXKLNPDGAGNPAGLISGXIAQPFALFVGVSVGRXNSRXXXLNPGREPSALPGGKINPPSGSKVPLPGVPGG

SEQ ID NO: 203981 - protein, 56 aa, Triticum aestivum; identical to SEQ ID NO: 134756
  Clone ID: PAT_TA_98399.pep

SEQ ID NO: 203982 - protein, 115 aa, Triticum aestivum
  unsure (1)..(115): unsure at all Xaa locations
  Clone ID: PAT_TA_98400.pep
MKKFLVLALIVVAATTTAAEPFTAFRSAWEPQHPSSPEHQPTPQPQEHPVPHQKLNPCRDALLQQXCSPVADMSFLRSQVVQHXXCLVMWEXXCXQLKAIPXAXKNGNPKNVPPF

SEQ ID NO: 203983 - protein, 121 aa, Triticum aestivum
  unsure (1)..(121): unsure at all Xaa locations
  Clone ID: PAT_TA_98401.pep
ILQQQLIPCRDVVLQQHNIAHASSQVLQQSSYQQLQQLCCQQLFQIPEQSRCQAIHNVVHAIILHHHQQQQQQPXSQVSXXKPQGQYPSRQXSLPXSPQQNPTRAXGXVQXXKKLAXFQGN

SEQ ID NO: 203984 - protein, 135 aa, Triticum aestivum
  unsure (1)..(135): unsure at all Xaa locations
  Clone ID: PAT_TA_98402.pep
TARPNPKPSRTPPPPILSLAEAATGRRHRPRVSVQFGEFGAQERKGGATSLWWSGIQDKMHFPCINSTACKFLSFLSXFPGEWDAKKIPGKWVXXKXXXDPXKKKGNPSXNWXXKNLETXKFKGPXXKXGXKKLQ

SEQ ID NO: 203985 - protein, 109 aa, Triticum aestivum
  unsure (1)..(109): unsure at all Xaa locations
  Clone ID: PAT_TA_98403.pep
QFPQTQQPQQPFPQPQQTFPXXPQLPFPQQPXQPFPQPQXPQQXFPQSQQPXQPFPQPQQXFLQSXQPQXSFPQXXHPLIQLSLQQQXNPCKNFLLXXMAXPVXLVSSS

SEQ ID NO: 203986 - protein, 139 aa, Triticum aestivum
  unsure (1)..(139): unsure at all Xaa locations
  Clone ID: PAT_TA_98404.pep
MKTFLVFALLAVAATSAIAQMETRCIPGLERPWQQXPLPPXQTFPQQPLFSXQQQLFPQQPSFSQXQQPPFWXQXPPFSQQQPILPQATPFSQQXXLVLPQXPPFSQXQXTRFLPXTXXXLFPTTXXQHXQXWVXQXXP

SEQ ID NO: 203987 - protein, 146 aa, Triticum aestivum
  unsure (1)..(146): unsure at all Xaa locations
  Clone ID: PAT_TA_98405.pep
NFCQQPXQTIPQPHQTFHHQPQQTFPQPQQTYPHQPQXQFPQTQQPQQPFPQPQQTFPQXPQLPFPQQPQXXXSPRPQXPQQPFPQSQQPXXPFXQPQTXFSAXPQQPQXSXPQXTATXDSXHFYXQQMTPCKDFPPCSXCKHXXI

SEQ ID NO: 203988 - protein, 48 aa, Triticum aestivum
  Clone ID: PAT_TA_98406.pep
AEVHHIESFGHLAYVSKVCSDEYQVESSPVGPTMISTTHRSPFVQGRK

SEQ ID NO: 203989 - protein, 136 aa, Triticum aestivum
  unsure (1)..(136): unsure at all Xaa locations
  Clone ID: PAT_TA_98407.pep
MKTFLVFALLAVAATSAIAQMETRCIPGLERPWQQQPLPPQQTFPQQPLFSQQQQLFPQQPSFSQQQPPFWQXQPPFSQQXPILPQQPPFSQXQXLXVYPQXPPFSQXQXNQVLPPQQSPFPHQQXHQQLXATNSL

SEQ ID NO: 203990 - protein, 93 aa, Triticum aestivum
  unsure (1)..(93): unsure at all Xaa locations
  Clone ID: PAT_TA_98408.pep
LLLQQQILQQILQQQQLIPCRDVIVLQQHNIXHESSQVLQQSSYQVLQQLCCQQLRLIPEQSRCQAIHNVXHAIILHQQXSTSXXNKQQRGTF

SEQ ID NO: 203991 - protein, 143 aa, Triticum aestivum
  unsure (1)..(143): unsure at all Xaa locations
  Clone ID: PAT_TA_98409.pep
MKTFLVFALLAVAATSAIAQMETRCIPGLERPWQQQPLPPQQTFPQQPLFSQXQQLFPQXPSFSQXXPPFWASXQXTIFLXXQXXSYQRXXTIXRXXSXXLASXXKQXNQFSXGNXQPSFYLPTXKSPFPQQQXPPTGWNPVV

SEQ ID NO: 203992 - protein, 141 aa, Triticum aestivum
  unsure (1)..(141): unsure at all Xaa locations
  Clone ID: PAT_TA_98410.pep
IPFVHPSILQQLNPCKVFLQQQCSPVAMPQSLARSQMLQQSSCHVMQQQCCQQLPQIPQXSRYEAIRAIIYSIILQEQQQVQGSIQTXKQXPQQLGQCVSXPQQEVXTXNSXHXPXQXXFGTRXLFWQPHQYLLEGLSIAV

SEQ ID NO: 203993 - protein, 141 aa, Triticum aestivum
  unsure (1)..(141): unsure at all Xaa locations
  Clone ID: PAT_TA_98411.pep
PSAPPPPXPTPPFPRPLCCRPPIPTCSCRRPIPTCSCRPPTPRPPKPPPGPPTSPTPPPPPRIPRPPSPTPPPPPTPTFPPSPRSXRRPWMTPTTXGSTTPRAPPXKHMTLAPPAPPDQGNPXEGWQRSGSGPTRKGGMKK

SEQ ID NO: 203994 - protein, 102 aa, Triticum aestivum
  unsure (1)..(102): unsure at all Xaa locations
  Clone ID: PAT_TA_98412.pep
RCQAIHNVVHAIILHHHQQQQQQPSSQVSYQQPQEQYPSGQGSFQSSQQNPQAQGSVQPQQLPQFQEIRNLALQTLPAMCXVYIPPYCSTTIAPFXGIFGTN

SEQ ID NO: 203995 - protein, 142 aa, Triticum aestivum
  unsure (1)..(142): unsure at all Xaa locations
  Clone ID: PAT_TA_98413.pep
CTDVDFSWYELPGAGAGCRVHGGFMKALGLQRRGGGWPRDVADPTGAGDGRPFAYYAIREKLKRFLDGNPGARFAVAGHSLGGALAVLFPTVLALHGEEAVLGRLQGVYTFGXQPRVGRPSGSGAFNGRRTWEQPGTSGSVL

SEQ ID NO: 203996 - protein, 107 aa, Triticum aestivum
  unsure (1)..(107): unsure at all Xaa locations
  Clone ID: PAT_TA_98414.pep
VAGINIYSSGTGSWNFMESGWDSDSTICGRCVFHQGMLHFVSAQSTVVSVDVEGKKWRAISVPEGVERSELGFLARSQGHLHYMVHXGIRQEXSIWCLEXHDSXEWA

SEQ ID NO: 203997 - protein, 105 aa, Triticum aestivum
  unsure (1)..(105): unsure at all Xaa locations
  Clone ID: PAT_TA_98415.pep
MARLNSKAVAAAVVLAAVVLMMAGREASXALSCGQVDSNLAPCVAYVTGRASSISKECCSGVQGLNGLGPQAPVPDNRGPQEAPTHQFQGGSGRPGSGVRSFPSV

SEQ ID NO: 203998 - protein, 40 aa, Triticum aestivum
  Clone ID: PAT_TA_98416.pep
ELKVKLLLSVDISSAQIMCIFSSCVITLHFSRVTVFFICN

SEQ ID NO: 203999 - protein, 97 aa, Triticum aestivum
  unsure (1)..(97): unsure at all Xaa locations
  Clone ID: PAT_TA_98417.pep
MKTFLVFALLALAAASAVAQISQQQQAPPFSQQQQPPFSQXQXPXFSQEQQSPFSQQQQXPPFAQHXQPXFSPSSPISQAVHFHHTHFSTQQLTRPA

SEQ ID NO: 204000 - protein, 138 aa, Triticum aestivum
  unsure (1)..(138): unsure at all Xaa locations
  Clone ID: PAT_TA_98418.pep
MKTFLVFALLAVAATSAIAQMETRCIPGLERPWQXQPLPPQQTFPQQPLFSQQQQLFPQXPSFSQQQPPFWQXQQPPFSQQXPILPQQPPFSXQXXXVVLPXXPPFFSSXQXXSFXPPXXXHPFXQTAPHGQQPLLRP

SEQ ID NO: 204001 - protein, 147 aa, Triticum aestivum
  unsure (1)..(147): unsure at all Xaa locations
  Clone ID: PAT_TA_98419.pep
GVKDYKLTYYTPEYETKDTDILAAFRVSPQPGVPPEEAGAAVAAESSTGTWTTVWTDGLTSLDRYKGRCYHIEPVAGEDSQWICYVAYPLDLFEEGXPLLNMFTFIXXNVFGFQXAPNVLLRFWRDLXKFPPTYSKNXSKGPPFMGI

SEQ ID NO: 204002 - protein, 72 aa, Triticum aestivum
  Clone ID: PAT_TA_98420.pep
HRQQITAHRSSSLTKRKVRREMTGVTTGHATSCRSRPPTAAGRGRRDGEAVVGCDTITMMKGNCLRLRGGRM

SEQ ID NO: 204003 - protein, 136 aa, Triticum aestivum
  unsure (1)..(136): unsure at all Xaa locations
  Clone ID: PAT_TA_98421.pep
MKTLLILTILAMAITIGTANIQVDPSGQVQWLXQQLVPQLQQPLSQQPQQTFPQPQQTFPHQPXEQGSPSLSNHKQPFLQXPQQPFPQXSXXIHSPQTQQXPQXLIFXXXPQITYFPXDSTNPEXXXSPKXPQTNS

SEQ ID NO: 204004 - protein, 134 aa, Triticum aestivum
  unsure (1)..(134): unsure at all Xaa locations
  Clone ID: PAT_TA_98422.pep
MAPIKIGINGFGRIGRLVARVALQSPDVELVAVNDPFITTDYMTYMFKYDTVHGQWKHHEVKVKDSKTLLFGQKEVAVFGCRNPEXEIPWAAAGWLXYVVEVXRXFFNTRKGWQKIKGVGCQRKVNQFLLPKQM

SEQ ID NO: 204005 - protein, 122 aa, Triticum aestivum
  unsure (1)..(122): unsure at all Xaa locations
  Clone ID: PAT_TA_98423.pep
GILAADESTXTIGKRFASINVENVEDNRRALRELLFCTPGALQYLSGVILFEETLYQSTKGGKPFVDILKAGNVLPGIKVDKGTIELAGTNGETTTQGFDDLGKRCAKVLGLGAPLPPWANP

SEQ ID NO: 204006 - protein, 130 aa, Triticum aestivum
  unsure (1)..(130): unsure at all Xaa locations
  Clone ID: PAT_TA_98424.pep
MANPRVFFDMTVGGAPAGRIVMELYKDAVPRTVENFRALCTGEKGVGKXGKPLHYKGXSFHRVIPDFMXPRAADFXKGHXAXGWXSPSXGXEVRPXEXXFVHNXHXXXGXXPPXAXAGAPNTXXAPKVLH

SEQ ID NO: 204007 - protein, 102 aa, Triticum aestivum
  Clone ID: PAT_TA_98425.pep
RLLPPAPVRPPRRHPSHPKTTPSRSRTPPLPHEHQPTPPPVRAPPPPPISAPAHTAAVASLLQHPPPPAYLIIHTKGGKKREIPLPSKAARLILCRPPNARD

SEQ ID NO: 204008 - protein, 139 aa, Triticum aestivum
  unsure (1)..(139): unsure at all Xaa locations
  Clone ID: PAT_TA_98426.pep
TFLILALLAIVATTATIAVRVPVPQLQPQNPSQQQPQEQVPLVQQQQFPGQQQPFPPQQPYPQLQPFPSQQPYMQLQPFPQPQLPXPQPQLPYPQPQPFXPQQPXPHQQPYEVFSIGWMMDVIQGMDHLFRSNAVVHCY

SEQ ID NO: 204009 - protein, 77 aa, Triticum aestivum
  unsure (1)..(77): unsure at all Xaa locations
  Clone ID: PAT_TA_98427.pep
FFFAXETXFIACHKHCPLXQNGXTAXAPRNVTXRHRYMXXYIPKGNNTSXNCGTRAXRPXXXKWXMIIYXERXLLSI

SEQ ID NO: 204010 - protein, 142 aa, Triticum aestivum
  unsure (1)..(142): unsure at all Xaa locations
  Clone ID: PAT_TA_98428.pep
PNPTRAAAPRGSSATMSGRGKGGKGLGKGGAKRHRKVLRDNIQGITKPAIRRLARRGGVKRISGLIYEETRGVLKIFLXNVIRDAVTYTEHARRKTXVPPWDXXYALKXPXPAXSYGFRRAAWPPAKIGRQVFFGPSRLPPL

SEQ ID NO: 204011 - protein, 96 aa, Triticum aestivum
  unsure (1)..(96): unsure at all Xaa locations
  Clone ID: PAT_TA_98429.pep
MKTFLVFALLAVAATSAIAQMEXTRCIPGLERPWQQXPLPPQQTFPQQPLFSQQQQLFPQQPSFSQQQPPFWQXXPPFSQQQPLLPXQQAPFSQQT

SEQ ID NO: 204012 - protein, 79 aa, Triticum aestivum
  unsure (1)..(79): unsure at all Xaa locations
  Clone ID: PAT_TA_98430.pep
MXVXXRXHNFQAKYPPHXRHPXYSRXWRAXTPSRAAATGWAPESASATAGRTPAAASAAPTAPRSSWPLARSLRCSSMR

SEQ ID NO: 204013 - protein, 94 aa, Triticum aestivum
  unsure (1)..(94): unsure at all Xaa locations
  Clone ID: PAT_TA_98431.pep
MKTFLILALLAIVATTATTAVRVPXAQXXXQNPSXEKAQRAISLXNNKNXXXSNNISXQQPXHSATFXSQQHXXVEHFLXPQYKFPAQFKTFNP

SEQ ID NO: 204014 - protein, 98 aa, Triticum aestivum
  unsure (1)..(98): unsure at all Xaa locations
  Clone ID: PAT_TA_98432.pep
MKTFLVFALLAVAATSAIAQMETRCIPGLERPWQQQPLPPQQTFPQQPLFSQQQQLFPQQPSFSQXQQPPFWXQQQPHFLKQQPILPQQPHFXXQQXF

SEQ ID NO: 204015 - protein, 153 aa, Triticum aestivum
  unsure (1)..(153): unsure at all Xaa locations
  Clone ID: PAT_TA_98433.pep
QVYQVVHGNFFSVSLHTGSNALDRQGIXNFVXQSXXGLQGXNPXCLQXSGQGQQIXQGXMXXYPTYLQQXGQGQQIXXQGQQGFYPTXXQXAGXRQQPGQGLQIXXGQQXXQGRQXXQGQXXGQGQQGXYPSXPQQXGQGQXPGQWQQSGQGQ

SEQ ID NO: 204016 - protein, 93 aa, Triticum aestivum
  unsure (1)..(93): unsure at all Xaa locations
  Clone ID: PAT_TA_98434.pep
MSDTDEHHFESKADSGASKTYPQQAGAIRKGGTHRHQGXPCKVVEXPLPKTGKHXHAKCHFCCNLILWELGTFLSMPKAKFQLIYKPIISPSN

SEQ ID NO: 204017 - protein, 67 aa, Triticum aestivum
  unsure (1)..(67): unsure at all Xaa locations
  Clone ID: PAT_TA_98435.pep
MARAQVMLMAVALVLMLAAVPRAAVAIDCGTXQLVRPCLXYFKAARPSGQCCNXVKNSIQGHFQTQL

SEQ ID NO: 204018 - protein, 162 aa, Triticum aestivum
  unsure (1)..(162): unsure at all Xaa locations
  Clone ID: PAT_TA_98436.pep
MKTFLVFALLAVAXTSAIAQMETRCIPGLERPWXQQPLPPQQTFPQQPLFSQQQQLFPQQPSFSQQQXPFGQQQPPFLKQQXILPQQQXFSQQXQLVLPQQXHFQQQQXPVLLPQHHFFQQQQQXQQXGEQHPVXQPSILQXANPCXYXSTXCNPVGMHTSC

SEQ ID NO: 204019 - protein, 151 aa, Triticum aestivum
  unsure (1)..(151): unsure at all Xaa locations
  Clone ID: PAT_TA_98437.pep
QQGQQLAQGQQGQQPAQVQQGQRPAQGQQGQQPGQGQQGQQLGQGQQGQQPGQGQQGQQPGQGQQPGQGHHGYYPLPPXDPRQGQQPRQWQQPRQRHQGXTNSPFXLWQRHKVLPIFNKTRQHQDMHTRIGIQFSQGKRKTWTSGTLPPKK

SEQ ID NO: 204020 - protein, 109 aa, Triticum aestivum
  unsure (1)..(109): unsure at all Xaa locations
  Clone ID: PAT_TA_98438.pep
XKPLXFVXTXGPWXPVGRXCWLGXXVXXFLKXFRXFLLCFLKPWXGAGPWTXASNRRGXSSVFRDLLGGDRLSPPRAPSSVSAADGFLDISGGHCRRGCKKMTGVAEAG

SEQ ID NO: 204021 - protein, 82 aa, Triticum aestivum
  unsure (1)..(82): unsure at all Xaa locations
  Clone ID: PAT_TA_98439.pep
RAGGPHGPHRWPTLIFCEGFELEHACRDPKDGELCLSGRNQRKSGGGPKDTXVQXSSNLVIXXKTXQQHXXSPQFPPRKPGH

SEQ ID NO: 204022 - protein, 145 aa, Triticum aestivum
  unsure (1)..(145): unsure at all Xaa locations
  Clone ID: PAT_TA_98440.pep
PQQPPFSQQQQPQFSQQQQPFPQQQQPLLLQQPPFSQQRPPFSQQQQQPVLPQQPPFSQQQQQQPIXPQQPPFSQHQQPXLPQQQIXYVQASILAASKPCKXSSKQQCXXXMPQXLAKXQIXWXXCHVMQQQVCHKCRXPXDITL

SEQ ID NO: 204023 - protein, 140 aa, Triticum aestivum
  unsure (1)..(140): unsure at all Xaa locations
  Clone ID: PAT_TA_98441.pep
GTNKSPSRSRLRSTPAPPPPVLPHRPKMQIFVKTLTGKTITLEVEXPSDTIDNVKAKIQDKEGIPPDQQRLIFXAGKQLEDGRXLADYTSKKXQPSTXLRLXGRNXFFVKTLNWEXXHXGGXXENXQXXRXIQDRXNPPA

SEQ ID NO: 204024 - protein, 146 aa, Triticum aestivum
  unsure (1)..(146): unsure at all Xaa locations
  Clone ID: PAT_TA_98442.pep
MAPKAEKKPAAKKPVEEEPAAEKAEKAPAGKKPKAEKRLPAAGKTSAKDGDKKAKKKSKKSVETYKIYIFKVLKQVHPDIGISSKAMSIMNPFIKRHLPRNSPGKAAKFARYNKEANITPREIXNFVRLXFPGELXKEXSPKXTXN

SEQ ID NO: 204025 - protein, 124 aa, Triticum aestivum
  Clone ID: PAT_TA_98443.pep
KKYLPIVVVGGCCGCCCGCCWGLGNTLPLLGLLLLELDWNPDLLLFLQDDGVDDSTDCLIAGLLGDLQQQLPPFSQQQPPFSQQQQPVLPQQPPFSQQQQPILPQQPPFSQQQQQPVLPQQQIP

SEQ ID NO: 204026 - protein, 158 aa, Triticum aestivum
  unsure (1)..(158): unsure at all Xaa locations
  Clone ID: PAT_TA_98444.pep
MKTFLIFALLAIVATSAIAQMENSHIPGLERPSQQQPLPPQQTLSHHQQQQPIQQQPPFSQQQQPPFSXQQQQPSSQQPPFPQQHQQXPQQQSLLFNHPFCSKLNPCKCSSKQQCYHVGMSNSCXVTMWQQSNCKWMQQQCFQQLPXPPNNPSEXSXP

SEQ ID NO: 204027 - protein, 88 aa, Triticum aestivum
  unsure (1)..(88): unsure at all Xaa locations
  Clone ID: PAT_TA_98445.pep
ISXTGXXHCSPYPSNGKVXGQKFECCXXGTKAVXXVGVIMNIGISEQSRVSFYLNKCAPSQERGLLHVLALRLLTVIRSSTYHQTNYN

SEQ ID NO: 204028 - protein, 99 aa, Triticum aestivum
  unsure (1)..(99): unsure at all Xaa locations
  Clone ID: PAT_TA_98446.pep
QPFPLRPQQPFPQQPQQSQQSFPQPQPQQPQQPSILQPQQPLPQQPQQPFQQPQQQLSQQPEQXFPKQPQQPFPQATTPTSTTISTTTTIWELTSIGGQ

SEQ ID NO: 204029 - protein, 75 aa, Triticum aestivum
  unsure (1)..(75): unsure at all Xaa locations
  Clone ID: PAT_TA_98447.pep
FPQPXHPQHXFPQPQXPXXPFPQQPQQPFPQXXQPLIQPXLQXQXXPCXNYLLQQCNPVSLXSXLVSMILPXXDC

SEQ ID NO: 204030 - protein, 147 aa, Triticum aestivum
  unsure (1)..(147): unsure at all Xaa locations
  Clone ID: PAT_TA_98448.pep
QPFPQPQQTFPQQPQLPFPQQPQQPFPQPQQPQQQFPQSQQPQQPFPQPQQQFLQPQQPQXSFPQQQQRWIQVSLQQQMNPWQDFSLAXMATCVIGCHPSISMILATXNCQVMQQHVCQQMXXSLKKNFASKRSFIKQGHDRLISHC

SEQ ID NO: 204031 - protein, 83 aa, Triticum aestivum
  unsure (1)..(83): unsure at all Xaa locations
  Clone ID: PAT_TA_98449.pep
AAATAARAALRPAPLAGRGLGLGSSLPSSSPARAARILRRSAVAGLETLLPLHTAVASARLKSCIAVDSTCWXSLSQGFKKRV

SEQ ID NO: 204032 - protein, 158 aa, Triticum aestivum
  unsure (1)..(158): unsure at all Xaa locations
  Clone ID: PAT_TA_98450.pep
MKTFLVFALLAVVATSAIAQMDTSYIPGLERPWQQQPLPPQQTFPQQPPFSQXQQQQQQPFPQQPSFSQQQPPFSQQQQLILPPQQQQQXPQXQISNVQPSVLQQLXPCXVXLQQQXXPVXMAKXLARXQMWQQNVACDXQXCCQQLSQIPEXSRYDA

SEQ ID NO: 204033 - protein, 167 aa, Triticum aestivum
  unsure (1)..(167): unsure at all Xaa locations
  Clone ID: PAT_TA_98451.pep
MKTFLVFALLAVAATSAIAQMETRCIPGLERPWQQQPLPPQQXTFPQQPLFSQQQQLFPXQQPSFSAATTTIFGQQQPPFFSXQQPILPQQPPFXSQQQQLXVLPQQPHFSQQQQPFLLPQXHXFPQQQXHQQWVQQQPWCSATIWXQXTMQSSNCTRGNASLLQML

SEQ ID NO: 204034 - protein, 176 aa, Triticum aestivum
  unsure (1)..(176): unsure at all Xaa locations
  Clone ID: PAT_TA_98452.pep
QQXQPQFSQQQQPPYSQQQQPPYSQXQQPPFSQQXQPPFSQQQQQPPFTQQQQQQQQQQPFTQQQQPPFSQQPPISQQQQPPFLQQQRPPFSRXQQIPVIHPSVLXQXNPCXVFLPTECIPGGMQRCXLARSQMLQQXCHVMXQXCCQXXRETXRSRHXHPATSXYTCTTQXNTHN

SEQ ID NO: 204035 - protein, 103 aa, Triticum aestivum
  Clone ID: PAT_TA_98453.pep
MSRTGPIAQDWEPVVVRKKLPNAAAKKDEKAVNAARRAGVDIHIAKKHNAGTNKAAHSTTSAQIQRGLIDDTRESLLNERVPFRPGRKLCKVTGTRQHKKFSD

SEQ ID NO: 204036 - protein, 81 aa, Triticum aestivum
  unsure (1)..(81): unsure at all Xaa locations
  Clone ID: PAT_TA_98454.pep
XKLRHHYXXILYCLRTGXXTFWIVXIXYTXPFSYXYYXXTRYNGSTIFKHXQIPXSPPXTLXSSSKICDLLHXLLPLPXGG

SEQ ID NO: 204037 - protein, 147 aa, Triticum aestivum
  unsure (1)..(147): unsure at all Xaa locations
  Clone ID: PAT_TA_98455.pep
QQPYLQLQPFPQPQLPYSQPQPFRPQQPYPQPQPQYSQPQQPISQQQQQQQQQQQQQQQQXLQQFGNNNWIPCMXVVLQQHNIAHGXXQFLQQSLNXCYRLCCQHLWNSLAFMPASKRLFKHYSGNNKPHTHQPCKKFQGLRHNGGV

SEQ ID NO: 204038 - protein, 55 aa, Triticum aestivum
  unsure (1)..(55): unsure at all Xaa locations
  Clone ID: PAT_TA_98456.pep
FXXGFXLXPFVPNWVETSLXXFWLIRIWYRLICFIYISLSDCHLFSFFFNTCTVS

SEQ ID NO: 204039 - protein, 121 aa, Triticum aestivum
  unsure (1)..(121): unsure at all Xaa locations
  Clone ID: PAT_TA_98457.pep
QQLPQIPQQSRYEAIRAIIYSIILQEQQQVQGSIQTPQQQPQQLGQCVSQPQQQSQQQLGQQPQQQQLAQGTFLQPHQXIAQLEVMTPLRSVTLPTIXRVNVPVCXNTTSVXFRCLHRIWS

SEQ ID NO: 204040 - protein, 159 aa, Triticum aestivum
  unsure (1)..(159): unsure at all Xaa locations
  Clone ID: PAT_TA_98458.pep
MKTFLILALLAIVATTATTAVRVPVPQLQLQNPSQQQPQEQVPLXVQEQQFPGQQQPFPPQQXYPQPQPFPSQQPYLQAATFPQPQLSYPQPQPFRPQQPYPQPQXQYSQPQQQXRSKQEQQQXTTTQQHNPTTFCNTTVPCRDXVLQQHNIRRELKIL

SEQ ID NO: 204041 - protein, 162 aa, Triticum aestivum
  unsure (1)..(162): unsure at all Xaa locations
  Clone ID: PAT_TA_98459.pep
MKTFLILALLAIVATTATTAVRVPVPQLQPQNPSQQQPQEQVPLVQQQQFPGQQQQFPPQQPYPQPQPFPSQQPYXLQLQPFPQPQPFPPQLPYPXAASFPPXQPYPQQQPQYLQPXQQFXKQQAQQQQQQQQQQXQQQQXLQQIWQQQLIPAGIVLQXTNT

SEQ ID NO: 204042 - protein, 159 aa, Triticum aestivum
  unsure (1)..(159): unsure at all Xaa locations
  Clone ID: PAT_TA_98460.pep
MKTFLVFALLAVAATSAIAQMETRCIPGLERPWQQQPLPPQQTFPQQPLFSQQQQLFPQQPSFSQQQPPFWXQQQPPFLKQQPILPQQPPFRKQQQLXLPQQPHFTSNNNSFTPQXTFPQQQQHQQWVQQQPWCSSIHLQELTMQPPTRCTLWAKLWLG

SEQ ID NO: 204043 - protein, 123 aa, Triticum aestivum
  unsure (1)..(123): unsure at all Xaa locations
  Clone ID: PAT_TA_98461.pep
RCRTDLTPTLGRALGYYDPRNQTLEPFTRLLXXICXLTTAQFFFXXFXPXHLIRPNFPKSYFLTFNXGXKHGXLXDCPGKXXTTTXLFASLPTIXQSLRLPSXQXXPRDFFPENPQYLPRLGN

SEQ ID NO: 204044 - protein, 163 aa, Triticum aestivum
  unsure (1)..(163): unsure at all Xaa locations
  Clone ID: PAT_TA_98462.pep
MKTLLILTILAMAITISTANMQVDPSGQVQWPQQQLVPQPQQAFPQQPQQPFPQTQQPQQPFPQXQPQQPFPQXTQQPQQHFPKQPQQXFPKQPQQHSPRLKQPQQHFPSNHNNIPPDQQPQQHFPXXQHTTFPSPQHPTAPQRNIIPQXQDVINHLYTLTMK

SEQ ID NO: 204045 - protein, 116 aa, Triticum aestivum
  unsure (1)..(116): unsure at all Xaa locations
  Clone ID: PAT_TA_98463.pep
NLRXCTFXXDEFXSKNLGPXLXRREPTFXXLGHRLXKVFXLSXSXVAXLEXXWREILXLMLXIGIXSRRNXSSNHLADGXRLHGDCLLYLELHAVRRYEHDHXVXTCLCGXHXXWI

SEQ ID NO: 204046 - protein, 164 aa, Triticum aestivum
  unsure (1)..(164): unsure at all Xaa locations
  Clone ID: PAT_TA_98464.pep
MKTFLILALLAIVATTATTAVRVPVPQLQLQNPSQQQPQEQVPLXVKNNNFQGKQQPFPPQQPYPQPQXFPSQQHICSCNHFPQAQLSYPQRNHFRPQQPYPQPXPQYSQPQQHFGKQQQXQXQQQQQQQQSYTAKTMIHAGFCIAHTTYATKFCKSTTAHVNN

SEQ ID NO: 204047 - protein, 95 aa, Triticum aestivum
  unsure (1)..(95): unsure at all Xaa locations
  Clone ID: PAT_TA_98465.pep
YXFLXKMXXXHQLEFSQAXVHDXVGRXIXXSXIVPXCXXLLGRKXSRNXGXAGKLANVDELMXVARLXSTSSFLRXGXXAXRPFKPXKXRGTXLG

SEQ ID NO: 204048 - protein, 122 aa, Triticum aestivum
  unsure (1)..(122): unsure at all Xaa locations
  Clone ID: PAT_TA_98466.pep
QAQLPFPQQPQQPFPQPQQPQQPFPQSQXPQQPFPQPQQPQQSFPQQQQPLIQPYLQQQMNPWQELLLQQCNPVSLXVSSSVSMILPRKXICKVMQQQCXQQLTQIPXRQSNCATIXNXWNS

SEQ ID NO: 204049 - protein, 108 aa, Triticum aestivum
  Clone ID: PAT_TA_98467.pep
IKAAYRRLARERHPDVAGAAGDDFIRLHDAYATLSDPDARARYDRDVVVAYAQPPASKPNGSGGHSPNLEKNSWKAGPFIKFRFKNHHYNRSVFKPNGLKFVGANKVC

SEQ ID NO: 204050 - protein, 152 aa, Triticum aestivum
  unsure (1)..(152): unsure at all Xaa locations
  Clone ID: PAT_TA_98468.pep
MKTFLILALLAIVATTATTAVRVPVPQLQLQNPSQQQPQEQVPLVQEQQFPGQQQPFPPQQPYPQPQPFPSQQPYLQLQPFXQAQLSYPQAATFRPQQPYPQAQPQYPQPQQHXSSXXSRRXHTHTSTFNKTSMQEFFEQPHTMEPISRNMF

SEQ ID NO: 204051 - protein, 159 aa, Triticum aestivum
  unsure (1)..(159): unsure at all Xaa locations
  Clone ID: PAT_TA_98469.pep
MKTFLILALLAIVATTATTAVRVPVPQLQLQNPSQQQPQEQVPLVQEQQFPGQQQPFPPQQPYPQPQPFPSQQPYLQLQPFPQPATIISASATFRPQQPFHSXQPQYSQHNNISAAATAEQQQQQQQQQXLQQFCNTTXPCRSLYAQHNIRRSHFARLR

SEQ ID NO: 204052 - protein, 77 aa, Triticum aestivum
  unsure (1)..(77): unsure at all Xaa locations
  Clone ID: PAT_TA_98470.pep
MKTFLILALLAIVATTATTAVRVPXPXLQPQNPSXQQPQEXVPLVQQQQFPGQQQQFPPQQPYPXXXSFPSQQPYLQ

SEQ ID NO: 204053 - protein, 87 aa, Triticum aestivum
  unsure (1)..(87): unsure at all Xaa locations
  Clone ID: PAT_TA_98471.pep
CIFYLCTLHVISYGADKVEIQTAVLMIHTVPILYDKYQGQVDHFAGKAIPRRASTXXCWPKSSEQIXRRXXKTKEPKXXVPXFXXGP

SEQ ID NO: 204054 - protein, 145 aa, Triticum aestivum
  unsure (1)..(145): unsure at all Xaa locations
  Clone ID: PAT_TA_98472.pep
MARLNSKAVAAAVVLAAVVLMMAGREXASAALXCGQVDSXLPPCVLXTGERASSXLSKDSAPGVQGLKRLXRSNXDRXIAXSAXKPXNNINSINMAXXPGXPXIRVLPSQHFQQIENTIKKPNFIMDVLTLVGQTSLLLKKKNVC

SEQ ID NO: 204055 - protein, 169 aa, Triticum aestivum
  unsure (1)..(169): unsure at all Xaa locations
  Clone ID: PAT_TA_98473.pep
VPVPQLQPQNPSQQQSQEQVPLVQQQQFLGQQQPFPPQQPYPQPQPFPSQQPYLQLRPFPQPQLPYSQPQPFRPQQPYPQPQPQYSATTTSNFTSSSSKQQQQQQQEQQILQQXLQQQLIPCMDVVLQQHNIAHGSYXFGNKXLTTVGKMCCQHYGVPGASHAHHMFSC

SEQ ID NO: 204056 - protein, 72 aa, Triticum aestivum
  unsure (1)..(72): unsure at all Xaa locations
  Clone ID: PAT_TA_98474.pep
RSSSPSLPSQIPTPPPPRPSLRPPSSPTIIXSLSPPSPSSVSFSPCPNLHPGQRPSDXPSSPPRPGHAILSS

SEQ ID NO: 204057 - protein, 92 aa, Triticum aestivum
  unsure (1)..(92): unsure at all Xaa locations
  Clone ID: PAT_TA_98475.pep
DNEDGASDPSVNVXREHPTXLHHXPVXHHHPXNLKDPHDXXCAGWXPXXSVMCYXXXHRLIXHEDXKXVPYIISVALXATCKNXSFXKXLAE

SEQ ID NO: 204058 - protein, 141 aa, Triticum aestivum
  unsure (1)..(141): unsure at all Xaa locations
  Clone ID: PAT_TA_98476.pep
EGQQGQQPGQGQQPGQGQPGYYPTSPQQLGQGQQPRQWLQPRQGQQGYYPTSPQQSGQGQQLGQGQQGYYPTSPQQXGQGQQGYDSHTMFSAEHQGGQPKGGKXQQLRGQLPAIGRRRPFGNQWIDICTRLVLKHASLNYT

SEQ ID NO: 204059 - protein, 111 aa, Triticum aestivum
  unsure (1)..(111): unsure at all Xaa locations
  Clone ID: PAT_TA_98477.pep
QQPFPQPQQQFLQPQQPQQSFPQQQQPLIQLSLQQQMNPCKNFXLQQCNPVSLVSSLISMILPRSDCQVMQQQCCQQLEXIPQXFXCCXQQXXXNPTIMEQGQXRNFRGKF

SEQ ID NO: 204060 - protein, 72 aa, Triticum aestivum
  unsure (1)..(72): unsure at all Xaa locations
  Clone ID: PAT_TA_98478.pep
MAPKKEKAPAASSKPAKSGGGKQKKKXWSKGKQKEKVNNXVLFDXPPNDKLLNQGAKYKQFTPPSSSXRLKI

SEQ ID NO: 204061 - protein, 105 aa, Triticum aestivum
  unsure (1)..(105): unsure at all Xaa locations
  Clone ID: PAT_TA_98479.pep
LVMWEQCCQQLKAIPKQSRCEAIHNVVHAIILQQQKQLVQGTSTQPQAAATTSXTXTWVKGPSQPQHQQQQQQLGRFGFLAIRTWVDSPFPGNRLHVPNTYTIST

SEQ ID NO: 204062 - protein, 157 aa, Triticum aestivum
  unsure (1)..(157): unsure at all Xaa locations
  Clone ID: PAT_TA_98480.pep
MKTFLILALLAIVATTATTAVRVPVPQLQPQNPSQQQSQEQVPLVQQQQFLGQQQPFPPQQPYPQPQPFPSQQPYLQLQPFPQPQLPYSAAQPFXRPQQPYPQPQXQYSQPQHPIXQQQQQQQQQQQQDNNTSTIWHTTDPVVLNNTTYAWSYFAQQ

SEQ ID NO: 204063 - protein, 133 aa, Triticum aestivum
  unsure (1)..(133): unsure at all Xaa locations
  Clone ID: PAT_TA_98481.pep
EPQQPLPQPQQPQQPFPQQQQPLIQPYLQQQMNPCKNYLLQQCNPVSLVSSLVSMILPRSDCKVMRQQCCQQLAQIPQAVQVRSIHGVLHSHHHXSKEQQQQQQQQQGIQFMXALFNSFQVQGIIQPQTTTHW

SEQ ID NO: 204064 - protein, 151 aa, Triticum aestivum
  unsure (1)..(151): unsure at all Xaa locations
  Clone ID: PAT_TA_98482.pep
MKTFLVFALLAVAATSAIAQMETRCIPGLERPWQQQPLPPQQTFPQQPLFSQQQQLFPQQPSFRKQQXPFGQQQPHFLKQQQSTTATTFSQQQQLVLPATTTXSQQQQXFYLQQHNXFPTTTTHQQLXNNNVFHFGANQASSSKNMHPVGM

SEQ ID NO: 204065 - protein, 160 aa, Triticum aestivum
  unsure (1)..(160): unsure at all Xaa locations
  Clone ID: PAT_TA_98483.pep
PQQTFPHQPQQQVPQPQQPQQPFLQPQQPFPQQPQQPFPQTQQPQQPFPQQPQQPFPQTQTTPTTIFPNNQQQPFPKIKQPQQPFSQVQXQPTQLFPKAQTTIGASPKXRQQSFPPTTTAFIQHSXNNSXNPXQDXLGMKLMGTRITGTKRWQVIRNKLQ

SEQ ID NO: 204066 - protein, 156 aa, Triticum aestivum
  unsure (1)..(156): unsure at all Xaa locations
  Clone ID: PAT_TA_98484.pep
PERRPLFQFEIQASQLREVSAASFPSPPPEPFTSARPRVQAAAAGPPPRRAQPAEPSVGPASGTAAPPSPSLGASAPLKQRRRPELPSDRSIAXSTFVLRFXTTAXQTSRISSRSLEDLXPRGWRTERYGSMKRSSXHGRAXQELLXGXCQALRNE

SEQ ID NO: 204067 - protein, 94 aa, Triticum aestivum
  unsure (1)..(94): unsure at all Xaa locations
  Clone ID: PAT_TA_98485.pep
MALPNQNTVDYPSFKLVIVGDGGTGXKTTFVKRHLTGRXGEEIRTTXGVEVHPLVSTTNWXKIVSNGXEXGXGKKFGGLKDXTQQLGLQGGFKG

SEQ ID NO: 204068 - protein, 172 aa, Triticum aestivum
  unsure (1)..(172): unsure at all Xaa locations
  Clone ID: PAT_TA_98486.pep
LQQPLSHQPQQQVPQPQQPQQPFPQSQQPQQPFPQPQQPQQSFPQXQQQPLIQPYLQQQMNPCKNYLLQQCNLVSLGASLPXPMILXRSDXXQGDASNNVCQQLXXFLRQSSCAXIHSVLIQSXCXKEQQQXYNSPGTVLLQKSSNSTTTYELIMGITFHNSVNITQQIPDK

SEQ ID NO: 204069 - protein, 147 aa, Triticum aestivum
  unsure (1)..(147): unsure at all Xaa locations
  Clone ID: PAT_TA_98487.pep
QACDHLIATMDPALKAYLDKMSDEATARANKQDGNNNAILQALATQDGAGLTPSVTWEAGVXRRRFAQFGXSVPRSSKPRSPXTAHPTDFPPLXXLPWXRXNXXGNXGTTTXIWGFPXVPPSXDFPXTDWAISKASWTXNSTDMXLI

SEQ ID NO: 204070 - protein, 105 aa, Triticum aestivum
  unsure (1)..(105): unsure at all Xaa locations
  Clone ID: PAT_TA_98488.pep
SPRWGPTTXGSPPSSGSRSTRRGPKGMREWPSWWAPTPAGSSSTXSPAISCIXXVYILRKILKLNFNXXKGKCLGXIXVQMXFRGFPRFIHFVMVLLQIMLSKSF

SEQ ID NO: 204071 - protein, 103 aa, Triticum aestivum
  unsure (1)..(103): unsure at all Xaa locations
  Clone ID: PAT_TA_98489.pep
SIIVQQQQQQQQQQQQQQQQGMHILLPLSQQQQLGQGTLXVQGQGIIQPQTTTQXEAIKSLVXLQILPTMXNVVCPPXCPSSRTFATYPRILWPMKKQVYIIM

SEQ ID NO: 204072 - protein, 85 aa, Triticum aestivum
  unsure (1)..(85): unsure at all Xaa locations
  Clone ID: PAT_TA_98490.pep
GRGKGGKGLGKGGAKRHRKVLRDNIQGITKPAIRRLARRGGVKRISXGLIYEETRGVXKIFLXKLIXKAXNLNQQXRXKTLXHGL

SEQ ID NO: 204073 - protein, 123 aa, Triticum aestivum
  unsure (1)..(123): unsure at all Xaa locations
  Clone ID: PAT_TA_98491.pep
MSCCGGNCGCGAGCKCGNGCGGCKMFPDVEATAGAAAMVMPTASHKGSXGXSETAGETGGCDCTXQCGTRAVVLCSATEPGPRGGKSTQIGGQQADITHSVHTTRSSRGRLINNSFLFSLPGS

SEQ ID NO: 204074 - protein, 122 aa, Triticum aestivum
  unsure (1)..(122): unsure at all Xaa locations
  Clone ID: PAT_TA_98492.pep
GWGXLVRSQXSKFAKIVXLGXXXGRTWFGGIXXLNHXXSXDSLIDMFXWGKXSXWDGPIPQXTASHCCPKGASAXTRGSPSWGRRSSRTLPTAGCGFRICSAXTPSLECSLAGAVDDSNGAR

SEQ ID NO: 204075 - protein, 148 aa, Triticum aestivum
  unsure (1)..(148): unsure at all Xaa locations
  Clone ID: PAT_TA_98493.pep
QQQQQQQQILQQILQQQLIPCMDVVLQQHNIAHGRSQVLQQSTYQLLQELCCQHLWQIPEQSQCQAIQNVVHAIILHQQQKQQQQPSEPXSFQTALXQQYPLSQGPSXHLKQNPQDQGXVQPQQXPHFXGIRTNATDATACACLXPPY

SEQ ID NO: 204076 - protein, 136 aa, Triticum aestivum
  unsure (1)..(136): unsure at all Xaa locations
  Clone ID: PAT_TA_98494.pep
MAALSSAAVSVPSFAAGAKVAAPRSSRMVVRASLGKKAASAAVAMAASAMLLGGSAMAQDVLLGANGGXLVFEAQQFKRQRPAKHXFKXNAXYPXXXVFXXXTXALXXQILKFPKEEYSKPPGNFSVKLTSXELRF

SEQ ID NO: 204077 - protein, 168 aa, Triticum aestivum
  unsure (1)..(168): unsure at all Xaa locations
  Clone ID: PAT_TA_98495.pep
MKTFLVFALLAVAATSAIAQMETRCIPGLERPWQQQPLPPQQTFPQQPLFSQQQQLFPQQPSFSQQQPPFWQQQPPFSQATTIXPQQPPFSQQQQLVLPQQPPFSQQQQPFYLHNITFPQQQQHQQLGATTXPVVQXSICKQLNHASILQQHAPCGAQRLLVQMLHKQ

SEQ ID NO: 204078 - protein, 116 aa, Triticum aestivum
  unsure (1)..(116): unsure at all Xaa locations
  Clone ID: PAT_TA_98496.pep
SSQSLASFPRRHPPRKGGCLAAAATAGAAPAASAATAAAGARCSPTWRPPPAPPPWSCPPPPTRGVXXSRRPGRPAAATAPPAXRTACGAPAAVQLSPXPXRPAGKRQHERDKQAT

SEQ ID NO: 204079 - protein, 162 aa, Triticum aestivum
  unsure (1)..(162): unsure at all Xaa locations
  Clone ID: PAT_TA_98497.pep
SKLQHKFYYQQQQPFLQQQQPSLPQQPPFSQQQQQLVLPQQQIPFVHPSILQQLNPCKVFLQQQCSPVXAMPQSLLGPQMLQQSXCHVMQQQCCQHCPQXPNIPAMSIPCYIYPIILARTTQVQGPSKSLSTQHWACFPNPTDHNNNPGTTQQQHWDKFCTT

SEQ ID NO: 204080 - protein, 75 aa, Triticum aestivum
  Clone ID: PAT_TA_98498.pep
THFMDSFNLQWLWFLHYRFLISADFRLFQVLASSKSKSYSFGRCNILSEFILLLFFVYLMSSILQTCWLSSYSVS

SEQ ID NO: 204081 - protein, 116 aa, Triticum aestivum
  unsure (1)..(116): unsure at all Xaa locations
  Clone ID: PAT_TA_98499.pep
MGRVIRAQRKGAGSVFKSHTHHRKGPARFRSLDFXERNGYLKGVVTDVIHDPGRGAPLAKXFRNXFKVQHQKXFFFXPEGXXTGISSKXGTRPTLPLEILPXAPFPXEGYFILKFG

SEQ ID NO: 204082 - protein, 150 aa, Triticum aestivum
  unsure (1)..(150): unsure at all Xaa locations
  Clone ID: PAT_TA_98500.pep
MKTFLVFALIAVVATSAIAQMETSCISGLERPWQQQPLPPQQSFSQQPPFSQQQQQPLPQQPSFSXQQQPPFSQQQPILSQQPPFSQQQQXXLPQHHIFGSNNTILPPQXQQQHLCNSNPYVQQSFCSSNPCKPRMHLQCTTLLGTWNHK

SEQ ID NO: 204083 - protein, 139 aa, Triticum aestivum
  unsure (1)..(139): unsure at all Xaa locations
  Clone ID: PAT_TA_98501.pep
MARLNSKAVAAAVVLAAVVLMMAGREASAALSCGQVDSKLAPCVAYVTGRASSISKECCSXVQGLNGLARSSPDRKIACRCLKSLATSIKSINMGXVSGVPGKCGVSVPFPISMSTNCNKSTSIYNPSYHDGPLGLNST

SEQ ID NO: 204084 - protein, 86 aa, Triticum aestivum
  unsure (1)..(86): unsure at all Xaa locations
  Clone ID: PAT_TA_98502.pep
APPFSRTTPPFXQQQQSPFSQQQQQPPFAQQQQPPFSQQPPISQQQQPPFSQQQQPQFSQQQQPPYSQQQQPPYGGCCCCENCGCC

SEQ ID NO: 204085 - protein, 141 aa, Triticum aestivum
  unsure (1)..(141): unsure at all Xaa locations
  Clone ID: PAT_TA_98503.pep
MANPRVFFDMTVGGAPAGRIVMELYKDAVPRTVENFRALCTGEKGVGKSGKPLHYKGSAFHRVIPXLHCQGGDSTRGNGTGGXSIYGENSRREFVHKHTNPGSLNGNAGPTQRPILSPLHWSTEHWPGVKGLSRTSKGSAT

SEQ ID NO: 204086 - protein, 120 aa, Triticum aestivum
  unsure (1)..(120): unsure at all Xaa locations
  Clone ID: PAT_TA_98504.pep
YQVLQQLCCQQLRQIPEQSRCQAINNVVHAIILHQQQQQQGQHQQSSQVSYQQPQQQYPSGQGXFQPSQQIPQAQGXXXPXNLPQLRGIXXLALQTYHHVXVKIPPYXXTXIAXFDIFGY

SEQ ID NO: 204087 - protein, 181 aa, Triticum aestivum
  unsure (1)..(181): unsure at all Xaa locations
  Clone ID: PAT_TA_98505.pep
GQPGYYPTSPQQSGQGQPGYYLTSPQQSGQGQQPGQLQQSAQGQKGQQPGQGQQPGQGQQGQQPGQGQQGQQPGQGQPGYYPTSPQQSXGQGQQPGQWQQPRQGQPRILPNSPLXPXGQGNQXQPXFPXKPRTRXQPGHFTTTQGNKXXTXXGTRXQXHNXTRQRQXXAQXATDKATVAGK

SEQ ID NO: 204088 - protein, 174 aa, Triticum aestivum
  unsure (1)..(174): unsure at all Xaa locations
  Clone ID: PAT_TA_98506.pep
QQPVLPPQQSPFPQQQQHQQLVQQQIPVVQPSILQQLNPCKLFLQQQCSPVAMPQRLARSQMLQQXSSCHVMQQQCCQQLPQIPQQSRYEAIRAIIYSIILQEQQQVQGSIQSQQQQPNSWAMCFPTQQQSQQQSGTTQQHNWRYFCSTPRYSTVMTPLRSFPATCACKCVVTH

SEQ ID NO: 204089 - protein, 179 aa, Triticum aestivum
  unsure (1)..(179): unsure at all Xaa locations
  Clone ID: PAT_TA_98507.pep
PQQPPCSQQQQPPLSQQQQPPFSQQQPPFLQQQQPVLPQQPPFSQQQQQFPQQQQPLLPQQPPFSQQQPPFSQQQQQPPFSQQQQQPXLPQQPPFSQHQQPXLPQQQIPSVQPSILQQLXPCKVFLQAACXPVXMPQILAXXQMLWQSIACDATTCCRQCRNPRTSRYDHPCHHLLDVY

SEQ ID NO: 204090 - protein, 123 aa, Triticum aestivum
  unsure (1)..(123): unsure at all Xaa locations
  Clone ID: PAT_TA_98508.pep
MARLNSKAVAAAVVLAAVVLMMAGREASAALSCGQVDSKLAPCVAYXRGXASSINKECCSXGVQGLNGLXRSNPDRKIAXKCLKDLATXIXSINXARSPXCPXKXGLXXPSQXEFTNCNNXTN

SEQ ID NO: 204091 - protein, 166 aa, Triticum aestivum
  unsure (1)..(166): unsure at all Xaa locations
  Clone ID: PAT_TA_98509.pep
QQQPPFSQQQPPFSQXQXPPFSQQQPPFSQQQQPVLPQQPSFSQQQLPPFSQQQSPFSQQQQIVLQQQPPFLQQQQPSLPQQPPFSQQQQQLVLPQQQIPFVHPSILQQXLNPCKGILQAXMXPVAMPQSLXXPQMLQQSIACDAQHVASIAAPNIRYEQSVIHHL

SEQ ID NO: 204092 - protein, 171 aa, Triticum aestivum
  unsure (1)..(171): unsure at all Xaa locations
  Clone ID: PAT_TA_98510.pep
QQPFPQPQQTFPQQPQLPFPQQPQQPFPQPQQPQQPFPQSQQPQQPFPQPQQQFPQPQQPQQSFPQQQQPAIQSFLQQQMNPCKNFLLQQCNHVSLVSSLVSIILPRSGLPGGCKQQCCQXQTSTNPQQSNGATIHSVAHSIIXMQQGQQQXVPILRATIXVAQGLGYPTQ

SEQ ID NO: 204093 - protein, 160 aa, Triticum aestivum
  unsure (1)..(160): unsure at all Xaa locations
  Clone ID: PAT_TA_98511.pep
QHPISQQQQQQQQQQQQEQQILQQILQQQLIPCMDVVLQQHNIAHGRSQVLQQSTYQLLQELCCQHLWQIPEQSQCQAIHNVVHAIILRQQQKQQQQPSSQXSFQTAQQQYPFCQGXFRASQQXHRPRSVLNNAQFQGIRTTLRATACEVSLILHIHWIF

SEQ ID NO: 204094 - protein, 149 aa, Triticum aestivum
  unsure (1)..(149): unsure at all Xaa locations
  Clone ID: PAT_TA_98512.pep
RNSSSLPSLLSRRPPRPPNPLLHSVLLGSRTIHHLQEQQPTPQPQEQPVPHQKLNPCRDALLQQCXPVADMSFLRHXWCNXHCLGNVGSSVCQQLKAIPKASKCXGIQNFXHPSFCNSNNIWYKYSNQPQQQQQQVNNNQVLTTTNTMV

SEQ ID NO: 204095 - protein, 72 aa, Triticum aestivum
  unsure (1)..(72): unsure at all Xaa locations
  Clone ID: PAT_TA_98513.pep
NIPLSLPCLGXKKKKXKNIGRXPXLPTXSPXAADLISXSHANMHSXNLLLXEPITDGLHPLAIQXELLXXXD

SEQ ID NO: 204096 - protein, 105 aa, Triticum aestivum
  unsure (1)..(105): unsure at all Xaa locations
  Clone ID: PAT_TA_98514.pep
MSCCGGNCGCGAGCKCGNGCGGCKMFPDVEATAGAAAMVMPTASHKGSPAXREXGETGGCDCTTXNXGTPCGCPAATXTXPXPKRPAGKGTRLGSKQDIPPNNNS

SEQ ID NO: 204097 - protein, 157 aa, Triticum aestivum
  unsure (1)..(157): unsure at all Xaa locations
  Clone ID: PAT_TA_98515.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQPQSFPPQQPYPQQQXQYLQPQQPISQQQAQQQQQXQQQQXQXQQFSQICNNNDPAMLLQQHT

SEQ ID NO: 204098 - protein, 137 aa, Triticum aestivum
  Clone ID: PAT_TA_98516.pep
VPKDPDEGDPETASAPVAASPAMASTAPQRSGTSTGLKSRTRGAASATPASVPAGRGPRGPAARRREGRGARPRPARGRAGRCGARTSGSAPQCAAAAGTAAASPRAADVRAPTPSWPWRAQAVEEVEEEDDKALVW

SEQ ID NO: 204099 - protein, 132 aa, Triticum aestivum
  unsure (1)..(132): unsure at all Xaa locations
  Clone ID: PAT_TA_98517.pep
RAPRTFLEALVRYTFPTPSPLSSRVKTPTMLGGGDALGAVSFLKALLWEQGGNLGLRREVCXGVXAASNYLQLCCAPPGGGLLLLPCILXSLLLNAQSLVSGVALLQXENSTTSRVLPNPTXXCIRCLSXKF

SEQ ID NO: 204100 - protein, 71 aa, Triticum aestivum
  Clone ID: PAT_TA_98518.pep
WHLVRTGSAVAVGGGIRTRRVTLPLVLLHATRPFICLLFVPCCEIQIASAVFDLFSRASVMLHPLKLILAL

SEQ ID NO: 204101 - protein, 95 aa, Triticum aestivum
  unsure (1)..(95): unsure at all Xaa locations
  Clone ID: PAT_TA_98519.pep
MAETXYRCFVGXLAWATDDXNLQQAFSQYGEILYAXIIXXRXTGRSRGFXFVTFXXQEXIXHAIHEMNGKXLDXRNITVNXAQSXRSXGSXRRLP

SEQ ID NO: 204102 - protein, 124 aa, Triticum aestivum
  unsure (1)..(124): unsure at all Xaa locations
  Clone ID: PAT_TA_98520.pep
MANPRVFFDMTVGGAPAGRIVMELYKDAVPRTVENSARCAPAKKGVGKSGKPLHYKGNASXALIPDXMXQGGDFTXRGNGTGGESSTGIRQNSKNPVSPMKGGKTKHFLNFPICPTCFSLDGSK

SEQ ID NO: 204103 - protein, 135 aa, Triticum aestivum
  unsure (1)..(135): unsure at all Xaa locations
  Clone ID: PAT_TA_98521.pep
MKTFLILALLAIVATTATTAVRVPVPQLQPQNPSQQQSQEQVPLVQQQXFLGQQQPFPPQQPYPQPQPFPSQQPYLQLQPFPXQXQLPYSQPQPFRPQQPYPQPQPQYSXAQXPFHXQQQXAXTQQQXDNXSXQI

SEQ ID NO: 204104 - protein, 167 aa, Triticum aestivum
  unsure (1)..(167): unsure at all Xaa locations
  Clone ID: PAT_TA_98522.pep
RTSLEFFFFFFFFFFFFFFLRRVXVSWXTLQQVNNCQQQQQQQQQQQQQQQXQVPQPQQPQXPFXQPQXPFPQQPQXPFPQTQQPQQPFPQQPQQPFPQXQQPQQPFPQQPXQPFPXTQQPXQPFPQLQQPQQPFPSPXXXMPXXQQRQQSFPNTASINTQHSPIPW

SEQ ID NO: 204105 - protein, 155 aa, Triticum aestivum
  unsure (1)..(155): unsure at all Xaa locations
  Clone ID: PAT_TA_98523.pep
PQQTFPQPQXTFPHQPQQEVXQPQQPXQXFLXPQQPFPQQPQQPFPQTQQPQQPFPQQPQXPFPQTQQPQQPFPXQPQQPFPQTQXXQXPFPQLQQPXXPFPXXQQQLPXPQQXQQSFPQQQRXFXQPSLQQXLNPCMNILLXQCKLRHWVSSSG

SEQ ID NO: 204106 - protein, 165 aa, Triticum aestivum
  unsure (1)..(165): unsure at all Xaa locations
  Clone ID: PAT_TA_98524.pep
QSQQPQQPFPQPQQPQQSFPQQQQPLIQPYLQQQMNPCKNYLLQQCNPVSLVSSLVSMILPRSGLPGGCQQQCCQQLSTXPRQLQCAAXHTSVHPXSMXQGXXPXIQFSRPXFQLVQGXGTXQPQXPTPXECSSHGYGNLTSSRGCPAWRSNHPLTPPPWAKMFA

SEQ ID NO: 204107 - protein, 79 aa, Triticum aestivum
  Clone ID: PAT_TA_98525.pep
GSPNNNIYRNNNSPGHNNPLNNNNSPNKNSPSNHHNNSPNNNFQYHTHPSNHKNLPHTNNIQNSNHLGRRYNTVAYEKS

SEQ ID NO: 204108 - protein, 125 aa, Triticum aestivum
  unsure (1)..(125): unsure at all Xaa locations
  Clone ID: PAT_TA_98526.pep
AAXGLLNKAPCXFSDQAGLAPXGRSVVGSSSPLPXCCRRLLLVSXNLDGGRRLDFGLHRRGGFLPSSRPPRRRPASPPRAPPPSARPMGSGHQRWPLPSWMQENDRSGRGWLAEASATLIRECEA

SEQ ID NO: 204109 - protein, 169 aa, Triticum aestivum
  unsure (1)..(169): unsure at all Xaa locations
  Clone ID: PAT_TA_98527.pep
MKTFLILALLAIVATTATIAVRVPVPQLQPQNPSQQQPQEQVPLVQQQQFPGQQQPFPPQQPYPQPQPFPSQQPYLQLQPFPQPQLPYPQPQLPYPQXQLPYPQXQPFRPQQPYPQSQPQYSXQPQQPFPQQQQQQQQQQQXQQQQQQQXQFFQQFWQQQRSMQDVCMA

SEQ ID NO: 204110 - protein, 72 aa, Triticum aestivum
  Clone ID: PAT_TA_98528.pep
FLTGALLPPRSLQPPRVTRTKGKCSRLAQITNSFGQEREREWIYHLIGKSLKNSHESLWDLRFGVGEVRGSL

SEQ ID NO: 204111 - protein, 128 aa, Triticum aestivum
  unsure (1)..(128): unsure at all Xaa locations
  Clone ID: PAT_TA_98529.pep
SSTMGMAMAMGARSTMKKSLLLILFVCPLTITVTDCAKDIPASVPQDPPGNKICETVNRTWPWLKFCGRHGTCNKPCRAEGFEEGYCGMFPYISTCCCTNTVSXAAPGHPCNHAQRGQTIXHFYKMLD

SEQ ID NO: 204112 - protein, 134 aa, Triticum aestivum
  unsure (1)..(134): unsure at all Xaa locations
  Clone ID: PAT_TA_98530.pep
QQPPFSQQELPILPQQPPFSQQQQPXFSQQQQPFPQQQQPLLLQQPPFSQQRPPFSQQQQQPVLPQQPPFSQQQXQQPILPQQPPFSXHQQPVLPQQXIXYVQXSILXQQXNPCXGXPPXAMAAPVAMPPKFLP

SEQ ID NO: 204113 - protein, 169 aa, Triticum aestivum
  unsure (1)..(169): unsure at all Xaa locations
  Clone ID: PAT_TA_98531.pep
MKTFLILALLAIVATTATTAVRVPVPQLQLQNPSQQQPQEQVPLVQEQQFPGQQQPFPPQQPYPQPQPFPSQQPYLQLQPFPQPQLSYPQPQPFRPQQPYPQPQPQYSQPQQPIRSKQQQXKQQQQQQQQQXLQQFLATTTDPCKDVCXQQHNITQGXPQXWQGKTYNW

SEQ ID NO: 204114 - protein, 90 aa, Triticum aestivum
  unsure (1)..(90): unsure at all Xaa locations
  Clone ID: PAT_TA_98532.pep
XCCADGXQRRASGSGRCVXLRPPSQLPPPPPEGPXELQFGAPPAALNVFGGNSHQGPRSDKFPSAFYNGFFSWVMEARELMLMDIKSDMA

SEQ ID NO: 204115 - protein, 179 aa, Triticum aestivum
  unsure (1)..(179): unsure at all Xaa locations
  Clone ID: PAT_TA_98533.pep
QPQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQCCQQLAQIPQQXQCATIHSVVDSIIKPAAEXQQQQQGMHIFLHYLKQXQXGQGXLXQGKGSSNTTTSLG

SEQ ID NO: 204116 - protein, 145 aa, Triticum aestivum
  unsure (1)..(145): unsure at all Xaa locations
  Clone ID: PAT_TA_98534.pep
PGCLRCHARGFQPCFSAAADGRLXSAAGAASSFTXSAAAGFASXTXSLVSXSTTAGXSXSGSAAAAGSGSFVSSASTAAGASSLVSSTSTGAGASTSASTGAGASSVFATSSAATGFSTAGASSVSAADGFWTSAVAIAVVDARK

SEQ ID NO: 204117 - protein, 139 aa, Triticum aestivum
  unsure (1)..(139): unsure at all Xaa locations
  Clone ID: PAT_TA_98535.pep
VIRPLPFSTDLAVATTDAAGSMEELTPAFSSFSSMVGSPSGGADAADSTTQEPVATRQTEVVRRRRTGRLWRRRKPYLGVGIGHLWRRMKPHRGAGAGSGRPSHPAEAARRLCQSMVGDPSRLYXAPWXRRTALTRFLP

SEQ ID NO: 204118 - protein, 181 aa, Triticum aestivum
  unsure (1)..(181): unsure at all Xaa locations
  Clone ID: PAT_TA_98536.pep
QQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSLVSSLXVSMILPRSDWPXVCKQQCCQQLAQIPRQSKXASIHSVVHSIVMQXQXQQQXIQFSGHXLSRQXQXIIQLNKSI

SEQ ID NO: 204119 - protein, 137 aa, Triticum aestivum
  unsure (1)..(137): unsure at all Xaa locations
  Clone ID: PAT_TA_98537.pep
HSTPPPGSGGRTAHFPFLSASSPDPVRAVAARPRICLRSPNPVGHLLPHLIDLQILTSLRRVPEQPTAALFFLVSGVHVQRLGAIVESSTLSPATRCGARRTTRRPRRSVWRRWNAVHPATTPXWCFGSLASTLXGI

SEQ ID NO: 204120 - protein, 177 aa, Triticum aestivum
  unsure (1)..(177): unsure at all Xaa locations
  Clone ID: PAT_TA_98538.pep
PGQGQQGQQVXQGQQAQQPGQGQQPGQGQPGYYPTSPQQSGQGQPGYYLTSPQQSGQGQQPXXLQQSAQGQXGQQPXXGQXPGQGQQGQQPGQXQQGQQPGQGXPXYYPXSPQQSGQXXQSQGQWQHPGXGQPGYYQLLRCNXGQGHPGYDPTXPAQPRQGHXPXTMQQPSQGXKGT

SEQ ID NO: 204121 - protein, 160 aa, Triticum aestivum
  unsure (1)..(160): unsure at all Xaa locations
  Clone ID: PAT_TA_98539.pep
MKTFLVFALIAVVATSAIAQMETSCISGLERPWQQQPLPPQQSFSQQPPFSQQQQQPLPQQPSFSQQQPPFSQQQPILSQQPPFSQQQQPVLPQQSPFSQQQQLXLPPQQQQQQLVQQQIPIVQPSVLQQLNHAKXILQQQCSLLAMPQRLXSHKMWQQT

SEQ ID NO: 204122 - protein, 178 aa, Triticum aestivum
  unsure (1)..(178): unsure at all Xaa locations
  Clone ID: PAT_TA_98540.pep
QQPFPPQQPYPQPQPFPSQQPYLQLQPFPQPQLPYSQPQPFRPQQPYPQPQPQYSQPQEPISQQQQQQQQQQQILQQILQQQLIPCMDVVLQQHNIAHGRSQVLQQSTYQXLLQELCCQXHLWQFLEQSQCQXAIQNVVHAIILHQQHXQQQQXSEQXSFQQPXXXYPLGKLPASNKT

SEQ ID NO: 204123 - protein, 175 aa, Triticum aestivum
  unsure (1)..(175): unsure at all Xaa locations
  Clone ID: PAT_TA_98541.pep
XQTQXPQQLFPQSQQPQQQFSQPQXXFPXPQQPQQSFPQQQPPFIXPSLQXQVNPCXNFLLQQCKPVSLVSSLWSMIWPQSDCXVMRXQCCQQLAQIPQXLQCXXIHXIXHSIIMQQEQXEQHXGMHILLPLYQHXXVGQGTLXQXQGIIXXQQXAQLXXXXSLVLQTLXTMCNV

SEQ ID NO: 204124 - protein, 161 aa, Triticum aestivum
  unsure (1)..(161): unsure at all Xaa locations
  Clone ID: PAT_TA_98542.pep
HKSTXXXFLVLALIVVAXTTXAAEPFXAFRSAWEPQHPSSPEHQPXPQPQEHPVPHQKLXPCRDALLQQCSPVADMSFLRSQVVQHSSCXVMWEQCCQQLKXXPXQSRCEAIHNVVHAIILXQQQQLVQAXSPNLNKQQQQVNNNNVWVLNHNMHNWLVDS

SEQ ID NO: 204125 - protein, 115 aa, Triticum aestivum
  unsure (1)..(115): unsure at all Xaa locations
  Clone ID: PAT_TA_98543.pep
TVVPSMLGRRSWTNAGTFGKFWCTWQXDRGDRLPLGAPALMVSPQGERDGAVRPDLVRKRDXKYSFSTEELKAARADVEVPAEPRPGQADYWVRHHKGFAVDVVPHEMKRHAPFP

SEQ ID NO: 204126 - protein, 85 aa, Triticum aestivum
  Clone ID: PAT_TA_98544.pep
QNCKKFVLPALGVLGSGGALFLLLNPRVIQLTQSQVELHVFFRGKPCVQQPCPCRFNRMNFIGIGNETRGWCYLLFASHLIEERE

SEQ ID NO: 204127 - protein, 164 aa, Triticum aestivum
  unsure (1)..(164): unsure at all Xaa locations
  Clone ID: PAT_TA_98545.pep
XSVRRTGDXIVTNVARSGEYAVNAXTSASAMIHGIAAIRVPEGIPAEDECGPDRSCSPAGLRLHRRPGAWCSCFTARPAGQLRRERTCPNWPAAPQPEAGAVNQIFRPDTPMVAASGSQALGVVAVLLAAANIMLTGLVMLFVVPMYFRKYQYAYTHVPKQLTP

SEQ ID NO: 204128 - protein, 169 aa, Triticum aestivum
  unsure (1)..(169): unsure at all Xaa locations
  Clone ID: PAT_TA_98546.pep
SPRAPCPTLMLVFHARTGEELPILVSKASSSPLLEPPPAAVAGDHPQDPIVPITFLLLARFLLPASHLSPVSLDRRRATMSAAKFLPGATPPGSGCLRVVRAPASPLTRLPSLPESQQPRLLPCFTSSSLLELPGLLQRPMASAAPGLCCSXXQXQQFVVAFSSLPCAR

SEQ ID NO: 204129 - protein, 124 aa, Triticum aestivum
  unsure (1)..(124): unsure at all Xaa locations
  Clone ID: PAT_TA_98547.pep
PPPPPPLSPRRDGRAPEALIRARPPDGRHGHRSRLLPPPRARSNSQRQSSSLRAAPPPAAQPPLGXPPPSNASASSRASYQRARPVPRPTRLRRRCGPAEEGAAVMSTQRDVRCCAGAVHRRSG

SEQ ID NO: 204130 - protein, 174 aa, Triticum aestivum
  unsure (1)..(174): unsure at all Xaa locations
  Clone ID: PAT_TA_98548.pep
LNPCKVFLQQQCSPVAMPQSLARSQMLQQSSCHVMQQQCCQQLPQXPQQSRYEAIRAIIYSIVLQEQQQVRGSIQTQQQQPQQLXGQCVSQPQQQSQQQLXGQQPQQQQLGQGTFLQPHQDTQLEVMTPLPPXPAXDCRVKLPLYXTTTXVPFGVGTGFGPTDKEGVIKLVVLG

SEQ ID NO: 204131 - protein, 139 aa, Triticum aestivum
  unsure (1)..(139): unsure at all Xaa locations
  Clone ID: PAT_TA_98549.pep
MKTFLILALLAIVATTATIAVRVPVPQLQPQNPSQQQPQEQVPLVQQQQFPGQQQPFPPQQPYPQPQPFPSQQPYLQLQXFPXPQLXYXQPQXPYPQXQPFRXPQQPYPQSQPQXXXPQQXSQQQQQQQQQQQXRXQHN

SEQ ID NO: 204132 - protein, 155 aa, Triticum aestivum
  Clone ID: PAT_TA_98550.pep
MKTFLILALLAIVATTATIAVRVPVPQLQPQNPSQQQPQEQVPLVQQQQFPGQQQPFPPQQPYPQPQPFPSQQPYLQLQPFPQPQLPYPQPHLPYPQPQPCRPQQQFPQPQQPQQPFPQAPTTPTTFPNNHSIPQLNPNIPSHSNQTFSQPHIRM

SEQ ID NO: 204133 - protein, 159 aa, Triticum aestivum
  unsure (1)..(159): unsure at all Xaa locations
  Clone ID: PAT_TA_98551.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQXPQSFPPQQPYPQQQPQYLQPXQPISQQQAQQQQQXQQQQQQQQQILQQIWHNNSMGCCLQQTT

SEQ ID NO: 204134 - protein, 70 aa, Triticum aestivum
  unsure (1)..(70): unsure at all Xaa locations
  Clone ID: PAT_TA_98552.pep
SPSYNRRKEXQEXGLWXCLKLKIAIWTAFVEFPCTTSREHNLIEERRSICMQVAFLRACSLFPSYLPRML

SEQ ID NO: 204135 - protein, 127 aa, Triticum aestivum
  unsure (1)..(127): unsure at all Xaa locations
  Clone ID: PAT_TA_98553.pep
MARLNSKAVVAAVVLAAVVLMMAGREASAALSCGQVDSKLAPCVAYVTGRASSXSKECCSGVQGLNGXRSNSDRKIACKCLKXLATSIKSINMGKAXGVPGKXRXKCAFPIXXSNKLQTFNNSITFP

SEQ ID NO: 204136 - protein, 80 aa, Triticum aestivum
  unsure (1)..(80): unsure at all Xaa locations
  Clone ID: PAT_TA_98554.pep
MSCCGGNCGCGSGCKCGNGCGGCKMYPEMDEGVTTTSQTLIMGVAPSKGTXPFEAAAETGADNGGCKCGPXCTCNPCTCK

SEQ ID NO: 204137 - protein, 178 aa, Triticum aestivum
  Clone ID: PAT_TA_98555.pep
QPFPQQPQQQFPQPQQPQQPFPQPQQPQLPFPQQPQQPFPQPQQPQQPFPQLQQPQQPLPQPQQPQQPFPQQQQPLIQPYLQQQMNPCKNYLLQQCNPVSLVSSLISMILPRSDCQVMQQQCCQQLAQIPQAVQCAASIVSVHSIIMQQEQRQGVQFGGTFSSFKVKASSNSTTVNGG

SEQ ID NO: 204138 - protein, 165 aa, Triticum aestivum
  unsure (1)..(165): unsure at all Xaa locations
  Clone ID: PAT_TA_98556.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCXGIHNVVHAIILQQQQHWYKXFNQPQQQQQQGQQQQXGLGSNQPQQQTQLVKVGCRDEWV

SEQ ID NO: 204139 - protein, 171 aa, Triticum aestivum
  unsure (1)..(171): unsure at all Xaa locations
  Clone ID: PAT_TA_98557.pep
MKTFLVFALIAVVATSAIAQMETSCISGLERPWQQQPLPPQQSFSQQPPFSQQQQQPLPQQPSFSQQQPPFSQQQPILSQQPPFSQHHQPVLRQHSPFSQHQQLVLPPXQQQQQLVQQQXPIVQPSVLQQLXPMQXILXQQCTLXQAKRLARXQIWXRHCHVSNKXCQNCT

SEQ ID NO: 204140 - protein, 69 aa, Triticum aestivum
  unsure (1)..(69): unsure at all Xaa locations
  Clone ID: PAT_TA_98558.pep
MXGVEYRCXVGGLAWATEXQSLYNXFSKYXDVIDXKIITDRXTGRXXGFGXVTFASXEAMRQXXXVMNG

SEQ ID NO: 204141 - protein, 83 aa, Triticum aestivum
  Clone ID: PAT_TA_98559.pep
LPPSLFLCPLSEKLDPSPEKLNPSPEKLDLSSGQLNPSSARMNPRRGGRILAGETDFSPQKADSSPERLISRRRTSPAAFLSA

SEQ ID NO: 204142 - protein, 165 aa, Triticum aestivum
  unsure (1)..(165): unsure at all Xaa locations
  Clone ID: PAT_TA_98560.pep
XNFLRGVGPKXLSCHRXAVLXXVLQQQRDAGRLGQQARLFLXFXAAAGFASANGSLVSCLDHGGASASGFGRSCWLGVLRLLCLXCCRRLLPWSPQPRRGQAPRLRPPPARGLPPSSRPPRRRPASPPRAPPPSARPMGSGHQRWPLPSWMQENDRSGRGWLAEA

SEQ ID NO: 204143 - protein, 164 aa, Triticum aestivum
  unsure (1)..(164): unsure at all Xaa locations
  Clone ID: PAT_TA_98561.pep
SAQPQETTPTNRTKLERIIWRPSLASPTSSWPPSWSPSSPQPFRPQQPYPQPQPQYSQPQQPISQQQQQQQQQQQQQQQILQQILQQQLIPCRDVVLQQHNIAHGSSQXCKKVLTKLVQQLCCQQLWQXPEQXRCQAIPHVVHAIXLHQQHNHNNXNXQQQQQR

SEQ ID NO: 204144 - protein, 126 aa, Triticum aestivum
  unsure (1)..(126): unsure at all Xaa locations
  Clone ID: PAT_TA_98562.pep
GHRIWCILRLIQWSSVARIFWRVEVTVIMVAQLWYNYGILSLQELTYLSLQAIPYITPLKQPAGNTIITGSGDGTIGLFDIRACSAIXIVXGGPVLRYICSFNNWWXLFSAXTHKYTLVWDTRLXH

SEQ ID NO: 204145 - protein, 172 aa, Triticum aestivum
  unsure (1)..(172): unsure at all Xaa locations
  Clone ID: PAT_TA_98563.pep
PTSRQQSGQGQQPGQGQQSGQGQQGQQPGQGQQAYYPTSSQQSRQRQQAGQWQRPGQGQPGYYPTSPQQPGQEQQSGQAQQSGQWQLXVYYPTSPQQPGXLQQPAQGQQPAQGQQSXAQEQQPXQAQHQGQWXLXYYQLLPQHSXQGQXGTTKFFRNXPGQGXQPDKATAKT

SEQ ID NO: 204146 - protein, 138 aa, Triticum aestivum
  unsure (1)..(138): unsure at all Xaa locations
  Clone ID: PAT_TA_98564.pep
QQQQQQQQILQQILQQQQLIPCRDVIVLQQHNIAHESSQVLQQSSYQVLQQLCCQQLRQIPEQSXRCQAINNVXVHAIILHQXQQQQQGQHQQSSQVSYQAASSNISIKPXSFQPSQQIHRPFVHLNICPTPRGAYQF

SEQ ID NO: 204147 - protein, 155 aa, Triticum aestivum
  unsure (1)..(155): unsure at all Xaa locations
  Clone ID: PAT_TA_98565.pep
MKTFLILALLAIVATTATTAVRVPVPQLQPQNPSQQQSQEQVPLXVQQQQFLGQQQPFPPQQPYPQPQPFPSQQPYLQLQXFPQPQLPYSQXQHFRPQQPYPQPQPQYSQPQHPXSQQQQQQQQQQQQGQQILQQFWQQQXFHAXVVLQQHNIRE

SEQ ID NO: 204148 - protein, 144 aa, Triticum aestivum
  unsure (1)..(144): unsure at all Xaa locations
  Clone ID: PAT_TA_98566.pep
PARRRGAVAVALVALMAAVGLAGADFASDSKMCAEKLAVLATCLPVVDATATAHAPTPDCCSGLREXWVTAKLLLLLIKDRDTRHRIKSTLPRMDSLRCSSRLLLRPNFNLRRFQEIQHYSRPTPEPRGNIRFRRKRVSSLLSA

SEQ ID NO: 204149 - protein, 167 aa, Triticum aestivum
  unsure (1)..(167): unsure at all Xaa locations
  Clone ID: PAT_TA_98567.pep
SSPPTISPGNLRSERSEGSLVLLLKMQIFVKTLTGKTITLEVESSDTIDNVKAKIQDKEGIPPDQQRLIFAXGKQSEDGRTLXADYNIQKXPLSTWVLKLRXWVCSSFVKDPPPGKTITLEXXPPDTIGHVEGKFQGQGXIPPGQHAXXFAXKHSXDXDLSDYKSKK

SEQ ID NO: 204150 - protein, 155 aa, Triticum aestivum
  unsure (1)..(155): unsure at all Xaa locations
  Clone ID: PAT_TA_98568.pep
LLDNSLLDIMLYLCERRLLRWHGIPLLEDXTDMSTIKGCKXFGYIESKQDVLGSKVFGRGKLVMLEDCNPTTSKLSKSNDVVFCGRIIMFLAHFFPLSERSALNIKGVFNTSNETKYEKDATDGISVDFNFYQTLWSLQEHFRNPALTTTNPTKW

SEQ ID NO: 204151 - protein, 118 aa, Triticum aestivum
  unsure (1)..(118): unsure at all Xaa locations
  Clone ID: PAT_TA_98569.pep
QQPILPQQPSFSQQQQQLVLPQQQIPFVHPSILQQLNPCKVFLQQQCSPVAMPQSLARSQMLQQSSCHVMQQQCCXQLPQIPQQSRYEAIRAIIYSIVLQEQQXVRGSIQTQQQQSSG

SEQ ID NO: 204152 - protein, 130 aa, Triticum aestivum
  unsure (1)..(130): unsure at all Xaa locations
  Clone ID: PAT_TA_98570.pep
MAPKAAEKKPVEKTPAGKKPKAEKKVPASKEGGDKKGXKKKAKKSVETYKIYIFKVLKQVHPDIGISSKAMSIMNPSSTTSSEKLAGESAKLAKVQQEANITPGRSRLRPLSPGXSPXXVSEGTRRHNLV

SEQ ID NO: 204153 - protein, 162 aa, Triticum aestivum
  unsure (1)..(162): unsure at all Xaa locations
  Clone ID: PAT_TA_98571.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPXLPPQQSPFPQQQQHQQLVQQQXPVVQPSILQAVNHASILQAACXPVAMPQC

SEQ ID NO: 204154 - protein, 127 aa, Triticum aestivum
  unsure (1)..(127): unsure at all Xaa locations
  Clone ID: PAT_TA_98572.pep
QNVVHAIILHQQQQRQQQQQQQQQQQQQQQQQQQQQQQQQQQQQQQQQQPSSQVSFQQPQQQYPSGQGSFQPSQQNPQAQSSVQHQQLPQFEEIRNLXLQTLPAVCNVYIPPYCSTTIAPFGIFXTN

SEQ ID NO: 204155 - protein, 174 aa, Triticum aestivum
  unsure (1)..(174): unsure at all Xaa locations
  Clone ID: PAT_TA_98573.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQXSFPPQQPYPQQQPQYLQPQQPIRKQQAQQQQQQQQQQQQQQQFFNNFATTTDPCRELSATTQHXAATHNLQQIIQAMQ

SEQ ID NO: 204156 - protein, 166 aa, Triticum aestivum
  unsure (1)..(166): unsure at all Xaa locations
  Clone ID: PAT_TA_98574.pep
PQQPGQGKQLGQGQQGYYPTSPQQPGQGQQPGQGQQGHCPTSPQQTGQAQQPGQGQQIGQVQQPGQGQQGYYPISLQQSGQGQQSGQGQQSEQGHQLGQGQQSGQEQQGYDNPYHVNTXEQQTANPKVAKVQQPATQLPXXCWXGGAXPLSVTIELNLGLGIITLP

SEQ ID NO: 204157 - protein, 163 aa, Triticum aestivum
  unsure (1)..(163): unsure at all Xaa locations
  Clone ID: PAT_TA_98575.pep
MQIFVKTLTGKTITLEVESSDTIDNVKAKIQDKEGIPPDQQRLIFAGKQLEDGRTLADYNIQKESTLHLVLRLRGGYAXFSVKTLTGKTITLGVXXSGTPSDNVKAKFQDKEGFPRTTTLTSXATLXDGXPCGYNIQEXPPQLVSGSGDQSCQDLTGKTLPGG

SEQ ID NO: 204158 - protein, 138 aa, Triticum aestivum
  unsure (1)..(138): unsure at all Xaa locations
  Clone ID: PAT_TA_98576.pep
MARLNSKAVVSAVVLAAVVLMMAGREATALSCGQVDSKLAPCVSYVTGKAPSISKECCSGVQGLNGLARSSPDRKIACRCLKSLATXIKSINMDKVSGVPGKCGVSVPFPISMSXNCNNVNVQYITFRRACKDRLCGA

SEQ ID NO: 204159 - protein, 103 aa, Triticum aestivum
  unsure (1)..(103): unsure at all Xaa locations
  Clone ID: PAT_TA_98577.pep
IDRRXASKXLYKLFKPTMHACRALSLRPDVRQVAVAALADAHLKLVIIGVLLGSVGAVGGHCAPHGHREQGVLVPREREATADLLDAESGAGEHAGKLSGLIG

SEQ ID NO: 204160 - protein, 145 aa, Triticum aestivum
  unsure (1)..(145): unsure at all Xaa locations
  Clone ID: PAT_TA_98578.pep
MTMAMPLFLMFLLLHIAWVASSDLRPGFYSKTCPKAELIVRDVMKKALMREPRSVASVMRFQFHDCFVNGCDGSMLLDDTPTMLGEKWPLKYKSLRSYEXVHQVKEALREXCPGVGSCADIIIXASRDAVSLTSGLNGSELGRWT

SEQ ID NO: 204161 - protein, 149 aa, Triticum aestivum
  unsure (1)..(149): unsure at all Xaa locations
  Clone ID: PAT_TA_98579.pep
RVRVFGIPLYAHLFPPTVPSLPTPNTLPSLPQLLPFSPGARRLALAVHAHAVRLGLTEFLLVNNSLIRVHAGLLGRLSDVHLLLHSSGTGDHAHHLAREGGASRRCSITVRRNACKECCAPCEREGKRWVFSNAGKGHXDKXLGWEQFK

SEQ ID NO: 204162 - protein, 158 aa, Triticum aestivum
  unsure (1)..(158): unsure at all Xaa locations
  Clone ID: PAT_TA_98580.pep
MKKFLVLALIVVAATTTAAEPFTAFRSAWEPQHPSSPEHQPTPQPQEHPVPHQKLNPCRDALLQQCSPVADMSFLRSQVVQHSSCXVMWEQCCQQLKAIPKQSRCEAIHNVVHAIICNNNNIGTSTSTNLKQQQQQVNNNNRSGSNQHNNKHNGRLVA

SEQ ID NO: 204163 - protein, 136 aa, Triticum aestivum
  unsure (1)..(136): unsure at all Xaa locations
  Clone ID: PAT_TA_98581.pep
MARTKQTARKSTXGKAPRXQLATKAARKSAPATGGVKKPHRFRPGTVALREIRKYQKSTELLIRKLPFQRLVREIAXDFXTDLRFKSSAVSALQXAAXAYXLGLFEDXNLWAIQAKRVNIMPKGHQXXPPIRGXKA

SEQ ID NO: 204164 - protein, 154 aa, Triticum aestivum
  unsure (1)..(154): unsure at all Xaa locations
  Clone ID: PAT_TA_98582.pep
YFXVRFLQVPRPTRPSRSXARIGSTGQAIRIGSXSQALLKPSIKPSPRVGLYRTACARCSRIRLEKTRRRHGDFDNWPGDCRSRTRTGDFRTRHGDYSSWPGDCNDTRSGGRLQFHATQPTHPSHGGYINRRRSHSSIMGLGHPQVSSQQRAAG

SEQ ID NO: 204165 - protein, 105 aa, Triticum aestivum
  unsure (1)..(105): unsure at all Xaa locations
  Clone ID: PAT_TA_98583.pep
FXXANKSCXPDVVSFXGCPWNTVILXAECLIPXPPDNELSMACAEILTLSRCLDLILSCCHYQALQNTSSNLFPFSLDLXVHSPFYPSSSNLTKWLQLVSGSDPE

SEQ ID NO: 204166 - protein, 182 aa, Triticum aestivum
  unsure (1)..(182): unsure at all Xaa locations
  Clone ID: PAT_TA_98584.pep
FFRENFICILFQNLTTSLRVTHDVCVTLYLSPLHRHIHQPQQQFPQPQQPQQQFPQPQQPQQPFPQPQQAQLPFPQQPQQPFPQPQQPQQPFPQSQQPQQPFPQPQQPQQSFPQXQQQPLXIQAYLQQQMXPCKELLLQQCXPVSLVSSLVSMICXTNDWQVEQQQCCXQLAQSSPVQCAAS

SEQ ID NO: 204167 - protein, 166 aa, Triticum aestivum
  unsure (1)..(166): unsure at all Xaa locations
  Clone ID: PAT_TA_98585.pep
MKTFLVFALLAVAATSAIAQMETRCIPGLERPWQQQPLPPQQTFPQQPLFSQQXQLFPQQPSFSQXQPPFWXXXPPFSQQXPILPQQPPFSQATTTSSTAXTTFSQQXQPVLPPQQSTFPQTTTPAGGNNKPLVHPFCSRLNQASIPPAECLNAQVWQVQICRKQL

SEQ ID NO: 204168 - protein, 156 aa, Triticum aestivum
  unsure (1)..(156): unsure at all Xaa locations
  Clone ID: PAT_TA_98586.pep
MKKFLVLALIVVAATTTAAEPFTAFRTAWEPHHPSSPEQQPTPQPQEQPVPHQKLNPCRDALLQQCXPFADMXFLRSQVVQHSSCXVMWEQCCQQXKAIPKQSRCXXIHNXLHAILLQQQQQLGTXXFNQPQAATTPTTTGSNAQQQTQRVKVGLP

SEQ ID NO: 204169 - protein, 183 aa, Triticum aestivum
  unsure (1)..(183): unsure at all Xaa locations
  Clone ID: PAT_TA_98587.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHXLVHAIILQQQQQLVQATSTQPQAAATTSQQQQQGLGPNQPQQQTQLGGWIAVITWGDQDIPALRRACSTYATH

SEQ ID NO: 204170 - protein, 108 aa, Triticum aestivum
  unsure (1)..(108): unsure at all Xaa locations
  Clone ID: PAT_TA_98588.pep
RRRPPPLARHGRRQARPGPRPPRRXRAXXRHRXEXXRFPQXGTTPXARSSXSXNNAAKRGLQILXXAQKKNXAIVGDLQXHXXDXKFXXGCESXFXLXCXTTXNRSXL

SEQ ID NO: 204171 - protein, 136 aa, Triticum aestivum
  unsure (1)..(136): unsure at all Xaa locations
  Clone ID: PAT_TA_98589.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAESYLVGLFEDTNLCAIHAKRVTSCPRTXQLARRIRGEXA

SEQ ID NO: 204172 - protein, 119 aa, Triticum aestivum
  Clone ID: PAT_TA_98590.pep
KKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 204173 - protein, 168 aa, Triticum aestivum
  unsure (1)..(168): unsure at all Xaa locations
  Clone ID: PAT_TA_98591.pep
MKTFLILALLAIVATTATTAVRVPVPQLQPQNPSQQQSQEQVPLVQQQQFLGQQQPFPPQQPYPQPQPFPSQQPYLQLQPFPQPQLPYSXQPQPFRPQQPYPQPQPQYSXQPQHPIHSKQQQQQQQQQQEQQXQQIWQQQXSKHGVVLXQHNIAHXKSQXCNKXXKRL

SEQ ID NO: 204174 - protein, 168 aa, Triticum aestivum
  unsure (1)..(168): unsure at all Xaa locations
  Clone ID: PAT_TA_98592.pep
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGEXAKPSPRQPVSGFGSGCLLPVVFVIAVLLFGVKK

SEQ ID NO: 204175 - protein, 71 aa, Triticum aestivum
  unsure (1)..(71): unsure at all Xaa locations
  Clone ID: PAT_TA_98593.pep
MPXXSTAAPXXRTXXAPGTADCXPSPXGPPPPPFPRARRGDQEEHGEERGEGHGHSHGDLTSMDNRWIGVC

SEQ ID NO: 204176 - protein, 169 aa, Triticum aestivum
  unsure (1)..(169): unsure at all Xaa locations
  Clone ID: PAT_TA_98594.pep
MKTFLILALLAIVATTATTAVRVPVPQLQPQNPSQQQSQEQVPLVQQQQFLGQQQPFPPQQPYPQPQPFPSQQPYLQLQPFPQPQLPYSQPQPFRPQQPYPQPQPQYSQPQHQFHKQASKQQQQQQQQXQQIPQQXFATTTGFQCMGVGXEQHNIXAWXXYKXWQQSTY

SEQ ID NO: 204177 - protein, 161 aa, Triticum aestivum
  unsure (1)..(161): unsure at all Xaa locations
  Clone ID: PAT_TA_98595.pep
MVYIKNQKTRAYSKRFQVKFKRRRQGKTDYRARLRLTNQDKNKYNTPKYRFVVRFTNKDVTAQIVYATIAGDIVMAAAYSHELPRYGLEVGLTNYAAAYCTGLLLARRVLKNRDLDEEYEGNVXGTXEXDFSVEPSEXXXPFPCAPGMFGLIRTTNWETLV

SEQ ID NO: 204178 - protein, 140 aa, Triticum aestivum
  unsure (1)..(140): unsure at all Xaa locations
  Clone ID: PAT_TA_98596.pep
MPAGHGLRSRTRDLFARPFRKKGYIPLTTYLRTYKVGEHVDVKVNGAVHKGMPHKFYHGRTGRVCNVTKRAIGVEINKQVGNRIIKKRIHVRVEHVQPSRCNEEFLQRKLNNDKLKAXAKARGXVIKQQRXNQQGAKXGG

SEQ ID NO: 204179 - protein, 85 aa, Triticum aestivum
  unsure (1)..(85): unsure at all Xaa locations
  Clone ID: PAT_TA_98597.pep
XLCSRSLSQATEGWRRRRTLSFKLRVPGWSAMEGDIRHQRRRAAGRGERVNFRDATLLVVANESVCVSIRVHPRLWVDCICSSSG

SEQ ID NO: 204180 - protein, 116 aa, Triticum aestivum
  unsure (1)..(116): unsure at all Xaa locations
  Clone ID: PAT_TA_98598.pep
MYRCGGEQTLLVALRGPRQVRGAGVGGAAGGXRRGGAGGGAXVVELPRGVSGKGLATAVAYYQARAEAEARGADGGEFDGEFVRGLTHDAAIDLIYAAHHLGDEALFNLFAGYRAN

SEQ ID NO: 204181 - protein, 122 aa, Triticum aestivum; identical to SEQ ID NO: 132374
  Clone ID: PAT_TA_98599.pep

SEQ ID NO: 204182 - protein, 181 aa, Triticum aestivum
  unsure (1)..(181): unsure at all Xaa locations
  Clone ID: PAT_TA_98600.pep
PQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSLVSSLVSMILPRSDCQVMQQQCCQQLAQIPXRQAPVWQAIHSVVHSIVMAAXNNNKXYKILRAMVQVVQGQGIIQPQQXTQL

SEQ ID NO: 204183 - protein, 63 aa, Triticum aestivum
  Clone ID: PAT_TA_98601.pep
RNSGETGLVQNVNVRNLGGTDMINSVGDVLGLGQNLISVRPISTIDQTESWSDKLDGTDCTFR

SEQ ID NO: 204184 - protein, 179 aa, Triticum aestivum
  unsure (1)..(179): unsure at all Xaa locations
  Clone ID: PAT_TA_98602.pep
PPFSQQPQQPFPQPQQPQQPFPQLQQPQQPLPQPQQPQQPFPQQQQPLIQPYLQQQMNPCKNYLLQQCNPVSLVSSLVSMILPRSDCKVMRQQCCQQLAQIPQQLQCAAIHGVVHSIIMQQEQQQQQQQQQGIQIMRPLFQLVQGQGIIQPQQPXAQLEVIRSLVMGTPPTMCNVLVQL

SEQ ID NO: 204185 - protein, 146 aa, Triticum aestivum
  unsure (1)..(146): unsure at all Xaa locations
  Clone ID: PAT_TA_98603.pep
MMRWWWAGAFGAFKKRRASSRARAAAEAPQNNVALVVGSTGIVGAALLDILPLRDTPGGPWKVYALSRRPLPPWSAPLPPDVFHHHLDLADAAAVADTLAPLTDVTHLFYVAWDPRXRTGKGRKANGAMLXNVLSXLVPNCPGSSL

SEQ ID NO: 204186 - protein, 120 aa, Triticum aestivum
  unsure (1)..(120): unsure at all Xaa locations
  Clone ID: PAT_TA_98604.pep
LSYSIFDQWMPTSLFFLLFVVLGGLVPRFIPDRGASPRLPGERLGLVREVEATRPRTGRRPVPPCHFAKAWTTAGSVFLAGEPIVKIAPLESDGAGQGLPFGKLPGSSRQGXWXXPPGTC

SEQ ID NO: 204187 - protein, 177 aa, Triticum aestivum
  unsure (1)..(177): unsure at all Xaa locations
  Clone ID: PAT_TA_98605.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFXPQQQQHQQLVQQQIPVVQXPSILQXQLNPCKLFLQAAVQPCGNGNKVLXRXQMVXQK

SEQ ID NO: 204188 - protein, 160 aa, Triticum aestivum
  unsure (1)..(160): unsure at all Xaa locations
  Clone ID: PAT_TA_98606.pep
MKKFLVLALIVIAATTTAAEPFTAFRIASEPQHPSSPEQQPTLQPQEHPVPHQKLNPCRDALLHQCSPVADMSFLRSQVVQHSSCLVMWEQCCQQLKAIPKQSRCEAIHNVVHAIILQQQKQLVQGTSTQPQQQQQQGQQRXMVXXLAKPQQQQQQQQLG

SEQ ID NO: 204189 - protein, 72 aa, Triticum aestivum
  unsure (1)..(72): unsure at all Xaa locations
  Clone ID: PAT_TA_98607.pep
MCPXSGTLAGSGRNSSEACALSXSLDSXSEATPNPTPAYYCXYAGERAEAXDRGDREXIKRRARXGRXGRSX

SEQ ID NO: 204190 - protein, 173 aa, Triticum aestivum
  unsure (1)..(173): unsure at all Xaa locations
  Clone ID: PAT_TA_98608.pep
FPPQQPYPQPQPFPSQQPYPQPQSFPQPQPFPPQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWXQSDCQVMRXQCCQQLAQDSSKSSQWRKPSISVLFNQPETSKPTTNK

SEQ ID NO: 204191 - protein, 176 aa, Triticum aestivum
  unsure (1)..(176): unsure at all Xaa locations
  Clone ID: PAT_TA_98609.pep
QPQQTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSLVSSLVSMILPRSDCQVMQQQCCXQLAQDXPAKLQCATIIAVVHSXVMQPGQQQGI

SEQ ID NO: 204192 - protein, 137 aa, Triticum aestivum
  Clone ID: PAT_TA_98610.pep
MHRFPETLEVVGDACPLLKRFRLSQRSFYSECVDDSAAMAIAKMPELRSLQLTANSLTNSGLELILNGCPLLESLDIRSCYHVCMDDEMQAKCARIKTLRHPEDSMDDYDMSFNYKIPRPCWSTEPIEYSMGCQSPY

SEQ ID NO: 204193 - protein, 122 aa, Triticum aestivum
  unsure (1)..(122): unsure at all Xaa locations
  Clone ID: PAT_TA_98611.pep
MARLNSKAVAAAVVLAAVVLMMAGREASAALSCGQVDSKLAPCVAYVTGRASSISKXCCSGVQGLNGLARSSPDRKIACRCLKSLATSIKSINMGKVSGVPGKCGVSVPFPISMSTNCNNVN

SEQ ID NO: 204194 - protein, 139 aa, Triticum aestivum
  unsure (1)..(139): unsure at all Xaa locations
  Clone ID: PAT_TA_98612.pep
MYQKMRRCGDGCDGAVDAMLQCQKVSDFLIAAXYLSIPLELLYFASCADLAPVKWLLLQLXXFAVLGGAVHLLAVLTHHHPHSSGLLLASTAAKLLAALVSLATALSLLTFIPRLIRAKLREALLRAKARQLHRDVGLI

SEQ ID NO: 204195 - protein, 129 aa, Triticum aestivum
  unsure (1)..(129): unsure at all Xaa locations
  Clone ID: PAT_TA_98613.pep
SVLHQSCLPIQWPSWMASGIGSQKRISVIMHGNIVSLLQHQSTGVISXRPGSALVHPCDDSSNMMVNNSAXSQDAXLGWAXSXSTTIITKLCRVWEESEIISXGLTGGQRLKCXERKXGAGSYPXNSTL

SEQ ID NO: 204196 - protein, 95 aa, Triticum aestivum
  Clone ID: PAT_TA_98614.pep
HNSTTQQELIICMHFLSKSMTCSYQCTCSLYSLNRMQLNVLDYQQRAPPRFHPPTIGSRSRHPSPRCLFRFSFFSSQIPYSIYIIINSVIERIKE

SEQ ID NO: 204197 - protein, 174 aa, Triticum aestivum
  unsure (1)..(174): unsure at all Xaa locations
  Clone ID: PAT_TA_98615.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQPQSFPPQQPYPQQQPQYLQPQQPISQQQAQQQQQQQQQQQQQQQXXQQXLQQQLXXCXDVXLQQHNRRKCTFCTKQLIV

SEQ ID NO: 204198 - protein, 125 aa, Triticum aestivum
  unsure (1)..(125): unsure at all Xaa locations
  Clone ID: PAT_TA_98616.pep
MARLNSKAVAAAVVLAAVVLMMAGREASAALSCGQVDSKLAPCVAYVTGRASSISKECCSGVQGLNGLARSSPDRKIACRCLKSLATSIKXINMGKVSGXLPGSCGVSLPFPISXSTNLNNFNVQ

SEQ ID NO: 204199 - protein, 87 aa, Triticum aestivum
  unsure (1)..(87): unsure at all Xaa locations
  Clone ID: PAT_TA_98617.pep
MIIXKXNXXXIXKYXFHXEGVLYXXKXYNLAKHPQVDTSNLEVIKLMXSFKXXEXVRETFSWXXXYWYLXNVGIXFLRTFLNLHGLR

SEQ ID NO: 204200 - protein, 150 aa, Triticum aestivum
  unsure (1)..(150): unsure at all Xaa locations
  Clone ID: PAT_TA_98618.pep
MSIVRRSNVFDPFADLWADPFDTFRSIVPAISGGNNETAAFANARMDWKETPEAHVFKADLPGVKKEEVKVEVEDGNVLVVSGERTKXKXDKNDKWXRVERNNXXFVRXFRXPEEPQGGXKXKAGLRKGXSTSTXPKAQVKNPXXKAXDF

SEQ ID NO: 204201 - protein, 161 aa, Triticum aestivum
  unsure (1)..(161): unsure at all Xaa locations
  Clone ID: PAT_TA_98619.pep
QQQQQQKQILQQILQQQLIPCMDVVLQQHNIAHGRSQVLQQSTYQLLQELCCQHLWQIPEQSQCQAIQNVVHAIILHQQQKQQQQPSSQVSFQQPLQQYPLGQGSFRPSQQNPQDQGSVQPQQLPQFEEIRNLALQMLPAMCNVYIPPYCTIAPFGXFGTN

SEQ ID NO: 204202 - protein, 67 aa, Triticum aestivum
  Clone ID: PAT_TA_98620.pep
ETEATEVLPPNPPTPLTRTSPPPPPPSPPSLHQTLVAAAAQRSAAPQSPPDGDRRRPRRRAVGEGRD

SEQ ID NO: 204203 - protein, 151 aa, Triticum aestivum
  unsure (1)..(151): unsure at all Xaa locations
  Clone ID: PAT_TA_98621.pep
MAVGKNKRISKGXGKGXKKKAVDPFTXKQWYDIKAPLLFTSRNVGKTLVSRTQGTKIASXGLKHRVFEVSLADLXNXEDQAYRKXXLRAXDXQGMNVLTNFWGMXXTDXLKSLVXKWXTSLSSXDLXTDNYMLRMSHWLTDPKQFYPSSKI

SEQ ID NO: 204204 - protein, 118 aa, Triticum aestivum
  unsure (1)..(118): unsure at all Xaa locations
  Clone ID: PAT_TA_98622.pep
IKIIKXGRXXERLPGKRGXLXRPPTKLDLKEHGKLPFDPERGXRRAEXAQGAPNLVTARKLTFPFGXXSPAPATVRGAPRFILFSCSSATSIAMSAIGNPKKTQLSLKQLLWSVESGC

SEQ ID NO: 204205 - protein, 113 aa, Triticum aestivum
  Clone ID: PAT_TA_98623.pep
RIGTGPPGCACTRERGRVSAGQLRCPGGGARRCKTRFAFYQQQARRYQSREVRAKTYNVGELVLRLPEKKKDKLKPKWEGPFIIDEVLTGGAYHLRDASDNRLEPNPWNAARL

SEQ ID NO: 204206 - protein, 124 aa, Triticum aestivum
  unsure (1)..(124): unsure at all Xaa locations
  Clone ID: PAT_TA_98624.pep
MAPKVAVAKKGDAKAQAAKVAKAVKSGSIKKTAKKIRTSVTFHRPKTLSKARDPKYPRIKHPWXEQLDXYQDXKYPLTTXSAMKXIEDTXLVLIVNLKAXKKXXXGAXKKXFXIQAKKVNPFKA

SEQ ID NO: 204207 - protein, 66 aa, Triticum aestivum
  unsure (1)..(66): unsure at all Xaa locations
  Clone ID: PAT_TA_98625.pep
SEXSVXKTYADNFSLGXIQISIXIMIIFVXYVKNXGILLWYTPLESLRFRSGLKLEIGRYPFNQKG

SEQ ID NO: 204208 - protein, 95 aa, Triticum aestivum
  unsure (1)..(95): unsure at all Xaa locations
  Clone ID: PAT_TA_98626.pep
YQWLQPGXGXQGYYPTSXQQPGQGQQLXQWLQPGQGQXGYYPTSLQQTXQWQQSXQGQQXYYXSYHVXXXHQXXXLKVAXAHHLXAQLPAMCXXD

SEQ ID NO: 204209 - protein, 120 aa, Triticum aestivum
  unsure (1)..(120): unsure at all Xaa locations
  Clone ID: PAT_TA_98627.pep
DKRLTRALLADPMIHDNSTDRTAFVPATHIQISALSTFHGRIRGLQWWXRVDGKLGSXPXKEPEKRVXIQGRNKGQITXLTREVXPINTYRXIMSGIGRVNQXLTXSLGESGKTGXSXNT

SEQ ID NO: 204210 - protein, 130 aa, Triticum aestivum
  unsure (1)..(130): unsure at all Xaa locations
  Clone ID: PAT_TA_98628.pep
XQQPILPQQPPFSQQXQQPVLPQQQIPFVHPSILQQLNPCKVFLQQQCSPVAMPQSLARSQMLXQSSCHVMQQQCCQXQLPQIPXQSRYEXIRAIIXPSTCXEQQQVXQGSIQSXQXQPNSWAMFSQPNS

SEQ ID NO: 204211 - protein, 169 aa, Triticum aestivum
  unsure (1)..(169): unsure at all Xaa locations
  Clone ID: PAT_TA_98629.pep
PNGYCKVTWVEHTEYDEASVHQFYRPLLRSGLAFGASRWLATLQRQCECLAILMSSATVSPNEPTAISQEGKRSMLKLARRMTENFCAGVSASSAREWSKLDGATGSIGEDVRVMARKSVSEPXEPPRVVLSAATSVWVPXALRIVHFCVMACWDTSWRPSECERDMES

SEQ ID NO: 204212 - protein, 133 aa, Triticum aestivum
  unsure (1)..(133): unsure at all Xaa locations
  Clone ID: PAT_TA_98630.pep
QQPFPQSQQPQQPFPQPQQPQQSFPQQQQPLIQPYLQQQMNPCKNYLLQQCNPVSLXVSSLVSMILPRSDCQVMQQQCCQQLAQFXSPVQCAAIHSVXHSIVMQQEQQQGYNSPALFQLVKGQSSNSTTTQYE

SEQ ID NO: 204213 - protein, 180 aa, Triticum aestivum
  unsure (1)..(180): unsure at all Xaa locations
  Clone ID: PAT_TA_98631.pep
QQQPILPQQPPFSQQQQQPVLPQQQIPFVHPSILQQLNPCKVFLQQQCSPVAMPQSLARSQMLQQSSCHVMQQQCCQQLPQIPQQSRYEAIRAIIYSIILQEQQQXQGSIQSQQQQPQQLGQCVSQPQQQSQQQLGQQPQQQQLAXGTFXQPHKIXQLEVMTSMRSVPTTIACKCVVRTH

SEQ ID NO: 204214 - protein, 163 aa, Triticum aestivum
  unsure (1)..(163): unsure at all Xaa locations
  Clone ID: PAT_TA_98632.pep
QQQQPQFSQQQQPPYSQQQQPPYSQQQQPPFLQQQQPPFSQQQQPPFSQQQQQPPFTQQQQPPFSQQPPISQQQQQQQQQQQPFTQQQQPPFSQQPPISQXQQQPPFSQQQQPPFSQQQQILVXHPSVLQQLNHARXILQQQCIPVXMQRCLAKSQMWSRHCM

SEQ ID NO: 204215 - protein, 191 aa, Triticum aestivum
  unsure (1)..(191): unsure at all Xaa locations
  Clone ID: PAT_TA_98633.pep
QQQILQQILQQQLIPCRDVVLQQHNIAHASSQVLQQSTYQLLQQLCCQQLLQIPEQSRCQAIHNVAHAIIMHQQQQQQQEQKQQLXQQQQQQQQQLQQQQQQQQQQPSEQXSFPTAQAAYPSKQXSFQPSQLNXAQXSVQPQTTPHSXGIRTXATDATAMCMSTSSCSTQCANCNSVQLRREELILVMNTF

SEQ ID NO: 204216 - protein, 139 aa, Triticum aestivum
  unsure (1)..(139): unsure at all Xaa locations
  Clone ID: PAT_TA_98634.pep
MARAQVMLMAVALVLMLAAVPRAAVAIDCGHVDSLVRPCLSYVQGGPGPSGLCCDGVKNLHNQARFQSDXRQSACNCLKGXARGXHNLNXDNARNIPPKCGVNSHTHHSQHRTQQGVMGTFVNWQTSLGFKPQLYPIHN

SEQ ID NO: 204217 - protein, 107 aa, Triticum aestivum
  unsure (1)..(107): unsure at all Xaa locations
  Clone ID: PAT_TA_98635.pep
XQPGTRXASRXXNVSGXXCXXLSGPXAAASRLSFLALGQXSXHGCTVAGXSXPCTXIXGIFLAWTPRXGALRAPNAPHVVGSVSWYVXSPFXCATILYMSQFHDCHP

SEQ ID NO: 204218 - protein, 107 aa, Triticum aestivum
  unsure (1)..(107): unsure at all Xaa locations
  Clone ID: PAT_TA_98636.pep
LLAEIHAGFGGHHTAAQALVSKAFRIGFYLPTARADAQDLVQHCVGCQLFANKSHMPPTALQTIPITWPFAVWGXDMVGPLKGGSHKKKYLLVMVDXFTXWIPNNYQ

SEQ ID NO: 204219 - protein, 122 aa, Triticum aestivum
  unsure (1)..(122): unsure at all Xaa locations
  Clone ID: PAT_TA_98637.pep
INEGEANIELVGIKEQQQRQQQEEQPLEVRKYRAELSEQDIFVIPAGYPVVVNATSDLNSLLLGINAENNQEELLGRFRKTMXISQXIPNQVQDLRSLGPAKIFENLIKXQSXPYFCGSQPQ

SEQ ID NO: 204220 - protein, 144 aa, Triticum aestivum
  unsure (1)..(144): unsure at all Xaa locations
  Clone ID: PAT_TA_98638.pep
PPPPGSPPLGRLRRLPKPQPKSTPVLEISGRCRRRPRQRWRRPARQRRRAEGGPAGQGRSSQSPVAWNGAAPSGGTLGAVGFRRHGRQLKRRGCGTKKLGGGALDFGHEAAHLGLIGPDFXSXGPARPRCRPTLPLLXKAPPRK

SEQ ID NO: 204221 - protein, 108 aa, Triticum aestivum
  unsure (1)..(108): unsure at all Xaa locations
  Clone ID: PAT_TA_98639.pep
TCGATVTCDKDHELAAHMLAGWKXFDHYXDGLKNGIQDSVGIKEALKANLTHCNPQLLVLWWVFXLPGXVQLPLVVXGVNXQSPNGKILXPPXLSPXXIRGSDXGXXN

SEQ ID NO: 204222 - protein, 170 aa, Triticum aestivum
  unsure (1)..(170): unsure at all Xaa locations
  Clone ID: PAT_TA_98640.pep
MKTFLILALLAIVATTATTAVRVPVPQLQPQNPSQQQSQEQVPLXVQQQQFLXGQQQPFPPQQPYPQPQPFPSXQQPYLQLQPFPAXQLPYSASTTIFGPQQPYPQPQPXYXQPHIHFXQQQQQQQQQQQQEQQYFNNFATTTIPCRCLYCSNTTYAWKLNFAQITTVAK

SEQ ID NO: 204223 - protein, 142 aa, Triticum aestivum
  unsure (1)..(142): unsure at all Xaa locations
  Clone ID: PAT_TA_98641.pep
IDGCXKKNMFRGANAIHPPLQAANAAGPFGAFXGSGXPCRIPRPPCXTRRISGMDKVLIPNCWDKTQSGNGTPSRLRRHGTADGPLSLSPARTEVEEGVQHTGFFRRRTPCRTNGTTPTNGATPTNGASAARTTYSFFTQLK

SEQ ID NO: 204224 - protein, 168 aa, Triticum aestivum
  unsure (1)..(168): unsure at all Xaa locations
  Clone ID: PAT_TA_98642.pep
RLLDVVYNSSNNELVRTQTLVKNAIVQVDAAPFKQWYLTHYGVEIGRKKKAAAAAKKEPAEGQEAEVAAAATEEAKKSNNVQXSXEKRQQGTSLDXHIXEHFXGGRLLADFLLXLXNXXKPKGNPWXGKDWILHXELQXXXXXVQNLSKLSFTWFPKCSIQVCKHTET

SEQ ID NO: 204225 - protein, 163 aa, Triticum aestivum
  unsure (1)..(163): unsure at all Xaa locations
  Clone ID: PAT_TA_98643.pep
QQQQQILQQILQQQLIPCRDVVLQQHNIAHGSSQVLQESTYQLVQQLCCQQLWQIXPEQSRCQAIHNVVHAIILHQQHHHHQQQQQQQQQQPFYQSPFXTAQATYPSRPSFFPTSQTNQQPRSFQPXQLPIFXAIRPTXKTYLQCQCVIPPYCTFSIXIFRTN

SEQ ID NO: 204226 - protein, 160 aa, Triticum aestivum
  unsure (1)..(160): unsure at all Xaa locations
  Clone ID: PAT_TA_98644.pep
MVLKTELCRFSGQKIYPGKGIRFIPFRIPQVFLFANSKMQALLHNRLXKPAKFGWDSNVTRKQHKKTSHAXEAAKKEXARTTKKXYXRPLFGATLEFIXKKXAXEPEXPXCCPKTVXLKFKGRIXETKDXXKAXRXXDHSXIQRGXGPXKGSKAXNXGGG

SEQ ID NO: 204227 - protein, 77 aa, Triticum aestivum
  unsure (1)..(77): unsure at all Xaa locations
  Clone ID: PAT_TA_98645.pep
TRIPPTPTVSPPPPQLDKKKRESRTRWECSRWSRGEGEFLRSESEQAGRARDRGYHTIFPKEPLSECANGVKGVAKX

SEQ ID NO: 204228 - protein, 89 aa, Triticum aestivum
  Clone ID: PAT_TA_98646.pep
RCEAIHNVVHAIILQQQQQLVQATSTQPQQQQQQGQQQQQGLGSSQPQQQTQLDSGLDCGDRDMGDSRPSPAMCDVHVPPYCYTTISPS

SEQ ID NO: 204229 - protein, 111 aa, Triticum aestivum
  unsure (1)..(111): unsure at all Xaa locations
  Clone ID: PAT_TA_98647.pep
VMLMAVALVLMLAAVPRAAVAIDCGHVDSLVRPCLSYVQGGPSPSGQCCGGVXKSLHNQXRNPRAIRQAACNCLKGFLXGIHNLNXDNARSSPQXPCQLPIHIISTSEQCL

SEQ ID NO: 204230 - protein, 122 aa, Triticum aestivum
  unsure (1)..(122): unsure at all Xaa locations
  Clone ID: PAT_TA_98648.pep
THSXXWRXYCSXPREXSTEXNGKYWXCLXLKDHKLNVQHPREQSQGRKFVPCIVIHHQGLANSWRHPFRIFFQNMGREQQXPVWEECCPNHLSMLFVPFGSILSLVDGLLGLALHSSRLHPD

SEQ ID NO: 204231 - protein, 117 aa, Triticum aestivum
  unsure (1)..(117): unsure at all Xaa locations
  Clone ID: PAT_TA_98649.pep
MKTLLILTILAMATTIATANMQVDPSGQVQWXQQQPFPQPQQPFCQQPQQTIPQPHQTFHHQPQQTFPQPQQTXPHQPXQQFPQTQQPQXHFPAPTNIPPTTQLQFPNNPTTXPQPQ

SEQ ID NO: 204232 - protein, 134 aa, Triticum aestivum
  unsure (1)..(134): unsure at all Xaa locations
  Clone ID: PAT_TA_98650.pep
MKKFLVLALIVVAATTTAAEPFTAFRSAWEPQHPSSPEHQPTPQAQEHQFXHQKLNPCKDASYNNXTHLLIXHPPVKSXCNITTAWXXGTRCXQLKAFPKHSRXKASTKFVHXIIXXQQQQLKYFNQLSTTEKG

SEQ ID NO: 204233 - protein, 146 aa, Triticum aestivum
  unsure (1)..(146): unsure at all Xaa locations
  Clone ID: PAT_TA_98651.pep
RTLLRDQAAPSASAPTGRSASQATGDEAAAKVELSKRSCVSCNSKDLQAMXEDSAKTLLRXVAGXXVKNEGGILKLHKAWKVKNLPKGLDSFNXVAAVAQGRRHHQXFNLVGWXNVKIKCPPNQWFNKDSLPMQGNFAKKSTAKNP

SEQ ID NO: 204234 - protein, 81 aa, Triticum aestivum
  unsure (1)..(81): unsure at all Xaa locations
  Clone ID: PAT_TA_98652.pep
XVXHVXIXIVKVVXTKSXXIISSKDWDPLLYQVVSVFRFSVIIFLPIVHRXSHNXXLDLFILGPSKSEPLKFPFHCLNHFX

SEQ ID NO: 204235 - protein, 84 aa, Triticum aestivum
  unsure (1)..(84): unsure at all Xaa locations
  Clone ID: PAT_TA_98653.pep
FRFFXGQSSLIDQPEVWRWDLIACWPVLWPESKDKACGTKRRRLWSFCFVSFRWLEGIDGDRLVQRQRQCSCLCVRVSWGRRKH

SEQ ID NO: 204236 - protein, 118 aa, Triticum aestivum
  unsure (1)..(118): unsure at all Xaa locations
  Clone ID: PAT_TA_98654.pep
MKTLLILTILAMAITIGTANIQVDPSGQVQWLQQQLVPQLQQHYPKQPQQTFPQPQQTFPHXPQQQVPKPQQPXQPFLKPXQXPXXPQQPFPXTQQHNIPKHNIPQTQHHSQQHTTFP

SEQ ID NO: 204237 - protein, 103 aa, Triticum aestivum
  unsure (1)..(103): unsure at all Xaa locations
  Clone ID: PAT_TA_98655.pep
MQIFVKTLTGKTITLEVESSDTIDNVKAKIQDKEGIPPDQQRLIFAGKQLEDGRTLADYNIQKESTLHLVLRLRRGIIXPSSKALARKFNQXKMILPQSATPK

SEQ ID NO: 204238 - protein, 140 aa, Triticum aestivum
  unsure (1)..(140): unsure at all Xaa locations
  Clone ID: PAT_TA_98656.pep
MARAQVMLMAVALVLMLAAVPRAAVAIDCGHVDSLVRPCLSYVQGGPXPSGQCCDGVKNLHNQARFQSDRQXSACNCLKGIAXWIHISNEDNARSXPPKCGVNLPYTSVSNQCXRCNGDSSTGAQLIIQLSTPTSYYIKL

SEQ ID NO: 204239 - protein, 131 aa, Triticum aestivum
  Clone ID: PAT_TA_98657.pep
HTTVLQSWNCRRSEIVQEEVMPAKRNSLMSLHGQAIDTINIQNHQLALQNDGYDEKSCFCIKLLPRKERVGRKSARITKGRMTHQLSALRFLKTRCSSCRYIKPYQVHATRDFRPQVYCQEYKQDKLSSQT

SEQ ID NO: 204240 - protein, 47 aa, Triticum aestivum
  Clone ID: PAT_TA_98658.pep
NHGHGAKPCQLLRLHHALNMIHPPRGPITRISKTRLFSTFHHFLWVS

SEQ ID NO: 204241 - protein, 113 aa, Triticum aestivum
  unsure (1)..(113): unsure at all Xaa locations
  Clone ID: PAT_TA_98659.pep
MARAQVMLMAVALVLMLAAVPRAAVAIDCGHVDSLVRPCLSYVQGGPGPSGQCCDGVKNLHNQARFXSDXQXSACNCLKGDXSVGSTISXXDNXRKHPPKCGVNSIHNLNTAG

SEQ ID NO: 204242 - protein, 119 aa, Triticum aestivum
  unsure (1)..(119): unsure at all Xaa locations
  Clone ID: PAT_TA_98660.pep
PQQPFPQXSQQSQQPFPGPQQLFPELQHPIPXXPQXPFPLXPQXPFPQQXQQPFPQQPHQXFPLQPQXPFPXQXXXPFPQXXQQPFXLXXQQPFPLPPQQXFSXQLXXSXXSFXQPQQE

SEQ ID NO: 204243 - protein, 120 aa, Triticum aestivum
  unsure (1)..(120): unsure at all Xaa locations
  Clone ID: PAT_TA_98661.pep
INCHNQNCLLHAVVIFLCETIRVFFFFSELFGNATVFYVAFTISSSRYNPKHNLVLRFXYSQVYSSTADLXKLXXKCFVQXQQATLSHVXLWGCNPEPHLALWPXSKXGTRVPAXPRXLG

SEQ ID NO: 204244 - protein, 161 aa, Triticum aestivum
  unsure (1)..(161): unsure at all Xaa locations
  Clone ID: PAT_TA_98662.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQXQQQLVLPQQPPFSQXQQQPVLPPQQSXFPQQXQHXQLGXQQIPVVKPSILQQXNPXSYXQQAMQPVNA

SEQ ID NO: 204245 - protein, 66 aa, Triticum aestivum
  unsure (1)..(66): unsure at all Xaa locations
  Clone ID: PAT_TA_98663.pep
RNNNSPGHNNPLNNNNSPNNNSPSNHHNNSPNNNFQYHTHXSXHKNLPHTNXIHNHLGSITIGLNE

SEQ ID NO: 204246 - protein, 121 aa, Triticum aestivum
  unsure (1)..(121): unsure at all Xaa locations
  Clone ID: PAT_TA_98664.pep
MKTFLILALLAIVATTATTAVRVPVPQLQPQNPSQQQSQEQVPLVQQQQFLGQQQPFPPQQPYPQPQPFPSQQPYLQLQPFXQPQLPYSQPQPFRPXQPYXTXAPQYSXPQHPFNSQQQQN

SEQ ID NO: 204247 - protein, 158 aa, Triticum aestivum
  unsure (1)..(158): unsure at all Xaa locations
  Clone ID: PAT_TA_98665.pep
MAPTVMASSATSVAPFQGLKSTAGLPVSRRSNGASLGSVSNGGRIRCMQVWPIEGIKKFETLSYLPPLSTEXLLKQVDXLIRXKWVPASXFSXGWVXFREHXNASPGYYMAVXAMWXLPXFXCTDPQSDXQVEESXXXTLTXXRIIGFXTCXSEXVXS

SEQ ID NO: 204248 - protein, 106 aa, Triticum aestivum
  unsure (1)..(106): unsure at all Xaa locations
  Clone ID: PAT_TA_98666.pep
LILALLAIVATTATIAVRVPVPQLQPQNPSQQQPQEQVPLVQQQQFPGQQQPFPPQQPYPQPQPFPSQQPYLQLQAFPQPQLPFRXPHXQXPXXTITNNQFQHRFS

SEQ ID NO: 204249 - protein, 124 aa, Triticum aestivum
  unsure (1)..(124): unsure at all Xaa locations
  Clone ID: PAT_TA_98667.pep
MANPRVFFDMTVGGAPAGRIVMELYKDAVPRTVENFRALCTGEKGVGKSGKPLHYKGSSFHRVIPDFMCQGGXDFXKGNXTXGEXIXGEKFXXQKFXHKXNXPGDFPMXNXGPKXKGPNFNLNP

SEQ ID NO: 204250 - protein, 161 aa, Triticum aestivum
  unsure (1)..(161): unsure at all Xaa locations
  Clone ID: PAT_TA_98668.pep
PQQSFSHQQQPFPQQPYPQQPYPSQQPYPSQQPFPTPQPQFPQQSQQPFPQPQQPIPLQPQQPFPQQPQQPQQPFPQPQQPFPWXQPQQPFPKTQQSFPLQPXQPFPXQPQQPFSKPXLQFPQQPRQIIPKNPXQPSSLEXQQQSPXNPTTFPNTIPTHHP

SEQ ID NO: 204251 - protein, 78 aa, Triticum aestivum
  unsure (1)..(78): unsure at all Xaa locations
  Clone ID: PAT_TA_98669.pep
FNNLXFRRQKEPXXRTXKMTIITTTWARRXPLAGGRILATAPTVASNFTHAGLVLTCVGVLRSHVRRLSSSAGSARPC

SEQ ID NO: 204252 - protein, 105 aa, Triticum aestivum
  unsure (1)..(105): unsure at all Xaa locations
  Clone ID: PAT_TA_98670.pep
MAPPRTVICVGDVHGYISKLESLWANLQSALPADAFAAALVIFLGDYNDRGPHTRRVLRLLLALPARHPXQRHVFLCGNHDSPSAAFRPERCRRPRRSPRRNLGQ

SEQ ID NO: 204253 - protein, 123 aa, Triticum aestivum
  Clone ID: PAT_TA_98671.pep
PQTQQPQQPFPQQPQQPFPQPQQVVQINPQQPQQPFSQSRQPFPQQPQQPFPLQPQQPFPQQSAQIIPQQPQQPFPLQPQQSFLRQSQQPFLQQPQQPSPQPQQVSTIIPQATPTTFPPAGKQ

SEQ ID NO: 204254 - protein, 129 aa, Triticum aestivum
  unsure (1)..(129): unsure at all Xaa locations
  Clone ID: PAT_TA_98672.pep
MVSLKLQKRLASSVLKCGKGKVWLDPNEVNEISMANSRQNIRKLVKDGFIIKXKPQKIHSRSRARRAHEAKQXGRHSXYGXRRVQGKLVPXKIXLXRRSPKAFPLKKFTTIFHFLKARTFGPISKNPLT

SEQ ID NO: 204255 - protein, 75 aa, Triticum aestivum
  unsure (1)..(75): unsure at all Xaa locations
  Clone ID: PAT_TA_98673.pep
MIPCMDVVLQQHNIAHGRSQVLQQSTYXQLLQELCCQHLWQIPEQSQCQAIHNVVHAIILRQQQKQQQQPSSQVS

SEQ ID NO: 204256 - protein, 111 aa, Triticum aestivum
  unsure (1)..(111): unsure at all Xaa locations
  Clone ID: PAT_TA_98674.pep
MXXLXCTNHTLLSSPTCLAXXRRAVXRAXVAVXAEAQPKVSLIRXIDTRXXXLALAXTRKTXDELKXAXTXLXKMIGITLSKKFFGNPEKGKGTKGQSWRELEIQKVPKGI

SEQ ID NO: 204257 - protein, 65 aa, Triticum aestivum
  unsure (1)..(65): unsure at all Xaa locations
  Clone ID: PAT_TA_98675.pep
SFQQVNCFXXGTMMLFFXLXGRXTLGGVFSLDSSHSPFHGPLLXFSFXRQVIPYINVFRHLAFAT

SEQ ID NO: 204258 - protein, 52 aa, Triticum aestivum
  unsure (1)..(52): unsure at all Xaa locations
  Clone ID: PAT_TA_98676.pep
GXCSRGLEPAEEMRREDASRLRRHPMAAPHPRHKRGGELGLPPRRSPDVSTG

SEQ ID NO: 204259 - protein, 128 aa, Triticum aestivum
  unsure (1)..(128): unsure at all Xaa locations
  Clone ID: PAT_TA_98677.pep
LLSLDLARSSRSPPATVPSRPAPLLLPPPASPXDPPSEPPSSSPTPTSTPPRTAGDDSSPRPXPPEQPRQRSDPPXPPSLPISAGNPSHPTMPNDRRHEESAVXGRRPXPPPPRSPDAAATPFPRPLP

SEQ ID NO: 204260 - protein, 104 aa, Triticum aestivum
  unsure (1)..(104): unsure at all Xaa locations
  Clone ID: PAT_TA_98678.pep
MKFIAAYLLAYLSGNASPSAEDLTSILESVGCEIDNEKMELMLSQVKGKDITELLGCWVGRICCGTSGGWWCXLFQAAAPCCXGGAAAPAAESKERKKXLXKGK

SEQ ID NO: 204261 - protein, 92 aa, Triticum aestivum
  unsure (1)..(92): unsure at all Xaa locations
  Clone ID: PAT_TA_98679.pep
PAPLNLATTPVGDXPSPAAPLSSPTPEPEAEPXWPAPCPSSPPXGRRPRXRSPRXPXXPPRSPSPXPPDASXSXSXCRXSSPVIAMASTGAV

SEQ ID NO: 204262 - protein, 64 aa, Triticum aestivum
  Clone ID: PAT_TA_98680.pep
RWFLALATTKWCHSSSEGVKNRATTKGPIFKLYPPPPWIAFSVLKKIKENDENVEKIKENKFPM

SEQ ID NO: 204263 - protein, 117 aa, Triticum aestivum
  unsure (1)..(117): unsure at all Xaa locations
  Clone ID: PAT_TA_98681.pep
MAAAGDAGEKKMITLKSSDGEEFEVEEAVAMESQTIRHMIEDDCADNGIPLPNVNSKILSKVIEYCNKHSKPSRRWGCRREPEPGARTRPAAPAEDXKNWDIPQGQQATSSLIQLLK

SEQ ID NO: 204264 - protein, 153 aa, Triticum aestivum
  unsure (1)..(153): unsure at all Xaa locations
  Clone ID: PAT_TA_98682.pep
KAPGRERGSCVRDMSGSKNAWVVRCWDRWSPSAPPPAXSPSXKXLRQGRAARPHLXRGRPMDGPVAFLRADAGLXLSPQLQLGQSPEQANRQARKAAASPAKLGGMALAAPRRRRGVSRRAAPPPYLIDISVGPPRRRCMAASSVPRGEVLLG

SEQ ID NO: 204265 - protein, 177 aa, Triticum aestivum
  unsure (1)..(177): unsure at all Xaa locations
  Clone ID: PAT_TA_98683.pep
GQQPYPQPQLFPQPQLPYSQPQPFRPQQPYPQPQPQYSQPQEPISQQQQQQQQQQQILQQILQQQLIPCMDVVLQQHNIAHGRSQVLQQSTYQLLQELCCQHLWQXPEQSQCQAIQNVVHAIILHQQQKQQQQPSSXVSFQXQPLQQYPLGXXSFRASQAKPQDKLCQASTTPSSRK

SEQ ID NO: 204266 - protein, 64 aa, Triticum aestivum
  Clone ID: PAT_TA_98684.pep
VRHLVIIFFHFYIHTNGASYRSAPLLVLTSNGAPDRECASTAFFYSFFCKTTNGAPPHSAPLLF

SEQ ID NO: 204267 - protein, 134 aa, Triticum aestivum
  unsure (1)..(134): unsure at all Xaa locations
  Clone ID: PAT_TA_98685.pep
MKTLLILTILXMAITIGTANXQVDPSXQVQWLXQQLVPQLQQPLSQQXQXTFPQPQXTFPHQPXQXVPQPQQXXQPFLXAQQAFXQXPXXPFPQXXXPXXAFXQQXXXXFPXLSSHXXRXFPHXHTANYFSHFR

SEQ ID NO: 204268 - protein, 78 aa, Triticum aestivum
  unsure (1)..(78): unsure at all Xaa locations
  Clone ID: PAT_TA_98686.pep
LFXLGERRGCTDISPDSSVDPSTAMISGYVVLAFFGPRIKEVDQRTGRSAGVERKSGHRAAPLKYREVDGQRTNACKF

SEQ ID NO: 204269 - protein, 125 aa, Triticum aestivum
  Clone ID: PAT_TA_98687.pep
ALLALAAASAVAQISQQQQAPPFSQQQQFPQQQFPQQQFPQQQQFPQQQQFPQQQQFPHPQQFPQQQQFPQQQQFPQQQFPQQPQQQFPQQQFPIPYPPQQQSQEASPYNITQQQLSGNVLVSGH

SEQ ID NO: 204270 - protein, 131 aa, Triticum aestivum
  unsure (1)..(131): unsure at all Xaa locations
  Clone ID: PAT_TA_98688.pep
VPLSSLPCSLLCSSAPSPXPSLAPXPEXPXLXRXTPXMVXIPXXGSASLRXGPAALQRDRRSXIVVGRRPCRSPGAARARCRWCXPXPRTXPSXXXRXXPXMXRLKARXRRRGXLXLXXERXXFWXRXXXP

SEQ ID NO: 204271 - protein, 128 aa, Triticum aestivum
  unsure (1)..(128): unsure at all Xaa locations
  Clone ID: PAT_TA_98689.pep
QQILQQILQQQLIPCRDVVLQQHSIAYGSSQVLQQSTYQLVQQLCCQQLWQIPEQSRCQAIHNVVHAIILHQQQQQQQQQQQKQPLEPXSFPTXKQHFNQGQGSFQXSQXKPXGQGSXXXQXXPNFXE

SEQ ID NO: 204272 - protein, 95 aa, Triticum aestivum
  Clone ID: PAT_TA_98690.pep
KHDLQLIDGASIIVSKDLQNCHTFTSRIYGNCGAVDFTASRLENAVEATLEVVILEVQNSFNLCLSCFTSGLNEEIRLFNGTIGESCGLKRLWLL

SEQ ID NO: 204273 - protein, 168 aa, Triticum aestivum
  unsure (1)..(168): unsure at all Xaa locations
  Clone ID: PAT_TA_98691.pep
CXXGXPXRDIPGXPFXDHXTXXGTPVXVGENXDGTXPASLHHESTEXSFMVKGGXLQAPXLLRVFRNRXEEGGVRQPRPRRPGXAPGPQPRARGGSAXPPPSXCPGTAARPPRTGXSPPPXPPAPAAAPKPSGNHAPWSTGEGKLAALRVDGSGDWRDRTGDRLPLIS

SEQ ID NO: 204274 - protein, 77 aa, Triticum aestivum
  unsure (1)..(77): unsure at all Xaa locations
  Clone ID: PAT_TA_98692.pep
KSNVRFLGMTNRKFFIKYYIGCDDDKFKCASMTFFWTKTGTKTDLPCSSSKLAILKEHNFHEETFRLPWXKTPTSDI

SEQ ID NO: 204275 - protein, 176 aa, Triticum aestivum
  unsure (1)..(176): unsure at all Xaa locations
  Clone ID: PAT_TA_98693.pep
QQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLXGQCVSQPQQQSQQQLGQQPQQQQLGTRYFLQXHQIAQLEVMTSIALRTXPTMCRVNVPLDRTPLMCIG

SEQ ID NO: 204276 - protein, 174 aa, Triticum aestivum
  unsure (1)..(174): unsure at all Xaa locations
  Clone ID: PAT_TA_98694.pep
ITGFADPKKKRAILLNDDAEVPILGLTNLKFWVYHSQGRRQINSRELKGVCVEHQNVLAERYLVQGHEFPTDKPIHHRAGCVPGSPRAAASRSPGTSATPWCRMRGRRRVPKPTSIRDGHRPHGTALISFGREYVGFKGLPVRMXWPPWGGEQGNCLGIVQNCCLGGRFXSNEP

SEQ ID NO: 204277 - protein, 94 aa, Triticum aestivum
  unsure (1)..(94): unsure at all Xaa locations
  Clone ID: PAT_TA_98695.pep
DQRRTIEFEGGKEPPLTPIVFATGYKSTTNLWLXKNDEDMLNSDGVPKKQFPNHWKGANGLYCAGLGRRGLAGIAMDAKNIANDIKRSIDSMCS

SEQ ID NO: 204278 - protein, 173 aa, Triticum aestivum
  unsure (1)..(173): unsure at all Xaa locations
  Clone ID: PAT_TA_98696.pep
QQQQPPFSQQQPPFSQQQQPVLPQQPSFSQQQLPPFSQQQSPFSQQQQIVLQQQPPFLQQQQPSLPQQPPFSQQQQQLVXPQQQIPFVHPSILQQLNPCKVFLQASNAACGNATKLARSQMLQQSXCHVMQQQCCQXXRXPPASRYEXIRAIIYPSSWQEQQQVKGPSKSTAT

SEQ ID NO: 204279 - protein, 130 aa, Triticum aestivum
  unsure (1)..(130): unsure at all Xaa locations
  Clone ID: PAT_TA_98697.pep
MSCCGGNCGCGAGCKCGNGCGGCKMFPDVEATAGAAAMVMPTASHKGXSSGGFEMAXGGETGGCDCTTCKCGTXRAAAPAAAATEPAHKEAGRAXGXTKDEEGRTXNHHQQQQQPKRTITTNRRMRSRAR

SEQ ID NO: 204280 - protein, 56 aa, Triticum aestivum
  Clone ID: PAT_TA_98698.pep
SRRLLCIFPCIDTSNYVYVFFLCEECIRQNLYFLTKFSIWTFLLKNQAILLYLNIL

SEQ ID NO: 204281 - protein, 70 aa, Triticum aestivum
  Clone ID: PAT_TA_98699.pep
YRAPPFTLAFYPKKYVIHWRVPGTETPPEPKEGELIVFTDHMDRGFSPPGSKFSRDVLHFFVDMDFDRDK

SEQ ID NO: 204282 - protein, 163 aa, Triticum aestivum
  unsure (1)..(163): unsure at all Xaa locations
  Clone ID: PAT_TA_98700.pep
PQQSFPQQQQPAIQSFLQQQMNPCKNFLLQQCNHVSLVSSLVSIILPRSDCQVMQQQCCQQLAQIPQQLQCAAIHSVAHSIIMQQEQQQGVPFLRPLFQAPPRVWGIIQPQTTSQLGGXRPLXWKTLPTMCNVYVPPXDAPTSNIPYANIDLGLGGQWKQIVA

SEQ ID NO: 204283 - protein, 177 aa, Triticum aestivum
  unsure (1)..(177): unsure at all Xaa locations
  Clone ID: PAT_TA_98701.pep
QQPFPQQPQQQFPQPQQPQQPFPQQPQQQFPQPQQPQQPFPQPQQPQLPFPQQPQQPFPQPQQPQQPFPQLQQPQQPLPQPQQPQQPFPQXQQQPLIQPYLQQQMNPCKNYLLQQCXPVSLVSSLGVNDLATKWIAXVMRQHVGQQLAXRILKQVQCAASXGLHSSSRKXDTHNNNT

SEQ ID NO: 204284 - protein, 161 aa, Triticum aestivum
  unsure (1)..(161): unsure at all Xaa locations
  Clone ID: PAT_TA_98702.pep
MKTFLIFALLAIAATSAIAQMETSRVPGLEKPWQQQPLPPQQQPPCSQQQQPFPQQQQPIIILQQSPFSQQQQPVLPQQQPVIILQQPPFSQQQQPVLPQQPPFSQQXQQQQQQQQPPFSQQQQPVLPQQPHFXNNTTHFRSRTTSSQQHFSXQHNSFKTT

SEQ ID NO: 204285 - protein, 171 aa, Triticum aestivum
  Clone ID: PAT_TA_98703.pep
PFPQQPQQPFPLQPQQPFPLRPQQPFSQQPQQSQQSFPQPQPQQPQQPSILQPQQPFLQPQQQLSQQLEQTISQQPQQPFPQQELPPFSQQQSPFSQQQQIVLQQQPPFLQQQQPSLPQQPPFSQATTTTSSTATNTICSSIYLAAAKPCKVFLKQNAACNGTLVAKLQQR

SEQ ID NO: 204286 - protein, 179 aa, Triticum aestivum
  unsure (1)..(179): unsure at all Xaa locations
  Clone ID: PAT_TA_98704.pep
QLQPFPQPQLPYPQPQLPYPQPQPFRPQQSYPQPQPQYSQPQQPISQQQQQQQQQQQQQQILQQILQQQLIPCRDVVLQQHSIAHGKSQFCNKVLYQAGATLCCQXQLWQXPEXSRCQXSTCCSMAIILHQXQQQQQQQQPFXQVCFQXXQQHXIKARSLQXXQAKPXAKXXQXQQRPI

SEQ ID NO: 204287 - protein, 60 aa, Triticum aestivum
  Clone ID: PAT_TA_98705.pep
LTNYASKVCRFRKEDISNPSNVRIYAECQNNFRYEGPRSSTKDLKLHNKHVLTILLVART

SEQ ID NO: 204288 - protein, 150 aa, Triticum aestivum
  unsure (1)..(150): unsure at all Xaa locations
  Clone ID: PAT_TA_98706.pep
QSRAMLHMRRIGGTPNQSEGGWAEQPDGAAMGASGEHVTCICHCWRTLPALETAVLFRRALTNQSTYEVARWKGLFYLRYVLSRTTQAPVCSDFMIPHYYIVRLGYWSCXTFKVILDKLIHSVNAYIETSVTSASLWXEXLPNHXRLXYX

SEQ ID NO: 204289 - protein, 126 aa, Triticum aestivum
  Clone ID: PAT_TA_98707.pep
PQQQVPQPQQPQQPFLQPQQAFPQQPQQPFPQTQQPQQPFPQQPQQPFPQQQGMHILLPLSQQQQLGQGTLVQGQGIIQPQQLAQLEAIRSLVLQTLPTMCNVYVPPECSIIRAPFASIVAGIGGQ

SEQ ID NO: 204290 - protein, 172 aa, Triticum aestivum
  unsure (1)..(172): unsure at all Xaa locations
  Clone ID: PAT_TA_98708.pep
VAKNCTRRQLNQIHGLLLTSSLHRLPGLPALLVRRAADVGDMAHADLLFSSFLRSGAPPDAALYNAMIRGRSYHGPHERALELFDEMPRRGLGXDGFTYPYVLDACARLRARRRGEGVHGRVLKEGLDHVPSVGSRWSHSTSPSAAVAGRRAEVFDGLRSVRGPVKHIRRQG

SEQ ID NO: 204291 - protein, 198 aa, Triticum aestivum
  unsure (1)..(198): unsure at all Xaa locations
  Clone ID: PAT_TA_98709.pep
IMSFWDRLCKVLHVRKVTVMDISKKQGMDYRLLHAITTGHPWYGEWGYKFGAGSFAHTSDTYQEAVDVLSGIHLALYSSHRSPIRTPLQNTIALYWSLSDRQLVTVRDLFRXFIMHLLHQARKDAETSKPTXDEHRELXSNVLCMWXTNEDINRAXTAMLKXLRAVKLGRWVSWRXLKGTASKVLITGTLIPQVGEMM

SEQ ID NO: 204292 - protein, 70 aa, Triticum aestivum
  unsure (1)..(70): unsure at all Xaa locations
  Clone ID: PAT_TA_98710.pep
EIMDKXLKKEHFVNPPNIFGILXFSXKXXDLNSRFWGGSEFXLXXQHFXIXEQIRIQHLGXLQFGIHCWK

SEQ ID NO: 204293 - protein, 177 aa, Triticum aestivum
  unsure (1)..(177): unsure at all Xaa locations
  Clone ID: PAT_TA_98711.pep
MKTFLILALLAIVATTATTAVRVPVPQLQLQNPSQQQPQEQVPLVQEQQFPGQQQPFPPQQPYPQPQPFPSQQPYLQLQPFPQPQLSYPQPQPFRPQQPYPQPQPQYSQPQXPISQQQAXSSKQQQQQQQQQPLSQPPNSLTYHARLQPSQNQKAKARQPQQRPIGITTVLQVAIPQ

SEQ ID NO: 204294 - protein, 56 aa, Triticum aestivum
  unsure (1)..(56): unsure at all Xaa locations
  Clone ID: PAT_TA_98712.pep
SXITHSNHPHHRLSRSNRDGMLTLVPVRDATGIMCTLSCDPKPCFLLVSCHMTEKH

SEQ ID NO: 204295 - protein, 190 aa, Triticum aestivum
  unsure (1)..(190): unsure at all Xaa locations
  Clone ID: PAT_TA_98713.pep
MKTFLILALLAIVATTATTAVRVPVPQLQLQNPSQQQPQEQVPLVQEQQFPGQQQPFPPQQPYPQPQPFPSQQPYLQLQPFPQPQLSYPQPQPFRPQQPYPQXPQPQYSQPQQPIXQASNKQQQQQQQQQQQXLQQXWQQQXIPCXDVVLQQHNIAHGSHXFARXSYNXATCVVTMWEVPEXXGKHHMCH

SEQ ID NO: 204296 - protein, 85 aa, Triticum aestivum
  Clone ID: PAT_TA_98714.pep
QKPPAPLKPTRFTKYFFNEPEMPFLKCSSSLPWSRTSVKNGSHFSRTTLVIELNHIVFAFGHLNAIKYFKCSNNHKLKCLLLDIF

SEQ ID NO: 204297 - protein, 140 aa, Triticum aestivum
  unsure (1)..(140): unsure at all Xaa locations
  Clone ID: PAT_TA_98715.pep
MPAGHGLRSRTRDLFARPFRKKGYIPLTTYLRTYKVGEHVDVKVNGAVHKGMPHKFYHGRTGRVCNVTKRAIGVEINKQVGNRIIKKRXHVRVGHVQPSKVQRGFLQXEINNDKLKAEAKXRGEVISTKEEPARPKPGSW

SEQ ID NO: 204298 - protein, 162 aa, Triticum aestivum
  unsure (1)..(162): unsure at all Xaa locations
  Clone ID: PAT_TA_98716.pep
MASEQTFIMIKPDGVQRGLIGEVISRFEKKGFYLKGLKLQNVEKSFAEQHYADLSSKPFFAGLXVEYIVSGPVXVAMVWEGKSVVSTXGRKIMGATNPWXLDPGTIRGDLPSDIRQELTMGSDQXXRXEEGXPLWSPGRIADGRSNQHNGSMRLNCHDGFQV

SEQ ID NO: 204299 - protein, 63 aa, Triticum aestivum
  unsure (1)..(63): unsure at all Xaa locations
  Clone ID: PAT_TA_98717.pep
FFLQXXGGIGVAXEARICTGKXXHXSFPCVSDKXCTKMCLXEXGAXWTXGYXCKIRXCTCQRE

SEQ ID NO: 204300 - protein, 80 aa, Triticum aestivum
  Clone ID: PAT_TA_98718.pep
KRYDQSVTCLADDPRNLEIRSNKRRTPGILSQTNKQAYNKYSSNKRSNQKVQLKNSGWQKESNRTKQRKSNGEIKTTLFY

SEQ ID NO: 204301 - protein, 137 aa, Triticum aestivum
  unsure (1)..(137): unsure at all Xaa locations
  Clone ID: PAT_TA_98719.pep
MSGGVGXTXGGGIMLPSMGQPPPPLHPEPTSPTXRPHHHYYLFSIKQLXTLGAAAVLAFSTTVPLSEIAFAVLLLPYLXLLASLAFPXQRPGKPXPSTXVFXGTARXLLSAQDVGRGXRREPAFPXVXXXDGXSAXG

SEQ ID NO: 204302 - protein, 178 aa, Triticum aestivum
  unsure (1)..(178): unsure at all Xaa locations
  Clone ID: PAT_TA_98720.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLVQQQIPVVQAXSXCSKXNPCKLFLXAAVQPWWAMPQXLARXQMFSNWPCE

SEQ ID NO: 204303 - protein, 126 aa, Triticum aestivum
  Clone ID: PAT_TA_98721.pep
QPPTKHLAFSQLSAGRPRFPSPPSPQAALESSPMKHPTLSPSHEPSHSPSLSQEIPLCSHKQRSILSRYSVHGRHAAHPRARLPLLCRLLRPDPSLPVSIACAQTLPMARVFGTASPPSPARLQCC

SEQ ID NO: 204304 - protein, 185 aa, Triticum aestivum
  unsure (1)..(185): unsure at all Xaa locations
  Clone ID: PAT_TA_98722.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQXPQQPFPQTQQPQXPFPQQAQQPFPQXTXQPQQAFPXLQQPQQXFPQXRXQLPQAXXXXXSFPQXXRGINQXFLXQXVNHG

SEQ ID NO: 204305 - protein, 150 aa, Triticum aestivum
  unsure (1)..(150): unsure at all Xaa locations
  Clone ID: PAT_TA_98723.pep
TATTAVRVPVPQLQPQNPSQQQSQEQVPLVQQQQFLGQQQPFPPQQPYPQPQPFPSQQPYLQLQPFPQPQLPYSQPQPFRPQQPYPQPQPQYSQPQHPISQQQQQXQQQQQQXQQILQQILQQQLIPCMDVVLQQHNIAHXXXQVLXQST

SEQ ID NO: 204306 - protein, 137 aa, Triticum aestivum
  Clone ID: PAT_TA_98724.pep
WRPPTWPSSSSRPSPPPPPSPVVFLPARRTGTRPARAATRPGHLLPAWLPPPPPGRLPSATHSPSTLSHSPVSLPPSLSPSAPSPSRDRTELVAAARRSHAYRPPHALQTLRKASPRLPLHPHPRRKAPECHIPSFW

SEQ ID NO: 204307 - protein, 119 aa, Triticum aestivum
  unsure (1)..(119): unsure at all Xaa locations
  Clone ID: PAT_TA_98725.pep
QPQXPFPQQPQQPFPQQPQXPFPLQPQQPFPLRPQQPFSQQPQXSQQSFPQPQPQQPQQPSILQPQQPFLQPQQQLSQQLXQTISQQPXQPFPQQPHQPQQPYPXQXPYGSSLTSIGGX

SEQ ID NO: 204308 - protein, 116 aa, Triticum aestivum
  Clone ID: PAT_TA_98726.pep
MARAQVMLMAVALVLMLAVVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSRV

SEQ ID NO: 204309 - protein, 188 aa, Triticum aestivum
  unsure (1)..(188): unsure at all Xaa locations
  Clone ID: PAT_TA_98727.pep
QPQQPQLPFPQQPQQPFPQPQQPQQPFPQLQQPQQPLPQPQQPQQPFPQQQQPLIQPYLQQQMNPCKNYLLQQCNPVSLVSSLVSMILPRSDCKVMRQQCCQQLAQIPQQLQCAXAIHGVVHSXIMQQEQQQQQQQQQGIQXMRXXFQXXXGQXIIQPQQXAXXXVIXXXVLGTPSNMCXVFGPPGVP

SEQ ID NO: 204310 - protein, 176 aa, Triticum aestivum
  unsure (1)..(176): unsure at all Xaa locations
  Clone ID: PAT_TA_98728.pep
QQPQQIPQQQQIPQQPQQFPQQQFPQQQFPQQQFPQQEFPQQQQFPQQQIARQPQQLPQQQQIPQQPQQFPQQQQFPQQQSPQQQQFPQQQFPQQQQLPQKQFPQPQQIPQQQQIPQQPQQFPQQQFPQTXSNFPNNXDSPNSNSRNNXSTXQQLPATTXFPNXNSPNQQFPQXXE

SEQ ID NO: 204311 - protein, 173 aa, Triticum aestivum
  unsure (1)..(173): unsure at all Xaa locations
  Clone ID: PAT_TA_98729.pep
QXLANRILCARWHXGEXSXRQDTAWKETQEAVRFLLQHKKDLHXRPRGRSQPPGVAAPIPTSGRIWRAPIFPISTRATSTAGMTSPASPHASTGGGGPHDLHPLSPSSRRRRRLTRAAECQTGSAGPPPPAAESPDARGVLHCRWRLIGEQQRRRAWRRERKGGKGDGTASTA

SEQ ID NO: 204312 - protein, 169 aa, Triticum aestivum
  Clone ID: PAT_TA_98730.pep
GILSNAFRGSLYTTMHYMASEDKLVAGMGNGSIRFIDISRDQKLHLWKSDSAEISFSSLVSTICSSGSDKPRNGSLVASSSWIAAGLSSGYCRLLDERSGKIIAVWRAHDGHITKLASPEDHLIASSSLDKTLRIWDLRRNLSVQSNIFRSHSDGIFDFSVWGQDLLSM

SEQ ID NO: 204313 - protein, 61 aa, Triticum aestivum
  Clone ID: PAT_TA_98731.pep
TQKMFILLEIVWKFKFCVRLQKKTLFSKRDSNFQKMYVLSKNRIFKKCSFLQQKSQIQKMS

SEQ ID NO: 204314 - protein, 142 aa, Triticum aestivum
  unsure (1)..(142): unsure at all Xaa locations
  Clone ID: PAT_TA_98732.pep
PQQPFPQQSQQSQQPFPGPQQLFPELQQPIPQQPQQPFPLQPQQPFPQXSQQPFPQQPQQPFPLQPQQPFPQQPQQPFPQXPQQPFPLQPQQPFPLRPQQXFSXXPQQSQXSFPKPQPQEXQXPSILXPQXXFLQPPTTIYP

SEQ ID NO: 204315 - protein, 36 aa, Triticum aestivum
  Clone ID: PAT_TA_98733.pep
RAILTSHSIILSLSNRCVQQGFMTQNKKQNKKIKKK

SEQ ID NO: 204316 - protein, 167 aa, Triticum aestivum
  unsure (1)..(167): unsure at all Xaa locations
  Clone ID: PAT_TA_98734.pep
QNLPRAPLRGGSCAHLCAPVVCPPPADFFPFLTSHHTSLKTTATHTSPGNTSSLPNALDSSLPPPIVATVPDRCFNQRRRSATTVTGVLRWRVPRPAVLQPGRPITSRKQGKGHRAVFTLAPVQVTNRDPWGHSSRFVSPRGRPGPRGHWSRFVWXHLSRFEPRTGD

SEQ ID NO: 204317 - protein, 115 aa, Triticum aestivum
  unsure (1)..(115): unsure at all Xaa locations
  Clone ID: PAT_TA_98735.pep
MARAQVMLAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSXV

SEQ ID NO: 204318 - protein, 180 aa, Triticum aestivum
  unsure (1)..(180): unsure at all Xaa locations
  Clone ID: PAT_TA_98736.pep
QPFPQTQQPQQPFPQQPQQPFPQTQQPQQPFPQFQQPHQPFPQPQQQFPQPQQPQQSFPQQQRPFIQPSLQQRLNPCKNILLQQCKPASLVSSLWSIIWPQSDCQVMQQQCCQELXAQIPQQLQCAAIHSVVHSIIVQQXQXQQQQHQAXAXTSXHAYPWLPXSQXQQVGXXGYXRSXGK

SEQ ID NO: 204319 - protein, 51 aa, Triticum aestivum
  Clone ID: PAT_TA_98737.pep
SKTVSKFKFKLMPIVKVFQKLKQKCSVGAKYYKGNYNKENIFFRKCLNKLN

SEQ ID NO: 204320 - protein, 180 aa, Triticum aestivum
  unsure (1)..(180): unsure at all Xaa locations
  Clone ID: PAT_TA_98738.pep
SQQQPPFSQQQQPVLPQQPSFSQQQLPPFSQQQSPFSQQQQIVLQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIXPSSLQGTTTRXKGSIQNSSSNNPNSWGQCVSQ

SEQ ID NO: 204321 - protein, 146 aa, Triticum aestivum
  unsure (1)..(146): unsure at all Xaa locations
  Clone ID: PAT_TA_98739.pep
QPFPPXHPXPQPXPFPXQQPYLQLXPFPQPQLPYSQPQAFRPQQPYPQXQPQYSXPQHPXSXXXQXQQXQQXHXQQILQQXLQQQLXPCMXDVVLQQHNXAAWXDHKFCNKSSYQXLLQXLCCQQLWEXPXXSXCKAIPCGQAFPK

SEQ ID NO: 204322 - protein, 102 aa, Triticum aestivum
  Clone ID: PAT_TA_98740.pep
WIIQPACFSVCQLFGATRCAKSLNAKTVSLEMLPFRGGAGRISGEANIEKEAIVIAAEGSKSTWRGIPQPTGTCHSSSKRRQFQNEDLLNCERMFCLKVYMV

SEQ ID NO: 204323 - protein, 153 aa, Triticum aestivum
  unsure (1)..(153): unsure at all Xaa locations
  Clone ID: PAT_TA_98741.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGILSMANAGPNTNGSQFFICNVPCNWLDXKHVVXSGEVXKGMDSSRXXXKG

SEQ ID NO: 204324 - protein, 52 aa, Triticum aestivum
  Clone ID: PAT_TA_98742.pep
KMLKHFQIFPCDKKKITHKRCLNYIRKMFNTEYILKYKGKKTRKEQISRKKK

SEQ ID NO: 204325 - protein, 64 aa, Triticum aestivum
  Clone ID: PAT_TA_98743.pep
GTSQCALDRPKFFNHVLNFTSWRLHIVTKCLARCVWLQLIFICMSLQFSKLGRILFYNMYSLRF

SEQ ID NO: 204326 - protein, 97 aa, Triticum aestivum
  unsure (1)..(97): unsure at all Xaa locations
  Clone ID: PAT_TA_98744.pep
FFVFIYIFSFKFFSYFYFSIYSLFYLFKIYELVFTLSYXCSKCRANLDRGLFYHTHSVLPRVFVCVYLATCSHVRNLLGHFCGAVWVMFRIDLLILI

SEQ ID NO: 204327 - protein, 124 aa, Triticum aestivum
  Clone ID: PAT_TA_98745.pep
RHQSPDPAREGADRGEREENLHKDAGRLAGDVATLATDGRRHLVAHTTEGRRLTNTCGHDPPQRPHRAHRPGPPPRLPRPSTQGGAARSPPPPSLVSHAEAGGHLWRRRRGREGEGGGWRRRVG

SEQ ID NO: 204328 - protein, 155 aa, Triticum aestivum
  unsure (1)..(155): unsure at all Xaa locations
  Clone ID: PAT_TA_98746.pep
QPFPLQPQQPFPQQPQQPFPQQPQQSFPQQPQQPFPQQPQQPFPLQLQQPFPQQPQQPFPQQPQQPFPLRPQQPFPQQPQQSQQSFPQPQXSXPQQPSILQPQQPLPQXPQQPFQQAPTTIIPSNQNXQFPSNPXQPFPQXPHQPQQPYPQXQPG

SEQ ID NO: 204329 - protein, 195 aa, Triticum aestivum
  unsure (1)..(195): unsure at all Xaa locations
  Clone ID: PAT_TA_98747.pep
QQQPLPPQQQPPCSQQQQPFPQQQQPIIILQQSPFSQQQQPVLPQQQPVIILQQPPFSQQQQPVLPQQPPFSQQQQQQQQQQQPPFSQQQQPXVLPQQPPFSQQQQPPFSQEQQPSSQQPPFPQQHQQFPQQQIPVVQPSVLQQLNPCKVFLQQXQCSHVAMSQRPAXSQMWQQXSXCHVMQQXCCQQXPXIPEQ

SEQ ID NO: 204330 - protein, 86 aa, Triticum aestivum
  unsure (1)..(86): unsure at all Xaa locations
  Clone ID: PAT_TA_98748.pep
PPPSLLRPLDSSAAAGATRSTPPPPLSRXKVLRRXILSLXAFSXPRRRHAPTQXAXVREGYSCQXXXESXEGGXFLSXKGLGSLAG

SEQ ID NO: 204331 - protein, 57 aa, Triticum aestivum
  unsure (1)..(57): unsure at all Xaa locations
  Clone ID: PAT_TA_98749.pep
LXKFCQEFKIFACKNIPVDFNTFLLILRSFSQVDPSKTYWTYFPSHLKTSLNQEIYL

SEQ ID NO: 204332 - protein, 153 aa, Triticum aestivum
  unsure (1)..(153): unsure at all Xaa locations
  Clone ID: PAT_TA_98750.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTESGNTKDDLKLPTDDVLLGQXKTGFADGKDXILSVMSXWXKEQXCL

SEQ ID NO: 204333 - protein, 72 aa, Triticum aestivum
  unsure (1)..(72): unsure at all Xaa locations
  Clone ID: PAT_TA_98751.pep
LKPGGEIHFQMATERKESRNRRKSALCWQMWRIXIHPFINEIVPLWVTNTHIKKXQTESTCXKEATIXKEIP

SEQ ID NO: 204334 - protein, 84 aa, Triticum aestivum
  Clone ID: PAT_TA_98752.pep
SQLFEERRFRVYDAYVEDADVIMWVEEVERATVRTKAKYGSVKGTDRKILFNKLFPTANLDNIIIFMLIIYCSKLLITSFFVSP

SEQ ID NO: 204335 - protein, 109 aa, Triticum aestivum
  Clone ID: PAT_TA_98753.pep
QQPFPQQPQQPFPLQPQQPFPLRPQQPFSQQPQQSQQSFPQPQPQQPQQPSILQPQQPFLQPQQQLSQQLEQTISQQPQQPFPQQPHQPQQPYPQQQPYGSSLTSIGGQ

SEQ ID NO: 204336 - protein, 80 aa, Triticum aestivum
  unsure (1)..(80): unsure at all Xaa locations
  Clone ID: PAT_TA_98754.pep
MKNXTLVXILVVLQAIMXIRILSHAAXDNFPKCCDHCNSWSGYHFCDXVXXRCRDGCFXCHXVXTSPVNTFRCXDGRPVL

SEQ ID NO: 204337 - protein, 187 aa, Triticum aestivum
  unsure (1)..(187): unsure at all Xaa locations
  Clone ID: PAT_TA_98755.pep
SQXQPQPFPQQPPCSQXXQPPLSQXQQPPXFSQHXPPFLQQQQPVLPQQPPFSQQQXQFPQQQQPLLPQQPPFSQQQPPFSQQQXQPPFSQXXQXPILPQQPPFSXHQQPVLPQQQIPSVQPSILQQLNPCKVFLQQQCSPVAMPQSLARSQXLWQSTCHVMQHQXCPASWANPRTINATNAIRWQH

SEQ ID NO: 204338 - protein, 116 aa, Triticum aestivum; identical to SEQ ID NO: 134375
  Clone ID: PAT_TA_98756.pep

SEQ ID NO: 204339 - protein, 184 aa, Triticum aestivum
  unsure (1)..(184): unsure at all Xaa locations
  Clone ID: PAT_TA_98757.pep
PQPQPQYPQPQQPISQQQAQQQQQQQQILQQILQQQLIPCRDVVLQQHNIAHASSQVLQQSSYQQLQQLCCQQLFQIPEQSRCQAIHNVVHAIILHHHQQQQQQPSKPXPPNXQASGDNIHXGQGLLQSSQAKTQXAKGSVQXPQKXAXVSRKLRDXTLENXAXMLNXVQXPPKWSTTIXQFGS

SEQ ID NO: 204340 - protein, 68 aa, Triticum aestivum
  Clone ID: PAT_TA_98758.pep
RDVKFQYFGSSFVFFLTQVLAPSCLEFISFFCIRPKHRLQNTNMSFQPSFANLFTHMQFKFGLYISNV

SEQ ID NO: 204341 - protein, 183 aa, Triticum aestivum
  unsure (1)..(183): unsure at all Xaa locations
  Clone ID: PAT_TA_98759.pep
NQRHMPPTTLQTIPITXPFAVWGLDMVGPLKGGTHKQKNLLVMVDKFTKWIQDKPVKTAESGPVIDFISGVVHHYGVPHSIITDNGTNFTADEVKLWCKNMGIKLDYASVYHPQTNGQVEXPTILIMSGIKPRLVRFLKESNTHWVEELXSVLXWGLRTKPNRTXGFTPXFMVYDAHSVLPAT

SEQ ID NO: 204342 - protein, 156 aa, Triticum aestivum
  unsure (1)..(156): unsure at all Xaa locations
  Clone ID: PAT_TA_98760.pep
WSXCSDXIVGXAAPCLLXDGEWLPLSFLLRVLWGSXLAQPWRWRARLYQRPLLVVEPVTGFIFVSSRVLWGSALAEPWRWRWRARLFQRPSIVVETVAAFILISSRVLRGSALVVTSHLISTAGIPVGLLRYHILISPLLLFHVRISTPRTKSTFG

SEQ ID NO: 204343 - protein, 100 aa, Triticum aestivum
  unsure (1)..(100): unsure at all Xaa locations
  Clone ID: PAT_TA_98761.pep
CKXIARINSNYXPNQAXQLTLLQPNIRFPRDQSRLGLRIDMLSKGQIWDCQWKRHSKTRGRRVCFGAAWMQPAKVTRTVESQRQGQQRWALGQLEGPMSW

SEQ ID NO: 204344 - protein, 146 aa, Triticum aestivum
  unsure (1)..(146): unsure at all Xaa locations
  Clone ID: PAT_TA_98762.pep
MARAQVMLMAVALVLMLAAVPRAAVAIDCGHVDSLVRPCLSYVQGGPGPSGQCCDGVKNLHNQARSQSDRQSACNCLKGIARGIHNLNEDNARNXPPKCGXNLPYNHQVSKSTGTGVMGQRFVKPGAQAQSQPTWFPRKPNPNVGN

SEQ ID NO: 204345 - protein, 187 aa, Triticum aestivum
  unsure (1)..(187): unsure at all Xaa locations
  Clone ID: PAT_TA_98763.pep
XVPQPQQPQQPFLQPQQPFPQQPQQPFPQTXQPQXPFPQQPQXPFPQTQQPXQPFPQQPQQPFPQTQQPQQPFPQLQQPQXPFPQPQQQLPQPHQPQQSFPQQQRPFIQPSLQQQLNPCKNILLQXCKPASLVSSLWSIIWPQXDWQVMRXXXCQQLAQIPQQXLQCAAIHSVCXFIIMEQQQXQXH

SEQ ID NO: 204346 - protein, 49 aa, Triticum aestivum
  Clone ID: PAT_TA_98764.pep
LKAHTASIVCATKTVHLLHPSDEIVAYQAHLVQNAEARLYALNALNAAP

SEQ ID NO: 204347 - protein, 84 aa, Triticum aestivum
  unsure (1)..(84): unsure at all Xaa locations
  Clone ID: PAT_TA_98765.pep
VAPDLPSNEPXLGDLDCTHPXSRTLXRPVLLFIVTTSRCQDWLIWALVXFXGCGXVSQAXSPESNPNSPSPVTTMVGPYPTIES

SEQ ID NO: 204348 - protein, 153 aa, Triticum aestivum
  unsure (1)..(153): unsure at all Xaa locations
  Clone ID: PAT_TA_98766.pep
QILQQILQQQLIPCRDVVLQQHNIAHASSQVLQQSSYQQLQQLCCQQLFQIPEQSRCQAIHNVVHAIILHHHQQQQQQPSSQVSYQQPQEQYPSGQGSFXXSQQNPQAQGSVQPQQLPQFQEIRXLTLQTLXGMXKGLNPSKMAPTTIAINLY

SEQ ID NO: 204349 - protein, 70 aa, Triticum aestivum
  Clone ID: PAT_TA_98767.pep
LRPRCAGATAFSSPFAPLLQEHDMSELNKGFLALSHGPLENVTCVTGYDRNRFRCRVQIQVRLLCTHTSG

SEQ ID NO: 204350 - protein, 143 aa, Triticum aestivum
  unsure (1)..(143): unsure at all Xaa locations
  Clone ID: PAT_TA_98768.pep
PQQPFPLQQPQYQXQQPYQQXPFPQQPQQPFPQQPQQXFPQQPXQPFPQQPXQPFPLQLQQPFPQHPQQPFPQXPQQPFPLRPQQRFPQQPQQSQQSFPQPQPQQPQQPSILQPQQPLPXQPQXPFQQPQXXLSQQPVXXXSQ

SEQ ID NO: 204351 - protein, 51 aa, Triticum aestivum
  Clone ID: PAT_TA_98769.pep
ATSSDPLNCTRIAQPHTHHDDATFICSTYPSLYHDLLINYMIAERFSVGLY

SEQ ID NO: 204352 - protein, 136 aa, Triticum aestivum
  unsure (1)..(136): unsure at all Xaa locations
  Clone ID: PAT_TA_98770.pep
MARAQVMLMAVALVLMLAAVPRAAVAIDCGHVDSLVRPCLSYVQGGPGPSGQCCDGVKNLHNQARSQSDRQSACNCLKGIARGIHNLNXDXNARSIPPSSGVNLPLQHQVSNNRLQGLLMGDDSVQGLKLNQSNEF

SEQ ID NO: 204353 - protein, 165 aa, Triticum aestivum
  unsure (1)..(165): unsure at all Xaa locations
  Clone ID: PAT_TA_98771.pep
DIILKLADILQAGNLQNIQALTRARVPIVKLMDPDTGLSCDICVNNLLAVVNTKLLRDYAQIDQRLRQLAFIVKHWAKSRRVNETYQGTLSSYSYVIMCIHLLQLRRILPCLQEMEATCYVTVDDNHYAYFDQMDKLSNYGAHNNETLSSLLWAFFHXGAYQHDT

SEQ ID NO: 204354 - protein, 108 aa, Triticum aestivum
  unsure (1)..(108): unsure at all Xaa locations
  Clone ID: PAT_TA_98772.pep
SSTKFSTTKSSRCLLPRSPLLSTVSTPPSSLPPSTTTISXSRPSAQRSSATLSSPATRLRALPTLSPTRSPLVRQPTNSPSPTSPRVSTPSSTPNPPLVSLPSAASGV

SEQ ID NO: 204355 - protein, 158 aa, Triticum aestivum
  unsure (1)..(158): unsure at all Xaa locations
  Clone ID: PAT_TA_98773.pep
ITKISEVVSVVNNVNTSVGNTSVGEQEYTLYGKPTITEMLRGLTFQISANSFFQTNTXQADVLYKLIEDSAGLKGDGSXIVLDLFCGTXTIGXLTLAKSAKHVYGYEVVPEAIADAQKNAQVXNXLXNATFVQGDLXKNQAXXLAKEFPXXXIIISRF

SEQ ID NO: 204356 - protein, 164 aa, Triticum aestivum
  Clone ID: PAT_TA_98774.pep
MKWSSILLTLAATVAAAPPKPPKPSGPAGPPGYPPLPPSKPGQLPSSFKWTSTGVLVTPKDDERKIAGVKDPSIVFYKGAYHVFASSAKAEGYNLLYFNFTDIAKANDAPFFYLDQAPLGTGYRAAPQVFYFAPQKLWYLVYQDNNAAYSTNPDISNPTGWTRR

SEQ ID NO: 204357 - protein, 50 aa, Triticum aestivum
  unsure (1)..(50): unsure at all Xaa locations
  Clone ID: PAT_TA_98775.pep
HGQHGRHHXRXQKLLAKLPHRXSLXCXFXSLPAQGFSAVSFRPRLRLRFX

SEQ ID NO: 204358 - protein, 94 aa, Triticum aestivum
  unsure (1)..(94): unsure at all Xaa locations
  Clone ID: PAT_TA_98776.pep
EXAXASRAGXXAXXPRSITTAXPPPXXCXDASXXPPXSSSSMREGAGLGLAGGXGRDWGLXSWVGXKLLQHADAGETREEGXGCGGGGGGWSER

SEQ ID NO: 204359 - protein, 160 aa, Triticum aestivum
  unsure (1)..(160): unsure at all Xaa locations
  Clone ID: PAT_TA_98777.pep
PKSPQPPCRRISDSMARTKQTARKSTGGKAPRKQLATKAARKSAPVTGGVKKPHRFRPGTVALREICKYQXKSTELLIRKLPFQRLVREIAQDFKTDLRFQSSAVSALQEAAEAYLVGLFEDTNLCAIHAKRVTIMPKDIQLARRIRXXKALQSAIHASA

SEQ ID NO: 204360 - protein, 79 aa, Triticum aestivum
  unsure (1)..(79): unsure at all Xaa locations
  Clone ID: PAT_TA_98778.pep
MAAVSAKSIALLAAVVLVALVASAAGRIVDREEEFFLGSLAPSLAPAPAPAAAVGAAGAVAPGAWAVAAXVSLIAFLAH

SEQ ID NO: 204361 - protein, 127 aa, Triticum aestivum
  unsure (1)..(127): unsure at all Xaa locations
  Clone ID: PAT_TA_98779.pep
MTPPFRPSPSSXAPAPRGCXGERCAXXRDAWXLHHVRHNDVXXRLXSSCVLLYQPASFCSAXLLLLQHGRTPSLGRRRAPPIRPRRRGPQRVLQLRALRTAKPSRGPSPSTGRRARRDEGRNGRSAS

SEQ ID NO: 204362 - protein, 59 aa, Triticum aestivum
  unsure (1)..(59): unsure at all Xaa locations
  Clone ID: PAT_TA_98780.pep
HSRLTPWKQREEEDXXNHEXLKXXDXQXNXSHLXTQREAVSTDXTNILTXRANHFXXAL

SEQ ID NO: 204363 - protein, 122 aa, Triticum aestivum
  unsure (1)..(122): unsure at all Xaa locations
  Clone ID: PAT_TA_98781.pep
MAAATTVCSSPPPCHPSVPPLGHHRRHDYELQACPCEASSTTRRSPPDPFLPPCLPMQTEIQNMGWRSDGGLSLHMRGGGLFRSKGTEIVEAIEEPSVRSRGFXILDVGYHSKVTITEMNCM

SEQ ID NO: 204364 - protein, 136 aa, Triticum aestivum
  unsure (1)..(136): unsure at all Xaa locations
  Clone ID: PAT_TA_98782.pep
MARTKQTARKSTGGKAPRKQLATKAARKSAPATGGVKKPHRFRPGTVALREIRKYQKSTELLIRKLPFQRLVREIAQDFKTDLRFQSSAVSALXXRXEAYLVGLFEDTNLCAIHAKRVTIMPKDIQLARRIRGERA

SEQ ID NO: 204365 - protein, 105 aa, Triticum aestivum
  unsure (1)..(105): unsure at all Xaa locations
  Clone ID: PAT_TA_98783.pep
XXSSXIXPTFAYKSDEEIPNARWLGLVDSCDHNHAAEENYKCKEEGTHDEWSAVLGVKRVIGIICVTMLGLGTSPVGMVVVKISPVFASGGRHDPNYWSAAVSAP

SEQ ID NO: 204366 - protein, 67 aa, Triticum aestivum
  unsure (1)..(67): unsure at all Xaa locations
  Clone ID: PAT_TA_98784.pep
MGFIMEFXXKLILXLMXXPEQRDXEXXAHVXRMXXRXEXTXAVXXLALXXYXFWTFXXFNSQLSWDT

SEQ ID NO: 204367 - protein, 67 aa, Triticum aestivum
  unsure (1)..(67): unsure at all Xaa locations
  Clone ID: PAT_TA_98785.pep
GPSNQVAVNIGMLVVRIDIXGCSTRVACXMDDQXSSSCSRSTRSCXRTCIGCSRSXRSRPPSPCRRS

SEQ ID NO: 204368 - protein, 78 aa, Triticum aestivum
  unsure (1)..(78): unsure at all Xaa locations
  Clone ID: PAT_TA_98786.pep
GPCHPGXHXAXCXIXLETGTSHAXTXKAPWXFRTQPTXVXRAFGAXLPSPXQNLXXFIXRTLGMPNGXQFHHXXLRHH

SEQ ID NO: 204369 - protein, 61 aa, Triticum aestivum
  unsure (1)..(61): unsure at all Xaa locations
  Clone ID: PAT_TA_98787.pep
XXLVARSVPVLGDPXGFKNCXGLMWEXNCHXXFISAXLSPAKFXNPCINXLXTSXIXKTEX

SEQ ID NO: 204370 - protein, 66 aa, Triticum aestivum
  unsure (1)..(66): unsure at all Xaa locations
  Clone ID: PAT_TA_98788.pep
MPSLFKSNNQCCPSXRRIIXIFLGXVYWXXXLRVWENPLAIXLASSEHEQXLLYSAWPPSXXILDG

SEQ ID NO: 204371 - protein, 88 aa, Triticum aestivum
  unsure (1)..(88): unsure at all Xaa locations
  Clone ID: PAT_TA_98789.pep
LXXFSPVAXISXSXYRPEEXPPRXXLLLLLXPPXLXXPPXGLVAAPXPGLAXLFPEEGFDXPAXXXGXXRXRCELFRIXGRXKGGRIR

SEQ ID NO: 204372 - protein, 135 aa, Triticum aestivum
  unsure (1)..(135): unsure at all Xaa locations
  Clone ID: PAT_TA_98790.pep
PIARGPWGRKRPLNVGRGGRRAQASHALDSDLEAFSHKPAHGSFAPLAFQPSAMXNCVNQRFLSYXVELLSXHCHQXVKLNXSHDGLPPAHVXYXWXNNPTLGEFCFTMIGRADIEGSKSNVAMNAWLPQASYPC

SEQ ID NO: 204373 - protein, 216 aa, Triticum aestivum
  unsure (1)..(216): unsure at all Xaa locations
  Clone ID: PAT_TA_98791.pep
RLAKHHQPRDQRKPQGRPXWPSSLPNRPATNWXPNRRXRGGMGMGSGEGRSLLKQLRXAVGRPPVGRGKTSRSQXSLVLQTRKGXKGSXLXKGRRPPTGSSSVIKNFXKXLXPPXGXPXKXXFPKGPRAGXXLGXXPNFQRAXLGXXSXFPNFXXNXXXEXLXPQXSGNXILMAPKPQTKXKIXFKXVSWXPXLEXXFSQKGRXPXKXXXFPXGEX

SEQ ID NO: 204374 - protein, 142 aa, Triticum aestivum
  unsure (1)..(142): unsure at all Xaa locations
  Clone ID: PAT_TA_98792.pep
SFPFXSTWXISXIXSKXLXVFSKNSRXRVGXXKLGPPSSGCKVLATFFMHFGHPXGSIPLCXQTXKRXPNSCSPYTSSPLSGGGREDKSPLLISAPYNRDHYEGCLFCGPLVVTKEGXPSSFHTVGDNNNDGGKLLYAWPKC

SEQ ID NO: 204375 - protein, 162 aa, Triticum aestivum
  unsure (1)..(162): unsure at all Xaa locations
  Clone ID: PAT_TA_98793.pep
XAKLIKKHPSTTSSXKAXQTFXEGWXXGTXGRXXGTXNTXXSLTSLGXFLKGSSATLGLTKSQXLLARRFXTTGNLKGDXRNKGHXKKEQXTRGTSPKIIXARQKXXFXDGYRHPPKNFYADSNIPFPGXPGPVAPCCXNHXHKXARQRLRLAKLXLXGEXL

SEQ ID NO: 204376 - protein, 166 aa, Triticum aestivum
  unsure (1)..(166): unsure at all Xaa locations
  Clone ID: PAT_TA_98794.pep
MAPKAAEKKPVATAEKTTAGKKPRAEKRAPASXKAGGXEGKTRGKKKGNKGKKSVEXTYKIYIFKGCLKQGCNPRTLGILPPKANXQSIXTPLIKRTXFEKASPGKSAKLGPLTTKKANNXXXRGXQXFVRXLLPRELRXQGVXXXNKGXNKXNXSKTLFSLQGCS

SEQ ID NO: 204377 - protein, 141 aa, Triticum aestivum
  unsure (1)..(141): unsure at all Xaa locations
  Clone ID: PAT_TA_98795.pep
SRREHEHGXXXRSEEEDDDQRHXRRXXGSGSESESXSEEXQDQQRYEXVXARLSRGSAFVVPPGHXVVXIAXSRGXTNLXVVCFEIXAERNERXWXXGRNNXIGXLXSPAQXLNFXXPAKEVHEVFRXKDQQXXGFVAGPE

SEQ ID NO: 204378 - protein, 185 aa, Triticum aestivum
  unsure (1)..(185): unsure at all Xaa locations
  Clone ID: PAT_TA_98796.pep
XGLIPGARRHDEHRQQHLPRPICSRYLLXQPRQQALGQREERXRPWSRTPWLNVILGTXVFPILLTNGYXNKGYPGRVTNQANREGPYGETGFNNKREPLXGHQEVDCREGSLQEVLPLMTXFTCMYRATPXPGXRSRGXPLTVLTXKCREXISXKXELXXKPKXGKGXMGKSPTGNXAPGXXPG

SEQ ID NO: 204379 - protein, 27 aa, Triticum aestivum
  Clone ID: PAT_TA_98797.pep
TKKRSSKKKKKKKKKKKKKKKKKKKKK

SEQ ID NO: 204380 - protein, 118 aa, Triticum aestivum
  Clone ID: PAT_TA_98798.pep
ISTTRDCLFLMLPLATAAILGSWLLEAQLCPIHFKIMQNPCRLLRSHRKEAQVLPSTSNGSQNKRKQLSTPAASVGSSQIRGSMHISAPTSARSSSSGIRPYKAAKAPRISNGRNAAG

SEQ ID NO: 204381 - protein, 157 aa, Triticum aestivum
  unsure (1)..(157): unsure at all Xaa locations
  Clone ID: PAT_TA_98799.pep
MYTARKKIQXKDKGVEPSEFEDTVAQAFFDLENGNQELKSDLKDLYINTAIQMDVVGNRKAVVIHVPYRLRKPFXKIHVRLVRELEKKFSGKDVXFVATRXIVXXPXKGSAVQRPRTRTXTVVNXGTLXVSGPTXNXGXXVKTVGWAKASKFWPKGG

SEQ ID NO: 204382 - protein, 171 aa, Triticum aestivum
  unsure (1)..(171): unsure at all Xaa locations
  Clone ID: PAT_TA_98800.pep
IAQIFYVIASISVTCTFLLSPWIFPTHSKEAEPTSSSGSNPEKAHGLNHSVFLTGVTYTMFWCLLQLLLQQPINAIPVLLILLQIISSVIYFSLGEIIAXQWVQVVAMQFLGMTGHFGLGNTNSLASIDVAGAFIGISXSYSTVLSGVLMFNITYGVSAVIPPGWVGHKSG

SEQ ID NO: 204383 - protein, 130 aa, Triticum aestivum
  unsure (1)..(130): unsure at all Xaa locations
  Clone ID: PAT_TA_98801.pep
MEELRRLRRSPLLQAPSXEATYRACTXIPYXXXLRQPPQRPAPSEIQVDHLFLXSVPSFXQXAENDPTVPDAPXKAEKFAQRYTDMLEELKKXPRGGHGGPPXDCILLCKAXVELILKXIWGFNDIFKEG

SEQ ID NO: 204384 - protein, 165 aa, Triticum aestivum
  unsure (1)..(165): unsure at all Xaa locations
  Clone ID: PAT_TA_98802.pep
MAASLQAAATLMPAKIGGRASSARPSSHVARAFGVDAGARITCSLQSDIREVASKCADAAKMAGFALAXSALLVSGAXAEGAPKRLTFDEXIKSKTYMEVKGTXNANQCPTIDGXVDSFPXXGGKYXMXXFCLEPNSFTXKGEGIXKNERRAFKKTKLMNRXTXT

SEQ ID NO: 204385 - protein, 136 aa, Triticum aestivum
  unsure (1)..(136): unsure at all Xaa locations
  Clone ID: PAT_TA_98803.pep
DVFAFGAFLLEVTCGRRPIEEDEENNRVMLVDWVAEHWRQGCITKAADIRMPNSFGLDQVSLVLKLGLLCSHPLPNARPTIRQVMQYLDGDMPLPEFSPXYLGSTMLEQMYKRGXFNKNAMSYVSLGVISDLSGGR

SEQ ID NO: 204386 - protein, 123 aa, Triticum aestivum
  Clone ID: PAT_TA_98804.pep
TPAIPSACQKPFSCLLTSDRLLGPFIGRHASGEDGEGQLLGSSPPGAAGLPLLLLPRPRGGGRGQRQPQDVPAEGGSSRRRVQRWWAGHADDGGGGGRRRDASAAERRRGDVGQKGGPCKTQD

SEQ ID NO: 204387 - protein, 201 aa, Triticum aestivum
  unsure (1)..(201): unsure at all Xaa locations
  Clone ID: PAT_TA_98805.pep
RLKPTGAKQQLSXFLAMGKLPXXPTPGXXNLXPXAGWAGAXXAGPGGQPGRPGGRGCRVXRNXPGQGGWKLTLAPRCNQVXRPXGARGLKLPPLGGWGWLASGXLPLGPLNGGRGLPKPPARXPAKEPTLAXLALKSKQGRKRAXGGQSKPKPSFAWESPGQSCGGQTIPYGHQAKETDLLQXALSVEIKNHFRMHGEEAK

SEQ ID NO: 204388 - protein, 51 aa, Triticum aestivum
  unsure (1)..(51): unsure at all Xaa locations
  Clone ID: PAT_TA_98806.pep
RXSPXXXFSLLSXPVXXPPXLDXHPWQAPGASCLGRGMGXXWTLLQVVYIT

SEQ ID NO: 204389 - protein, 153 aa, Triticum aestivum
  unsure (1)..(153): unsure at all Xaa locations
  Clone ID: PAT_TA_98807.pep
MAPKAAEKKPVATAEKATAGKKPKAEKRAPASKEAGGEGKTRGRKKGSKAKKGVETYKIYIFKVLKQVHPXDVXISXKAMXIMNSFINDIFEKLAGESAKLARYNKKPNITSREXFKTSVRLVLPGEAXQSKPSPRATKXVNKFTHPNKLRLV

SEQ ID NO: 204390 - protein, 138 aa, Triticum aestivum
  unsure (1)..(138): unsure at all Xaa locations
  Clone ID: PAT_TA_98808.pep
KDRHYHQVRHRGNSPIHHQLCFAILSFALCCKAQRKLKLCRLIDLKRVKEDVITCSLPXXLPLDLTLFMSKPGSIFFACRHHPFVGLYKCIXCLICSIIFPDVLLHIYIYXYIYIYIYIYIYIYIYXLXVICLXDPST

SEQ ID NO: 204391 - protein, 74 aa, Triticum aestivum
  unsure (1)..(74): unsure at all Xaa locations
  Clone ID: PAT_TA_98809.pep
PTXIXLXSXCLFGDGFGXSFMVLXXLXFAFELXWXRDDXADYKVXHDSXTGMXEXLRXLQXDQXTVFTRVVCGR

SEQ ID NO: 204392 - protein, 231 aa, Triticum aestivum
  unsure (1)..(231): unsure at all Xaa locations
  Clone ID: PAT_TA_98810.pep
EVIPNPATRKSPIFKKPLALQXPIPGRKRRNGQTPKGXFLSTIEPFGRAPPGRGAQSVDWELVTKGTPGCPPGPGGXKLSGRXFLQPGGRXGGSRQRSGXKPAWQLTKGQXAFPTGGEFPRXFNVAQRGGXNFXPXGQTGKPGGAKSNLRGEESXPRTKKFRPKSNNQRPGEFSPWGKRPGXKQQTGSQFFKLETSPGKFXSNXKARWXLRXRSSKGHWRRQRTFQKXGVX

SEQ ID NO: 204393 - protein, 148 aa, Triticum aestivum
  unsure (1)..(148): unsure at all Xaa locations
  Clone ID: PAT_TA_98811.pep
MGACNSCXATXVXAVXGASAVGEATAARVVLADGQLQRFPGGNRASXXMKXXAAPAGACFLXSXDGLXLXGXVXXVVGDEXLQAGQVYFVLPPXMLRXALQAXEWARSHSRQXRAGXXTRXPLVFPTRWPGERGGPAAVGNLGSSQFQ

SEQ ID NO: 204394 - protein, 70 aa, Triticum aestivum
  unsure (1)..(70): unsure at all Xaa locations
  Clone ID: PAT_TA_98812.pep
GVVPXLQLXGAERRAERHHKTPPPARELNHPSSPWVXRPLSVASRRLXPLVLSQKCGXPASSWPRAVVPS

SEQ ID NO: 204395 - protein, 107 aa, Triticum aestivum
  unsure (1)..(107): unsure at all Xaa locations
  Clone ID: PAT_TA_98813.pep
SYXXXSXLTFXSIPXVLISRXLRILTAPXCPVLICSAXLAFPXGPNPQGLSQFGNSXKGFPXFXAFRQFXXCPXGSFPRGXAYRRRPGVXEAERRXXGGVWRDWGXI

SEQ ID NO: 204396 - protein, 118 aa, Triticum aestivum
  unsure (1)..(118): unsure at all Xaa locations
  Clone ID: PAT_TA_98814.pep
MSCCGXNCGCGAGCKCXNGCRGCKXMFPDVEATXGAAGMVMPNXSXKGNSGGFETGGGENGGCDCTTAVXTGCGCSCCNCKLSRQRRRAARARLRRQLVKQTTTTTTISRLGPPRALK

SEQ ID NO: 204397 - protein, 88 aa, Triticum aestivum
  unsure (1)..(88): unsure at all Xaa locations
  Clone ID: PAT_TA_98815.pep
QYXKXCLEXCWTQSTHDXTTXILVSXSWRSLTXWXXWVSSXEQXVEQGGKTFLLXCGEPWRRTAGGNPRLGGGAGRGECMNRKPTDRL

SEQ ID NO: 204398 - protein, 133 aa, Triticum aestivum
  unsure (1)..(133): unsure at all Xaa locations
  Clone ID: PAT_TA_98816.pep
LTSVQSXWXXPXGAXWCWRWCXPAWWWRAXDVXRHILXQRXQDADAVLXXXXKAXRXPGLXNXIKXCWRRQQQPDRRXICGCSRXSQXXSXGXXINXAGXLPQXKVAXLXXSPXSMEXFXDXXNXLALSXXXP

SEQ ID NO: 204399 - protein, 138 aa, Triticum aestivum
  unsure (1)..(138): unsure at all Xaa locations
  Clone ID: PAT_TA_98817.pep
MARTKQTARKSTGGKAPRKQVATKAARKSAPXTGGVKKXHRFRPGTVALREIRKYQXKSTELLIRKLPFQXRLVREIAQDFKTDLRFKSSAVSALXEGAEGYLVGLFEDNNLCAIHAKRVXIMPKXIKLXRRIRGXXG

SEQ ID NO: 204400 - protein, 150 aa, Triticum aestivum
  unsure (1)..(150): unsure at all Xaa locations
  Clone ID: PAT_TA_98818.pep
MARRSGGGRSSRPAPRAAPSEKPXAPARQAPPTATTQNSGGGIMXGIGSNIAQGMAFGTGSAMAHXAVDAVMGPRNIQHETGVGEXAASMTPMDNAADDKCXKPFKGLQXCIXHYGSDINKWQXQLEMLNXCPXGGARAGLSYCVGKLPL

SEQ ID NO: 204401 - protein, 182 aa, Triticum aestivum
  unsure (1)..(182): unsure at all Xaa locations
  Clone ID: PAT_TA_98819.pep
ASHTWTHAHLNSLTHDEIDEEIEALELALWKIIGAVPAIIRPPYGEANDDVVQYLNNKHGLTVTNWDVDSADSAGATPSASISTLSAFKYPDPHMPLMHETYQTSVEMVTPQILPIYRKQGYKLMTXSQCLSGVQLINFKAKDKKETKLWPCDQVTYLAKRKLGIELRECKKLGFGGPKFQG

SEQ ID NO: 204402 - protein, 135 aa, Triticum aestivum
  unsure (1)..(135): unsure at all Xaa locations
  Clone ID: PAT_TA_98820.pep
SLTANNNLSLGILPDPSSXPPTATNGSTRXQQRGNQRPKPELTRXLSFPMTWXCXRRCSFTPGDKITLQXGLXPCLPPSFXFSSLFSYVSPCHGKXKQWXPXSSWFVXRQMDSAQGPLSGLKEXWXPKAWAGLPI

SEQ ID NO: 204403 - protein, 131 aa, Triticum aestivum
  unsure (1)..(131): unsure at all Xaa locations
  Clone ID: PAT_TA_98821.pep
NSPSISTPFNKQWPKRKTRXXAAEXKGXKAAXKPPRGKKPKAXXRLPEXXTASKDAGGXGKTRXRKKGTMAMKGVXXYNIYIFKVLXQVXPGIGISSKACHHELLINXIFENSPXNRQTRKVHKKPTXTLG

SEQ ID NO: 204404 - protein, 59 aa, Triticum aestivum
  Clone ID: PAT_TA_98822.pep
IISLSVKDKLQIIHKTTKTKITRMEMKKDNAVPNAPTVVREVLVISQHMLPTGRRINSL

SEQ ID NO: 204405 - protein, 173 aa, Triticum aestivum
  unsure (1)..(173): unsure at all Xaa locations
  Clone ID: PAT_TA_98823.pep
FGXPGXXSRXLXPXXPFPWHGXVNXVXXXVXXFXVGXYNALXPXVALLTKXAPXSAWXSXXXPXFPRLQRXXLLFLRRPRGNCFRCLXPYHRIXSCRNAACCLLCGEIGHKAWGARSGSRXPRLLLRLQSPLPLGRAPLVPAAWWCFPPNSRPRSPAQENHGGAGRGEEDGGL

SEQ ID NO: 204406 - protein, 108 aa, Triticum aestivum
  unsure (1)..(108): unsure at all Xaa locations
  Clone ID: PAT_TA_98824.pep
LPAYKNGGTEVXEAKTXAGXXTPSMGYATTKFADACLRRVXGDAXIWECSYIASQVTELASSRPKVRXAGAXVEESAARAANEFXKGGLEXAKAXSPRDPQRGRLRNK

SEQ ID NO: 204407 - protein, 150 aa, Triticum aestivum
  unsure (1)..(150): unsure at all Xaa locations
  Clone ID: PAT_TA_98825.pep
MGSKPTAKLMAGETKXRXEEKTGXXXDKAGKHGGTKQKGGXXGXGTKQKGGEARTRXGQTGQAGKERXAXSXXQTXSFLXEKTEXGKQXXSXXXQYXKVSPRRRAVXKESAVXXKDKTXSXVQQAGXTVVTPVXGAKDPVPWGAKHKPHR

SEQ ID NO: 204408 - protein, 93 aa, Triticum aestivum
  unsure (1)..(93): unsure at all Xaa locations
  Clone ID: PAT_TA_98826.pep
LFAXXXCRSXCGSPFLGYLXXPDXEAVAIGAVXXPSSKSAQCRLPAGXPALEXDHXLTGLQDFPXXXXPPPPPPPSGMCGIXCLEKKKKKTRD

SEQ ID NO: 204409 - protein, 132 aa, Triticum aestivum
  unsure (1)..(132): unsure at all Xaa locations
  Clone ID: PAT_TA_98827.pep
MGRTKQTXRKSNGGKARGRAGNKAARKSAXGNGGVKKPHRFRPGNVALREXRKXXKSXELLIRKLPFQRLVREXAQDFKNDLRFQSSAVSALQEGAXGXTXGXLQXTXSAPXXAKRVNIXPRNSPAASGREG

SEQ ID NO: 204410 - protein, 64 aa, Triticum aestivum
  unsure (1)..(64): unsure at all Xaa locations
  Clone ID: PAT_TA_98828.pep
VIVFERXXAAQLXCCXGQHXHHXGXHXXLLVEXPHLVXLLLPPYXTXCSVTFXPDXADVCCXDS

SEQ ID NO: 204411 - protein, 108 aa, Triticum aestivum
  unsure (1)..(108): unsure at all Xaa locations
  Clone ID: PAT_TA_98829.pep
XSTVTXSIXHXARGTLSQAXGVKTTXXRRTGXGFSSXXRPAXVEVLLETXRWXANALXAXIINGKTXDIXLHPNCXXTCGRXDXTDXIXRWIXSXXCNGSTKXDLNSN

SEQ ID NO: 204412 - protein, 136 aa, Triticum aestivum
  unsure (1)..(136): unsure at all Xaa locations
  Clone ID: PAT_TA_98830.pep
LTEILPSPXLXPSAVSTLVPXVLHLXRRARXXDALGDAEERARGVEEERKRRRSGVGXHDVAGPDDLDTFDSNHXASHNLRXRHRTLRRDRRHPCFPVPSGTPAVFLPTPQSRGGFRDGATAMAAVTRRETRSRGA

SEQ ID NO: 204413 - protein, 163 aa, Triticum aestivum
  unsure (1)..(163): unsure at all Xaa locations
  Clone ID: PAT_TA_98831.pep
MAGEXDLXLLGLLVNPFVNRVRLVLHIKGPELPVIXXDXWTXAKLLLRYXPVXKKVAVLIXNXLPLCESQVIVKYXTKAGXRRXAILPXXPXPAQRRFWAASRQVPRLGHLLARRREGESPLKPGARATRRPIPGKPFAIGSNRRVKISGWRRRFLHPGKPLC

SEQ ID NO: 204414 - protein, 128 aa, Triticum aestivum
  unsure (1)..(128): unsure at all Xaa locations
  Clone ID: PAT_TA_98832.pep
SSAIWRRQQAMGRXXKKXACVXXGSXYIXSALVXXCWRMVRRQDHRXEPDDTEKNAHLKALAGXGPWSPPRXSEXXGQLXXAVXGXDYXFLVPLRXNXXRRNXXRXXLHRASTXQSTLXXSXXAIGGR

SEQ ID NO: 204415 - protein, 173 aa, Triticum aestivum
  unsure (1)..(173): unsure at all Xaa locations
  Clone ID: PAT_TA_98833.pep
NCCVREAEMPLPAMFIKVIVMMLXXYPRCCCIPPAVAWVISWFGXRLACLRSPRCPLXPSXTRXIATNPSPGNHGRXYSLQDFIVFSYSYWVFDLAHVSKDGWITXAMVIFALRNGXALFVFXLYFXLVRGSGDGPKIAMSTGWRSXLSFVTLIHFSLSLSDSAARDPCSRAP

SEQ ID NO: 204416 - protein, 129 aa, Triticum aestivum
  unsure (1)..(129): unsure at all Xaa locations
  Clone ID: PAT_TA_98834.pep
RVDSPGPDXXVDXHXVXTDEXRQHAXPLRLXVRKPWTXPPRGRXFPPXARSGFXAXXPRSARPPPCIXGXDAGAEXXLLGLSGCVDRSMRRLTWIRAGXHSGAALYIYWMXASKQRSPCVIAVPNSCSR

SEQ ID NO: 204417 - protein, 148 aa, Triticum aestivum
  unsure (1)..(148): unsure at all Xaa locations
  Clone ID: PAT_TA_98835.pep
QIFVKTXTGKTSLWEVESSDTIXNVKAKXQDKEGXPPDQQXLIFAGKQLEDXRTLADYNIXEXSPTXHXVLRLRGGMQIFXKTLTGKTITLEVESSDTIXNVXARSQGGHSPGPAAPDLCWAAGGWSHPRRLHQSTLNYSVFVNCPVV

SEQ ID NO: 204418 - protein, 141 aa, Triticum aestivum
  unsure (1)..(141): unsure at all Xaa locations
  Clone ID: PAT_TA_98836.pep
RHTTTTASTQQEXEEGSAVLHFYFYTXGXLRHHASSHVXGXRRRXGXAVPXQXLXRARXAXEXALNQVXIRXIXRQLXELVXKRAAHERHXHILKXGRSXSXLLXHINNXGRXTNXSXTXXGGTXXPPXKXPXXXWCLSXP

SEQ ID NO: 204419 - protein, 94 aa, Triticum aestivum
  unsure (1)..(94): unsure at all Xaa locations
  Clone ID: PAT_TA_98837.pep
MGYSKNXXXXLFAMLFLXPGVLGSEPDXLXDFCVXDLXGRAVSVNGHXKAMSEXGDXFLFXSKLAXAGNXQPEWSGVXXLXXAEWAGXXTLGVS

SEQ ID NO: 204420 - protein, 137 aa, Triticum aestivum
  unsure (1)..(137): unsure at all Xaa locations
  Clone ID: PAT_TA_98838.pep
PKXPXHEHELRXXGSWRDGAVQAXQLXHHXDXRRPRRAXHAVXLRDXRQRSWPAAXRIPXXXGGXGGGMLXPPMRPTXAFXXGRGKXRAXLIWXKYNNRGSCXLRGPSXXSSXCGXAHRXXLVPQXNXFXSPQTRXR

SEQ ID NO: 204421 - protein, 67 aa, Triticum aestivum
  unsure (1)..(67): unsure at all Xaa locations
  Clone ID: PAT_TA_98839.pep
VXAQRFLERETEXETYPQMVCAICQXHCESXIEQTFRIXIRDDYEALANIPCTARXXFKQISGLNFK

SEQ ID NO: 204422 - protein, 79 aa, Triticum aestivum
  unsure (1)..(79): unsure at all Xaa locations
  Clone ID: PAT_TA_98840.pep
MSCCGGNCGCGTACKCGNGCXXCNMYPEVEGAGANLLVSATAXHKASSGGMEMAAENGGCGCTQCKXCGTSCXCSCCSC

SEQ ID NO: 204423 - protein, 124 aa, Triticum aestivum
  unsure (1)..(124): unsure at all Xaa locations
  Clone ID: PAT_TA_98841.pep
RRPEHKMANVPAXAXETAASARXREXCKPHEFVKATPRTSSAPARWSFQSGVDIVXDCKVQRSCHXLMXXGYYXKAGSMAMXIYLXQGIXIGGFXKLXWPSEERSPHPNFSXAXGGVPPTSSXV

SEQ ID NO: 204424 - protein, 46 aa, Triticum aestivum
  unsure (1)..(46): unsure at all Xaa locations
  Clone ID: PAT_TA_98842.pep
SYIXVGVRDVTSACIGFXIXTXGTVIQTXAPDXEXHXERPXRXEXH

SEQ ID NO: 204425 - protein, 122 aa, Triticum aestivum
  unsure (1)..(122): unsure at all Xaa locations
  Clone ID: PAT_TA_98843.pep
MXARRAHAAXGLGLLVXXLVLSAATAPXEGAVANCGXVVSYLXPCIXYAMGXVSVPGGGCCXGVRXLXAGAGNPAERKNNCTCLKQXANGXGGIXPKLLAXIPRKXGVXIPYAIXQGTIAPR

SEQ ID NO: 204426 - protein, 80 aa, Triticum aestivum
  unsure (1)..(80): unsure at all Xaa locations
  Clone ID: PAT_TA_98844.pep
MENASNXEMLPPALPLGXXIGASSAGGGPSAARAVRQSGFXKRXEXYFLVKPECLXRPXDLPFPSRFGKMCVGVLRLLHD

SEQ ID NO: 204427 - protein, 111 aa, Triticum aestivum
  unsure (1)..(111): unsure at all Xaa locations
  Clone ID: PAT_TA_98845.pep
MAGRXGGDRKKXVTRSVKGGLQFPXGRIGRYLKEGPLPRXASGPGPRLTRDVLXYSXAEVLEACRQTPVXGNXKXRISXXXLLLXXPXRTXAREVXVGXTSPPXGDPNXNS

SEQ ID NO: 204428 - protein, 72 aa, Triticum aestivum
  unsure (1)..(72): unsure at all Xaa locations
  Clone ID: PAT_TA_98846.pep
ASSMPLIKVXFLGYXLXVNLDVGQXKTLEVHLAPDHIRSIHKCPVLVDDVDDDDEAPVVXXVVHQATRPITS

SEQ ID NO: 204429 - protein, 116 aa, Triticum aestivum
  unsure (1)..(116): unsure at all Xaa locations
  Clone ID: PAT_TA_98847.pep
SKIPSPLFRSYSXMSGRGKGGXGLGKGGAKRHRKVLRDNXQXITKPAIRRLARRGGVKRISGLIYEETAXCSRXFLENVIRDAVXYTEXARRXTXTXMDVVYALKRQGXTLYXFRG

SEQ ID NO: 204430 - protein, 54 aa, Triticum aestivum
  unsure (1)..(54): unsure at all Xaa locations
  Clone ID: PAT_TA_98848.pep
SXXFTHTPTKXQXKHTTSYFCHGSSPCSRRRDLGPAGGGACAVCGNGARGGXGC

SEQ ID NO: 204431 - protein, 119 aa, Triticum aestivum
  unsure (1)..(119): unsure at all Xaa locations
  Clone ID: PAT_TA_98849.pep
EFTSSXHASXPXAQNXXAVNXTNTEXVXKCSVPQPKXKVVXIHEPRVFXNKXCXXTXKXEDXHDAACEYHPGXCGFHDRXKGGRFXHVXVKEFXXFMXIPPRXKGXNNPCFTHDSCIKS

SEQ ID NO: 204432 - protein, 76 aa, Triticum aestivum
  unsure (1)..(76): unsure at all Xaa locations
  Clone ID: PAT_TA_98850.pep
LKXPINDVKWMRXILTERFXFSXXXVLILTDEEXGXXRXPTKGNIXMGMHWLVXXCSSRDSLVFQFSGAGASPPLR

SEQ ID NO: 204433 - protein, 69 aa, Triticum aestivum
  unsure (1)..(69): unsure at all Xaa locations
  Clone ID: PAT_TA_98851.pep
RRNGRLRKERDWEQYTSXKELLLALVGEVGELSEIFQWKREVPXGCPGCNKRXXHLRXGLSNXLLTLPH

SEQ ID NO: 204434 - protein, 107 aa, Triticum aestivum
  unsure (1)..(107): unsure at all Xaa locations
  Clone ID: PAT_TA_98852.pep
KEXISXPSLSFXDLLXLPPETWEVKCXILVTRGNXLXHTVILRVRPRRFNDDTLSXHWAYFRMSRAXTVAIHIQMTGXSHHQETPTXXDSKEYAVXITIVINCXNLL

SEQ ID NO: 204435 - protein, 70 aa, Triticum aestivum
  unsure (1)..(70): unsure at all Xaa locations
  Clone ID: PAT_TA_98853.pep
KXXWXXAXGXXKRRGPXLXRXXTEKYWXSXSLLRWXFFXVELGVXSXLRKLXXRERNRGLXSFGXGIPAA

SEQ ID NO: 204436 - protein, 59 aa, Triticum aestivum
  unsure (1)..(59): unsure at all Xaa locations
  Clone ID: PAT_TA_98854.pep
QPQACERHRSVPSEAQDRDDLXXQPKMGRRWWWLXPXRPSPXXMXTRXCXAGXTHTXRX

SEQ ID NO: 204437 - protein, 87 aa, Triticum aestivum
  unsure (1)..(87): unsure at all Xaa locations
  Clone ID: PAT_TA_98855.pep
AAYGTAKSGVGVASMGVXLPELVXKSIXPVVMAGXLXXYSLIIXVIISTGXNPXGKPYFXFYXYAHLSXGLACGLPGXAXGXAIFPQ

SEQ ID NO: 204438 - protein, 176 aa, Triticum aestivum
  unsure (1)..(176): unsure at all Xaa locations
  Clone ID: PAT_TA_98856.pep
MAPKVAVAKKGDAXXXAAKVAKAXKSGSINKTAKKIRTSVTFHRPKTLSKARDPKYPRXSTPGRNKLDXYQILKYPLTTESAMXKIEDNNTLVFIVXLKGDKEXRLXALSXKMFDIQXAKKGNTLXXPDXKQEXVXVKLTPNYDAPDVQRASYKSTGRVLQIRLCPFLGVGNFLFQ

SEQ ID NO: 204439 - protein, 177 aa, Triticum aestivum
  unsure (1)..(177): unsure at all Xaa locations
  Clone ID: PAT_TA_98857.pep
PXNVSDLPPSVDWRXXGAVTGVXDQGXCGXCWAFSTVVSVGXINXIRTGXLXSLSXQELIDCDXGXKKRCQXGLXXXALXYIKXKXGXIXEXANXXAXPKGTXXVXKSGPKNXPXXXEXXQGNQKRXRXKNXEGXGQSGGAKXTPFLXLLRXNGKXVXXSTPXGVFTXNXGXGAPPG

SEQ ID NO: 204440 - protein, 134 aa, Triticum aestivum
  unsure (1)..(134): unsure at all Xaa locations
  Clone ID: PAT_TA_98858.pep
MAPXAXKKPAAAEKTPAXEKTTAGKKPXAEKRPPKSKEGGADKKKKKAXKSVETYKXYIFKVLXKQVHPDIXISSKXMSIMNSFINDIXEESSPXKSAKLAPLQQESPTSRPRGDXRPPSXLVLPXEAPNNAVF

SEQ ID NO: 204441 - protein, 139 aa, Triticum aestivum
  unsure (1)..(139): unsure at all Xaa locations
  Clone ID: PAT_TA_98859.pep
XYXWXXXKXLGWGKLLXRGRXTLTTEXHWNCLCALMXRKGAGHVVNPSNWAHPLTPLDXAYEVXQPLLGMXXWSSAXVAPGXVHAKRLXXDCAVRXPXXALSFDXTXFDRTGLSLTSXXXKXSVDXGXFEAILFSCVWY

SEQ ID NO: 204442 - protein, 204 aa, Triticum aestivum
  unsure (1)..(204): unsure at all Xaa locations
  Clone ID: PAT_TA_98860.pep
RLPFTKKQWYDIKAPLLFNSRNVGKTLVSXDTGXLXLPQEGLXHXVFEXSPXADLQNDXDQAYRKIXRLRAEDVXGMNVLTNFWGMDFTTDKLRSLVRKWQTLXEAHVDVKTTDNYMLRMFXXGFTKXRRPNQVXAHXAXAQASQXXQVRRKDGLEIMXXQXLQXCXLXGALXXKFIPXGXIWXRRIEXRATSSIFPSKNVFXX

SEQ ID NO: 204443 - protein, 128 aa, Triticum aestivum
  unsure (1)..(128): unsure at all Xaa locations
  Clone ID: PAT_TA_98861.pep
MGAYKFVSELWRRKQSDVMRFVQRVRCWEYRQXQPAIVRITRPTRPDRARRLGFKAKQGYVVXRIRVRRGGRKRQCPXVLSMVKPKHQGITQLXKFQKNKKSVAEQKAGRXLGGXLRVPTPYWVNEDS

SEQ ID NO: 204444 - protein, 131 aa, Triticum aestivum
  unsure (1)..(131): unsure at all Xaa locations
  Clone ID: PAT_TA_98862.pep
XNXRGIQRESLVPTXHLXLXSSXXXAPXIFSTXXIVXLXGXXPTRXSLFXXXALFVXXELXLXLALXLVGPQTLEGXGLLGEAGGXGXPARVGXRRGXRRLXXRAXXGGPPRLGMSRRHDAASSSSSSRPL

SEQ ID NO: 204445 - protein, 111 aa, Triticum aestivum
  unsure (1)..(111): unsure at all Xaa locations
  Clone ID: PAT_TA_98863.pep
LXHKHRSEXRXEAVXCRPLFLKKIXXVXCXGXGXXHXCRXRPLGLLLXLCDGPXXASPPTXXICLXXLXFGYINPHESSTRINXSXXNXISTPKGASAXLSXXRRNWVPFP

SEQ ID NO: 204446 - protein, 203 aa, Triticum aestivum
  unsure (1)..(203): unsure at all Xaa locations
  Clone ID: PAT_TA_98864.pep
AEMNKRSFKYAWVLDKLKAERERGITIDIALWKXFETTKYYCTVIDAPXHRDFIKNMITGTSQADCAVLIIDSTTGGFEAGISXDGQTREHALLAFTLGVKQMICCCNKMDATTPKYSKXARYEEIVKEVSSYXKKVGYNPDKVSFVPISGFEXGDNMIEXRSTTXDWXQGALTFLEXLDKIKRXXRGPQXKPXRSPPQGLXX

SEQ ID NO: 204447 - protein, 191 aa, Triticum aestivum
  unsure (1)..(191): unsure at all Xaa locations
  Clone ID: PAT_TA_98865.pep
MAASLQAAATLMPAKIGGRASSARPSXHVARAFGVDAGARITCSLQSDIREVASKCADAAKMAGFPLATSALLVSGASAEGAPKRLTFDEIQSKTYMEVKGTGTANQCPTIDXGVDSFPFKAXGKYEMKKFCLEATSFNVQGRGHPRRTXXPASKXTKLMXRPNYTLDXMEXPLEVRXXRHLKFXEXXXIY

SEQ ID NO: 204448 - protein, 140 aa, Triticum aestivum
  unsure (1)..(140): unsure at all Xaa locations
  Clone ID: PAT_TA_98866.pep
MXPTVMXSSGTSVXPFXGLXSXAGLPXSRRSXGASLXSVSNGXRIRCMXVWXIXXIKXXXTLSYLPPLXTEXLLXXVXYLIRSXWVXCLXFNKXGFIFREHXNASPGYYNGRYXXMWXLPXFGWTDATQGXXGGGGQRVT

SEQ ID NO: 204449 - protein, 77 aa, Triticum aestivum
  unsure (1)..(77): unsure at all Xaa locations
  Clone ID: PAT_TA_98867.pep
KLTXRGGAYNSDXXLXNSHEXVPAXRXLXFPNXXXLILTHHYINPXXQPTXDNIRMXMXSLLHAFIYXQLPGXPXLW

SEQ ID NO: 204450 - protein, 90 aa, Triticum aestivum
  unsure (1)..(90): unsure at all Xaa locations
  Clone ID: PAT_TA_98868.pep
QRGGLCXQHQXPHRAPAKGSVCLIDHTEKXPQNXEPSPSLMNCPLSVXGXMFXRCVXQETXLNPLSPXSLSVXPVPTLXXGCSXRMTTXG

SEQ ID NO: 204451 - protein, 116 aa, Triticum aestivum
  unsure (1)..(116): unsure at all Xaa locations
  Clone ID: PAT_TA_98869.pep
MXRAXVMLMXVALVLMLAAVPRAAVVIXCGHVDXLVRXCLSYVQGGPTXSGXCCGGVXNLHXQAQSKSDXQAAXNCLKGIXRXIHNLNXDNXRSLXPKCGVNLPXHISXDIDCNXV

SEQ ID NO: 204452 - protein, 86 aa, Triticum aestivum
  unsure (1)..(86): unsure at all Xaa locations
  Clone ID: PAT_TA_98870.pep
MSSVFNXDENGPFFXFXGXAAGLXFSCXGXXYGTXKXXVXVASKGVMXXEXVMKXXMXVXMAGVXXIYRLIXAXINNTGIKPKGKA

SEQ ID NO: 204453 - protein, 79 aa, Triticum aestivum
  Clone ID: PAT_TA_98871.pep
QYSYDSPRDLYHRNKWCKSRISQKKFILAFLWLRWQSVNHQCPFSLPGISLVQETYLLPFVKEWDSSFMVRSAHNLTSS

SEQ ID NO: 204454 - protein, 173 aa, Triticum aestivum
  unsure (1)..(173): unsure at all Xaa locations
  Clone ID: PAT_TA_98872.pep
XKKKXTXPWVPKXSXNSARRLLLPNFCQLLPCRCMEVASPPPXPPIVTFQQGAHTHPTSIHPQGRSACEXPRPFLLASTSSAIGSHRQAXNNLEKVLNLVKEFSCWYIFLTYICCLRVINTEINTCVRXKICXXQERQXWCGXFMFLTYSQYISTLXDXGCXQSSXQEQGLXS

SEQ ID NO: 204455 - protein, 97 aa, Triticum aestivum
  unsure (1)..(97): unsure at all Xaa locations
  Clone ID: PAT_TA_98873.pep
MAPKVAVAXKGDAKAQAAKXAKXVKSGXINKXAKKIRTSVXFHRPKTLSXXKGPXXPXIKXPGRXQGXSILXXQFPLTTXSAMXKIEDKKKNHFIQP

SEQ ID NO: 204456 - protein, 57 aa, Triticum aestivum
  unsure (1)..(57): unsure at all Xaa locations
  Clone ID: PAT_TA_98874.pep
XXIYPSXHLQLSSXTLILQTPXGWXALQLLNSCWSPWWALCSXXPRXRXSPAVXXXL

SEQ ID NO: 204457 - protein, 125 aa, Triticum aestivum
  unsure (1)..(125): unsure at all Xaa locations
  Clone ID: PAT_TA_98875.pep
MNEVCVKGAVGXPDTLXDCPFSXRVXLXLXXXXVPYQMXLIXVXNXPDWFLKXNPXGKXPVXNGGDGKWIADSXVIXXXSLXGKYPTPTLVTXXXYATXGXKXFSNFXXXXNNKDXXDGSEKXLV

SEQ ID NO: 204458 - protein, 51 aa, Triticum aestivum
  unsure (1)..(51): unsure at all Xaa locations
  Clone ID: PAT_TA_98876.pep
TPXXLDWXPWQAPGXFFLXXGMGVXWTXXQVVYIXSXGIXAARGASSFXLP

SEQ ID NO: 204459 - protein, 147 aa, Triticum aestivum
  unsure (1)..(147): unsure at all Xaa locations
  Clone ID: PAT_TA_98877.pep
KMXKXMGNAGGXXDGVVVKXXPPPXSXGGGSSXGGSNIXPGGGDSGGLIPSQXNLAWARGPKXPKETVTGARDXXHXKTKXLRDXRGXKQKAGLGQSXILGARPXGKKKXGAALFWAKGKSKKVXFFHKRGPKXFFPQXRXLGGXFV

SEQ ID NO: 204460 - protein, 84 aa, Triticum aestivum
  unsure (1)..(84): unsure at all Xaa locations
  Clone ID: PAT_TA_98878.pep
XSLXSTKXESLSPSSYASXPSNSLXLMASGGXLPXVSGMARAGAXEAVVGQNXQFPXXXEXXSXXETXGPGSSGXXEXRXXRXT

SEQ ID NO: 204461 - protein, 60 aa, Triticum aestivum
  unsure (1)..(60): unsure at all Xaa locations
  Clone ID: PAT_TA_98879.pep
GRSXLGXXYSRSTXFPTPCXXXAPPSAQAXXXSGAPVAPTXRTRTXXRGXMPVVGXMGFG

SEQ ID NO: 204462 - protein, 89 aa, Triticum aestivum
  unsure (1)..(89): unsure at all Xaa locations
  Clone ID: PAT_TA_98880.pep
MGIDLXPGGRNKRTXRVXPXSDDVXLXLLVXLYRXLVRRTKSXXXAXILKRVFMXKTKRPPLSMXRLSNFIKGKXXKNXAVVVGTITXD

SEQ ID NO: 204463 - protein, 154 aa, Triticum aestivum
  unsure (1)..(154): unsure at all Xaa locations
  Clone ID: PAT_TA_98881.pep
PPGCKSRRFLLLFLPLNPESEAXKSSQWVXXXFSSGXSXLSLPSSSTXPSASGPKNLPVAXRRRRAVAVASXVXESPKXLXLGDAIXGXNLXEXRNLXDHLQKXLGVSAASFXPXAAVAGPPAAXAXEXPVXKXEFXLVTKEGAXNXRFQXXKV

SEQ ID NO: 204464 - protein, 139 aa, Triticum aestivum
  unsure (1)..(139): unsure at all Xaa locations
  Clone ID: PAT_TA_98882.pep
MAPKVAVAXXGDAKXXAAKVAKXVKSGSIXKTXKKIRTSVTFHRPKTLSKXRDPKXPRISTPGRNKLDQYXILKYPLTTESAMKKIXXKKTLVFIVDLKGDKKXIXGAVKKMXDIQGKKXXTLIKPXXKKKGYVKLTTN

SEQ ID NO: 204465 - protein, 149 aa, Triticum aestivum
  unsure (1)..(149): unsure at all Xaa locations
  Clone ID: PAT_TA_98883.pep
XDLXLLGLLVNPFVXRVRLXLHIKGLSYEXIXTXVLDXXELLLRYXPVXKXVXVLIHKGLPLCEXQXIVXYXDXXWGAAGAPILPAEPXARANGRXWGAXVEKKLFPXLGWGSSWATQGGERKGPGKSPRSRKIEVGPRISGKTGKEGP

SEQ ID NO: 204466 - protein, 80 aa, Triticum aestivum
  unsure (1)..(80): unsure at all Xaa locations
  Clone ID: PAT_TA_98884.pep
DKXKXNSSFFFFFFLLLLPPGGXIFXXHPSSASXRXDAVPRSLHRXXTNQAXXXDXVXQSGGXAXGHLXAXXPTPGGQLQ

SEQ ID NO: 204467 - protein, 141 aa, Triticum aestivum
  unsure (1)..(141): unsure at all Xaa locations
  Clone ID: PAT_TA_98885.pep
VDSXKSTXTGHLXYXLGGIDKRVXXKVXKEAAEMNXRSFKYAWVLDXLXXERERGITIDIALWKFXTTKYYCTVIDAPGHRDFIKNMITXTSXADCAVXNXDSTTGXFXXXISKDGXTREXAXLXAFTLXVKQIXXWLQQR

SEQ ID NO: 204468 - protein, 138 aa, Triticum aestivum
  unsure (1)..(138): unsure at all Xaa locations
  Clone ID: PAT_TA_98886.pep
YGALLATQKVXXRAQVMLMXVXLVLMLAGVPRAAVGIXCGHVDXLVRXCLSYVQGXPGPSGXCCDGVKXLHKXARXQXDXQNAXXCLXGXARGIHNLNEENARSXPPXWXVKLPYXXXXNXHCSKVWGSSNWVSSNHL

SEQ ID NO: 204469 - protein, 68 aa, Triticum aestivum
  unsure (1)..(68): unsure at all Xaa locations
  Clone ID: PAT_TA_98887.pep
KKRSKNXXNLTSVXTKXLXXDERGXXLTGGRCKTSFXDEXXFNXSVDGRFXALHADQEGXLSYPXXGR

SEQ ID NO: 204470 - protein, 107 aa, Triticum aestivum
  unsure (1)..(107): unsure at all Xaa locations
  Clone ID: PAT_TA_98888.pep
PXPXCFXHXGKISFPLALAGAASTDRLSERSPRTLXWPSRLRLRAFCSSSTDAGVEELARPPRXGADXXGCGEGIKEXPHRRQPXEVEELFGKVGAEXPKAVGPRKK

SEQ ID NO: 204471 - protein, 129 aa, Triticum aestivum
  unsure (1)..(129): unsure at all Xaa locations
  Clone ID: PAT_TA_98889.pep
MARLNSKAVAAAVVLAAVVLMMAGREASAALXCGQVDSXKLAPCVAXVTGRASSISKECCSGRAGAETAXARSSPDRKDSVAGASKSLATSIKSINMGQRSPACPGKCXGVSVPLPPSSHVQPNLQQCS

SEQ ID NO: 204472 - protein, 86 aa, Triticum aestivum
  unsure (1)..(86): unsure at all Xaa locations
  Clone ID: PAT_TA_98890.pep
MVKAVAVLTGSEGVKGTIFFTQEGDGPTTVTGSVTGLKEGLHGFHVHALGDTTNGCMSTGPHFNPAGHXHGAPXDEIRHAGESLEM

SEQ ID NO: 204473 - protein, 87 aa, Triticum aestivum
  unsure (1)..(87): unsure at all Xaa locations
  Clone ID: PAT_TA_98891.pep
RIPDRKLLARLVIVREEARNMMGGGLLXDERNDRGLNTLPQAEVNFLSKLVALKPXGKQWEKMISDVMHGKEEGADNTESTNAGTKF

SEQ ID NO: 204474 - protein, 149 aa, Triticum aestivum
  unsure (1)..(149): unsure at all Xaa locations
  Clone ID: PAT_TA_98892.pep
SARRALTQPSISSRSATMAAAPRHSCAKLSVAVEDPKAPGGGGIFVKATWLPTRFSLAVTDGAGAWVADASDAEVRLRAEQWDQXPVSEYLALAERYLAFXKPSSTYSFHEAGAGRRLSWTFEKQGTKLEWRWKLQPAPXPATRLLLRS

SEQ ID NO: 204475 - protein, 47 aa, Triticum aestivum
  unsure (1)..(47): unsure at all Xaa locations
  Clone ID: PAT_TA_98893.pep
MMYLKNFIDDQALYFECHLGNQIQKCPXGIGFPSVWAMVVXXIREAS

SEQ ID NO: 204476 - protein, 171 aa, Triticum aestivum
  unsure (1)..(171): unsure at all Xaa locations
  Clone ID: PAT_TA_98894.pep
WXRXGEPSLTTSACRWRAPRSQAGSRRESVPGRQAPVFHLGEXGKKGALSSXKGGGRSPDRVRLRHQRNFQXXYPKPSKGGPXNGNISQGRDLRGXVQGLGTPVRKNWXMGPLDGERXFKLSGRXPPXQIXXXEEKNWIPIXDPSRLYLQSXLXQSLKXQKXXDFGXCKPG

SEQ ID NO: 204477 - protein, 78 aa, Triticum aestivum
  unsure (1)..(78): unsure at all Xaa locations
  Clone ID: PAT_TA_98895.pep
LSXPTFLLXGLAPPGCSPPXLLXTEAPPQVLPRPTRAPXLTXPTRPXLPSLXPEXGXHXPRPXAPSPLRSXXHRARXV

SEQ ID NO: 204478 - protein, 151 aa, Triticum aestivum
  unsure (1)..(151): unsure at all Xaa locations
  Clone ID: PAT_TA_98896.pep
XRAPXGVDDGTTLRRXRETLXMTFVENPARCAPALVVVGGXAEPPQQVPLARRNTWRENLVRVGGLDGGVHGVEGAVEALPPAEHHEAPNGAYISRRGGGRTPVGGEQSATPGRIRNPIEQRQTRSTRCACSPTRASRGGREPHARESPLV

SEQ ID NO: 204479 - protein, 110 aa, Triticum aestivum
  unsure (1)..(110): unsure at all Xaa locations
  Clone ID: PAT_TA_98897.pep
FPVXYTGGINPLIWXRPITSIGSFNLPTYDIELTPFLGKLLDGKEHEVGFAVTNXQNSWXRERATSTSGLDPKXSTTXGGLISYDXPKAVGEASHRHSVDGIDGEVPRRR

SEQ ID NO: 204480 - protein, 80 aa, Triticum aestivum
  unsure (1)..(80): unsure at all Xaa locations
  Clone ID: PAT_TA_98898.pep
MKGAKSXGAAKADAKLAVKSKGAXKPAAKGXKGKXXKDPXKPKXAPSAFFVFMGXSSXRSSXRKNPNNKSVAGXXXKAAG

SEQ ID NO: 204481 - protein, 114 aa, Triticum aestivum
  unsure (1)..(114): unsure at all Xaa locations
  Clone ID: PAT_TA_98899.pep
ETLADRSSPPPPPRTSALSFLLRFKMKFIAAYLLAYLSGNASPSAEDLTSILESVGCEIDNEKMELMLSQVKGKDITELLAAGXEKFAAVPSGGGGVAVSAAAPAAGGAAAPAS

SEQ ID NO: 204482 - protein, 113 aa, Triticum aestivum
  unsure (1)..(113): unsure at all Xaa locations
  Clone ID: PAT_TA_98900.pep
MARAQVMLMXVALVLXMLAXVPRAAVAIDCGHVDSLVRPCLSYVQGGPSPSGQXCCGXVQSLHXQXRNPKSDRQAACNXCLKGDRSWHPXILKRRDNXRSPPPPKVAGGQLSP

SEQ ID NO: 204483 - protein, 126 aa, Triticum aestivum
  unsure (1)..(126): unsure at all Xaa locations
  Clone ID: PAT_TA_98901.pep
ASSVLTASSQSLASFPRRHPPRKGGCLAAAATAGAAPAASAATAAAGARCSPTWRPPPAPPPWSCPPPPTRGAPAGSRRPGXRPAAATAPPASAAPRAGLLLPAACKLXPAPRXAGPXQKAEARXD

SEQ ID NO: 204484 - protein, 114 aa, Triticum aestivum
  unsure (1)..(114): unsure at all Xaa locations
  Clone ID: PAT_TA_98902.pep
NPXSXKQXTXQXRWPALSXTARXSXXGNRRRXXQLATNXARXSXPATARRXXAAXXPPRHRGAPGDXXVPXRARSCSSASCPSSALVREIXAVTSRPDLKVPVPPXVSVACTDG

SEQ ID NO: 204485 - protein, 77 aa, Triticum aestivum
  unsure (1)..(77): unsure at all Xaa locations
  Clone ID: PAT_TA_98903.pep
XHRQQTLTLFVSGTGTLNINPLGXCVXPGIFFHXKTIASIWFXGXALLIVHLSXWHPXPPXSLXRARPSPPSXXASL

SEQ ID NO: 204486 - protein, 170 aa, Triticum aestivum
  unsure (1)..(170): unsure at all Xaa locations
  Clone ID: PAT_TA_98904.pep
MAPKADKKPAAENKVEKAAEKTPAGKKPKAEKRLPAGKTASKEAGGEAKTRGRKKGSKAKKGVETYKIYIFKVLKQVHPDIGISSKGMSIMNSFINDIFXKLAGEXSGKLARYKQRKPTITSXGEIQNSVPAFVLPGEARQSNAVXXRGTKGVTKSXXSLLKITKFYLGC

SEQ ID NO: 204487 - protein, 70 aa, Triticum aestivum
  unsure (1)..(70): unsure at all Xaa locations
  Clone ID: PAT_TA_98905.pep
XKRVXYFKKAHXDRYIGLKQSWRKPQGIXSRXVRRKFKGXTLMPXNWGMVLTRKTXHYPKSSRTFVGGNS

SEQ ID NO: 204488 - protein, 139 aa, Triticum aestivum
  unsure (1)..(139): unsure at all Xaa locations
  Clone ID: PAT_TA_98906.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYKLLYDNKGRFPPSICXGMRDAKFKLCXGRACPSGQEASPN

SEQ ID NO: 204489 - protein, 144 aa, Triticum aestivum
  unsure (1)..(144): unsure at all Xaa locations
  Clone ID: PAT_TA_98907.pep
MXNXTVDVNLVSARDLXDVNLVSKMEVYAVVXLAXDPISRERVLADRNGGRNPNWNATVRVTVPTSGSGSXXLRVLLRXERPLGDREVGGGDSPRSTEILTRRGTSQTRRQPKPTKVAQGRVLKVKPLLQSGGSQSNQPAGSIT

SEQ ID NO: 204490 - protein, 157 aa, Triticum aestivum
  unsure (1)..(157): unsure at all Xaa locations
  Clone ID: PAT_TA_98908.pep
ANPSQVASHEHELRLHGSWRDGAVQAVQLELRGPINDVKCMRYLLTXRFGFPNDCVLILTDEERNPCXXPTKDNIRMAMHWLVXGVQXXDSLVFKFSGLGAXVPDDNGDXLDGMDEGLCPVXSFNKGPILXDEXTKAIXRPXXXRGLKLKXXLRRPW

SEQ ID NO: 204491 - protein, 149 aa, Triticum aestivum
  unsure (1)..(149): unsure at all Xaa locations
  Clone ID: PAT_TA_98909.pep
RSSGCFPLFVFSKLWANTSWYTRVEMFVVSANAFPCLXECIFSXFLTVPSMFSRGAMPQLEILWXDAPASDIASGELDVGMGHLPSLRKVKXYFWAXRKAALRISARRKADVXLRHAAXIHPNRPTLETYPISSLMMTISSRAKLCLLL

SEQ ID NO: 204492 - protein, 167 aa, Triticum aestivum
  unsure (1)..(167): unsure at all Xaa locations
  Clone ID: PAT_TA_98910.pep
DNEGEFKSYLKDHYPLLTDEDLSTLVSTYPNDRHWPDSGAWWDAVAKAQGDIRYICPTYLASNAMSELNPENVPTYQYQWDVMWGVDIENGYGTKHAGTVGQVMVRRQNEISDYFIKLHQVPRSQPRTSSHSSXKMLRLPSGSRWTTRVARMFFTNIKRRVGHKGDG

SEQ ID NO: 204493 - protein, 96 aa, Triticum aestivum
  unsure (1)..(96): unsure at all Xaa locations
  Clone ID: PAT_TA_98911.pep
KFIAAYLLAYLSGNASPSAXDLTSILEVSWXCEIDNEKMGTHAVPKWRAKDITELLGWLGXGKILLRVXSGGGGGGCFKPLAPGGGXRLXAPCKVK

SEQ ID NO: 204494 - protein, 55 aa, Triticum aestivum
  unsure (1)..(55): unsure at all Xaa locations
  Clone ID: PAT_TA_98912.pep
VPSSEQIXRPQPXTPXAPTPVHLHGAGXRPPPXPLRRGPRXRPGXXXGXPRRDGS

SEQ ID NO: 204495 - protein, 91 aa, Triticum aestivum
  unsure (1)..(91): unsure at all Xaa locations
  Clone ID: PAT_TA_98913.pep
XKXSXXGXPXXXGLNTCXQKPRAPEEXKXPEGEDHTGXPXRGXLFFXVAXVXPXHXXXPPXQESXFSPSCXHARVNEGRQTDVLCFVLCLA

SEQ ID NO: 204496 - protein, 168 aa, Triticum aestivum
  unsure (1)..(168): unsure at all Xaa locations
  Clone ID: PAT_TA_98914.pep
MEKTAAAVAVAAEEEPEEAWAWTWGAGTDGQLGNGGFQDYHLPQPLLLPPRCRGRVSFVAGGGAHAIALTSDGEVFTWGRGTHGQLGHGNIENIPHPKSVKFFENYXVTCVSTGWXHSGFATDSGQLFMCGDXSFGQAWHWVILKSRELCHLKVPSYQQSMFEALHFG

SEQ ID NO: 204497 - protein, 102 aa, Triticum aestivum
  unsure (1)..(102): unsure at all Xaa locations
  Clone ID: PAT_TA_98915.pep
ASGXXXFVXXXXNCCPAPPPXVXLNXDGGRPLDFGLHRRGGFLRXSRPPRRRPASPPRAPPPSARPMGSGHQRWPLPSWMQENDRSGRGWLAEASATLDQRV

SEQ ID NO: 204498 - protein, 132 aa, Triticum aestivum
  unsure (1)..(132): unsure at all Xaa locations
  Clone ID: PAT_TA_98916.pep
MXLLAAATLNPTTHLSLRSRAGRNSENLWLRSAASSQXSKGRFCXLTVRAGTPSKPAEPIGPVFTKLKPWQIPKRDWXDKDFLFGASTSAYQIXKGAWXENGKGASTWDHFWHKYPEAHIGQGXNGDVQQXS

SEQ ID NO: 204499 - protein, 146 aa, Triticum aestivum
  unsure (1)..(146): unsure at all Xaa locations
  Clone ID: PAT_TA_98917.pep
RRNTHTHXEAKMXXRXKGGXGLXKGGAXRHRKVLRDNIXXITKPGIRRLXRKGXVKRIXGLIYEEDPGXAQXLPXRNVIRDAVTYNRXTPRRKERQPPWDVVYALKRQXRTLYGIXGGGPAGFQISNVPRAKGSVFLKKWRCLGPR

SEQ ID NO: 204500 - protein, 104 aa, Triticum aestivum
  Clone ID: PAT_TA_98918.pep
VRSGTPWLVSRESEPLTKTKGSEFRNVLDPDKIHMVSYPQGRRNLSWCGASHGWLIASDELSNLLFCNPFTLAMIPLPPITDLECVEGVYDNDRSIAGYYYGKF

SEQ ID NO: 204501 - protein, 63 aa, Triticum aestivum
  unsure (1)..(63): unsure at all Xaa locations
  Clone ID: PAT_TA_98919.pep
SASLLETGXLQXXLKNYDPQKXKRFXXSXKLXXIPRPKMRXCMLGDAQHVXKAEKMGXDYMGC

SEQ ID NO: 204502 - protein, 142 aa, Triticum aestivum
  unsure (1)..(142): unsure at all Xaa locations
  Clone ID: PAT_TA_98920.pep
MXIFVKTLTGKTITLXVESSDTTDNVKXKIXDKEGIPPDQQXRLXFAXKXLEDGRTLAXYNIQXESTLHLVLRLRGGMQIFLXTLTGXXIXLXXGSSDTXXNVKXRIXEKEGXPPGQESLIFAGXQLXDGRXLPXYXIQERG

SEQ ID NO: 204503 - protein, 176 aa, Triticum aestivum
  unsure (1)..(176): unsure at all Xaa locations
  Clone ID: PAT_TA_98921.pep
KQCEADIXVNMSMMQRPSVGYEPTTDKLYDQPLLGFVRAKNEPTENKEAQPAQKTREEPLDLQTKCSLENKEEDESGDSESCSSSDEDGSWAMSPQRWGPKKGKAARKENKKEKLRREKKGKLXKDQRFPKGRLXKKXGRKMGERQSKPGNGITGLAWQKLEIQQWVDQSIFVIQT

SEQ ID NO: 204504 - protein, 62 aa, Triticum aestivum
  unsure (1)..(62): unsure at all Xaa locations
  Clone ID: PAT_TA_98922.pep
GPXXAPXXPRXHGLGLXPPXLFGGVAXLPXXTPNVXPLRAPXDXTGDVXXVYGCASIELXXL

SEQ ID NO: 204505 - protein, 148 aa, Triticum aestivum
  unsure (1)..(148): unsure at all Xaa locations
  Clone ID: PAT_TA_98923.pep
MDASXTGAGAKAXKGAAGRKAGGPXKKSVTRSVKXGLQFPVGRIXRYLKNGRYAKRVXTGAPVYLAAVLEYLAAELLELAGNAAKDNKKSRIVPXHLLLAVRNDXELGKVLGGXVTIAHGGVXLPXXNPXXLPXKNXXXRXPKXPKKX

SEQ ID NO: 204506 - protein, 143 aa, Triticum aestivum
  Clone ID: PAT_TA_98924.pep
MARAQVMLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCKQGVMGDDPSKLAQLIQSTLGVEARNPLLW

SEQ ID NO: 204507 - protein, 162 aa, Triticum aestivum
  unsure (1)..(162): unsure at all Xaa locations
  Clone ID: PAT_TA_98925.pep
GYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSXKDDPAKGGXXNFTXQXVINMXQPGQ

SEQ ID NO: 204508 - protein, 78 aa, Triticum aestivum; identical to SEQ ID NO: 106977
  Clone ID: PAT_TA_98926.pep

SEQ ID NO: 204509 - protein, 153 aa, Triticum aestivum
  unsure (1)..(153): unsure at all Xaa locations
  Clone ID: PAT_TA_98927.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQXGIPYLNTYDGXTIRYPRPN

SEQ ID NO: 204510 - protein, 109 aa, Triticum aestivum
  unsure (1)..(109): unsure at all Xaa locations
  Clone ID: PAT_TA_98928.pep
FQTRXXXSSSSPSSSPGPTPLQREQCPSXXGRTRGAQGRENGXPWAGCPLREEAXSXGVGSTILLQSFKXTTFQSNVELDLVLGKGEKPWPAGVQLGGXLKXSRGWXXE

SEQ ID NO: 204511 - protein, 146 aa, Triticum aestivum
  unsure (1)..(146): unsure at all Xaa locations
  Clone ID: PAT_TA_98929.pep
MXRTKQTXRKSTGGKXPRKQLATKXARKSAPATXXVKKPHRFRPXXVALREXRKYQKSNELLIRKLAFXRXVREXAXKDFKTDLRFQSSAVSALQEGAEGXLVGLFEGNKLCAIXAKARHHHGQRDIXLARRIRXEEGDKAAAAIH

SEQ ID NO: 204512 - protein, 138 aa, Triticum aestivum
  unsure (1)..(138): unsure at all Xaa locations
  Clone ID: PAT_TA_98930.pep
MXDRANXXSVMQKFGXEFHLASSFSEGVRARNICPSVPSYERXFTTXCYMTXXLXIXNVPMKSSSPLFANAPPEKKGVKNFAIDFLKGGVSAAVSXXAAXPIERVKLLIXEPKMGMIKXGKGLLNQKXGNGDWXWVAP

SEQ ID NO: 204513 - protein, 121 aa, Triticum aestivum
  unsure (1)..(121): unsure at all Xaa locations
  Clone ID: PAT_TA_98931.pep
KPXHXVEPNKQKNMKRRGEYTWEVVAQNRSMVVVSGGDSGEAGEGGVGQRVTGRGAASPAWRRAVLRNGVGQGPMGQSSELERLGRQWCCHFGWWSWRSCLWSSGLERNTTGSSTSRRWRW

SEQ ID NO: 204514 - protein, 101 aa, Triticum aestivum
  unsure (1)..(101): unsure at all Xaa locations
  Clone ID: PAT_TA_98932.pep
RKEVEKNRRLHMKGLCXKLSSLLPSSSSXXHLRHYSSSPPSSNKDAXTQLXXLXQARXXYIKKLKKPGSTKLSPQSAVVSRVAWGGSGLPGGLKRGRKNWS

SEQ ID NO: 204515 - protein, 51 aa, Triticum aestivum
  Clone ID: PAT_TA_98933.pep
YSEKIHYTPFVSVLGANHITWAGSFVVLLVCSITRLVCTVNNAMMHVLAHC

SEQ ID NO: 204516 - protein, 122 aa, Triticum aestivum
  unsure (1)..(122): unsure at all Xaa locations
  Clone ID: PAT_TA_98934.pep
TASPPAWAPAPAAAACARARWGTRXXDXXVLVDRXAXKVVRLXRPRRRGRVVQDAGVSICKPKDRXSLXGCPCTCLRXAPIKVQXXNILPKMXRGVXXVRXLDLXRXXKGAXXDPANXDXRW

SEQ ID NO: 204517 - protein, 126 aa, Triticum aestivum
  unsure (1)..(126): unsure at all Xaa locations
  Clone ID: PAT_TA_98935.pep
MARTKQTARKSTGXKAPRKQLATKAARKSAPTTGGVKKPHRYRPGTVALREIRKYQKSTELLIRXLPFXRLVREIAXQDFKTGPPLPSPTPCWPSREAAEAXLVGAVRGHQXCXAIQAKRVTIMPN

SEQ ID NO: 204518 - protein, 136 aa, Triticum aestivum
  unsure (1)..(136): unsure at all Xaa locations
  Clone ID: PAT_TA_98936.pep
PHQAPHLALLPPPSSLAAAAVLPPSSLPYNHVARRKPPFVAPCRCRGVVHFVPHSSSLILAHHRRCLLLPSTIVGASGSNLALVGWSSMLEAKTGKVRKMRDWMEVLETEEAGDAQLASLAIRWLXXQPILWSRWG

SEQ ID NO: 204519 - protein, 129 aa, Triticum aestivum
  unsure (1)..(129): unsure at all Xaa locations
  Clone ID: PAT_TA_98937.pep
MAPKADKKPAAENKVEKAADKTPAGKKPKAEKRLPAGKTASNEAGGEGKTRGRXKGSKXKKGVETYKIYIFKVLKXVHPDIGHLLQRPLXIMNSFIKGLPMKGAGGRFGKLPPRLQTRKAHHSGRIPVP

SEQ ID NO: 204520 - protein, 150 aa, Triticum aestivum
  unsure (1)..(150): unsure at all Xaa locations
  Clone ID: PAT_TA_98938.pep
PSLDWYKGPTLLEALDQXINEPKRPSDKPLRLPLQDVYKIGGIGTVPVGRVETGVIKPGMVVTFGPTGLTTEVKSVEMHHESLLEALPGDNVXXFNVKNVAVKDLKRGYVASNSKDDPAKEAAXFTAQXVIIMNHPGXQISNGYAPGAGL

SEQ ID NO: 204521 - protein, 141 aa, Triticum aestivum
  unsure (1)..(141): unsure at all Xaa locations
  Clone ID: PAT_TA_98939.pep
MDASATGAGAKAKKGAAGRKAGGPRKKSVTRSVKAGLQFPVGRIGRYLKNGRYAKRVGTGAPVYLAAVLEYLAAELLELAGNAAKDNKKSRIXPRHLLLAVRNDQEAPGGCWAGVTIAHGGXAGPNIKPRLLAGXKKDWGK

SEQ ID NO: 204522 - protein, 109 aa, Triticum aestivum
  unsure (1)..(109): unsure at all Xaa locations
  Clone ID: PAT_TA_98940.pep
TAISGSELGSMLAKTFTFLKLAILNIASLNTQNNKCSSKFQXLTFAHIIAAGWDRPLAVLSLPSCQSHNPIFTLCNSYLGIQGSTKKSKGRWALSRGCRSDASGVAXDA

SEQ ID NO: 204523 - protein, 64 aa, Triticum aestivum
  unsure (1)..(64): unsure at all Xaa locations
  Clone ID: PAT_TA_98941.pep
GRGXSXGNKFXXSLGLPVXXTXNCXDNTXAKNLYIISFKXIXGRXXRLSSVCVXYMXMVHSSRA

SEQ ID NO: 204524 - protein, 70 aa, Triticum aestivum
  unsure (1)..(70): unsure at all Xaa locations
  Clone ID: PAT_TA_98942.pep
FFXAPXXXRXHPPVKXPXLLXASFWSAQLXMACXLRSTGTSKXSLAVDSTXGRGCSGXVAPPRATGXRRX

SEQ ID NO: 204525 - protein, 136 aa, Triticum aestivum
  unsure (1)..(136): unsure at all Xaa locations
  Clone ID: PAT_TA_98943.pep
MAAKEPMRVLVTGAAGQIGYALVPMIARGVMLGADXPVILHMLXIEFAAEALKGVKMELIDAAFPLLXGKLVATTDVVEACTGVNVAVMVGGFPTKEGMERKDVMTKNVSIYKSSSICSLLMQAPNLQGSGCLPTK

SEQ ID NO: 204526 - protein, 75 aa, Triticum aestivum
  Clone ID: PAT_TA_98944.pep
CSVHWIIASGSICSAYEFVCFVLCCLCRISVYRLNALCCAFLAESFSCNINLRKVGSWAELDNLFCQQSFSSHYS

SEQ ID NO: 204527 - protein, 136 aa, Triticum aestivum
  unsure (1)..(136): unsure at all Xaa locations
  Clone ID: PAT_TA_98945.pep
SLEPSAAAATSALSFLLRSKMKFIAAYLLAYLSGNASPSAEDLTSILESVGCEIDNEKMELMLSQVKGKDITEXLLAAGREKFAAVPSGGXGGVAVXAAAPAAGXAAAPAAEXRKEENVXXXEESDDDMGFKSGSD

SEQ ID NO: 204528 - protein, 140 aa, Triticum aestivum
  unsure (1)..(140): unsure at all Xaa locations
  Clone ID: PAT_TA_98946.pep
MAPKAEKKPAEKKPAAEVAEKAEKTPAGQXKPRREKRLPASKSAKEGGDKKGRKKNKKSVETYKIYIFKVLKXVHPXDIGISSKAMSIXELLXINDIFEKLAGEGXQSLAXYNKKPTXTSREIQTSVASSSPGEVAKQRR

SEQ ID NO: 204529 - protein, 163 aa, Triticum aestivum
  unsure (1)..(163): unsure at all Xaa locations
  Clone ID: PAT_TA_98947.pep
PVXVCWXQXPSXXRPQGLTAXPLRGXVPXHPSPXFXSXADGPXXPGRRLPRGAMXXHPVAWXRRILTWRPGYATTEXYRKKRLXRGGVSRSLKKSSRGRRCRRKXAIRLRGRRXTESRRRPGACGRRRGSDGAHHANGELGSEPXMALGLGKEARWNWXLXGR

SEQ ID NO: 204530 - protein, 159 aa, Triticum aestivum
  unsure (1)..(159): unsure at all Xaa locations
  Clone ID: PAT_TA_98948.pep
AKAKPTFPPSHPXSPPLPQEARPGXNPAGPLPHRRRASQREGGERWGSTREEPWGXQSLIYAVVXRGHRGAGXXYTGVHRAXSATIGPXKWPXSSXPGAXKQTKXQLTXWXTGQHLXXNXSFAKRXQGXXXFQXKWKKRGWMGXTIGRKGXWXXGRXKI

SEQ ID NO: 204531 - protein, 65 aa, Triticum aestivum
  unsure (1)..(65): unsure at all Xaa locations
  Clone ID: PAT_TA_98949.pep
PRFWXSXTXXGGCXXPWXGFAPMAXNPPTXTXIIPKXSXTIVXSHSPXSIPFHTTVIELNDVEMC

SEQ ID NO: 204532 - protein, 123 aa, Triticum aestivum
  unsure (1)..(123): unsure at all Xaa locations
  Clone ID: PAT_TA_98950.pep
QTPXIXFPETTSGXXWXFIXPGXSKRPAPKLIARHSXQXVSCFPTQYXFSXGXAXHVIPRRVHRLHRAMXALTXWPLAXCLXXQFSTAGVEAXGGGVGGDPXASTVKXXCAHPLWGPVPVPST

SEQ ID NO: 204533 - protein, 76 aa, Triticum aestivum
  unsure (1)..(76): unsure at all Xaa locations
  Clone ID: PAT_TA_98951.pep
KDEPTIFAWELMNEPRVPSDLSGKTMQAWVXLMSSYVKSVDGKHMXXIGLEGFXXDSXXERKRFXPXGKXXAGTDF

SEQ ID NO: 204534 - protein, 67 aa, Triticum aestivum
  unsure (1)..(67): unsure at all Xaa locations
  Clone ID: PAT_TA_98952.pep
CTXLIESQXXXSSKSNPGSQIRDPYPEDPQXHLAPVFLTGLTRGAGENXAGGVGGAGGGFDSSLXLL

SEQ ID NO: 204535 - protein, 156 aa, Triticum aestivum
  unsure (1)..(156): unsure at all Xaa locations
  Clone ID: PAT_TA_98953.pep
ENPRFRXRFRFRFPRQXWGPTSSCRRTGTTTSNNGGRTXRTXAXXAGAGAXGSKNNXXGGNAKXGGALLRHVRXGXXATPTPNSXXSGKPPTXXLTDXGISQDXPXGDXXYXXEXXWAPPPPXKIPRXSPPXPXPIFKDPXQXIFQXCQGXLFLFX

SEQ ID NO: 204536 - protein, 141 aa, Triticum aestivum
  unsure (1)..(141): unsure at all Xaa locations
  Clone ID: PAT_TA_98954.pep
MPVNKXAVGSQREXYXVGALXGGLAEFNSXLNXGFXGXXSXXMGXNKXRPDXXXNPAGLXXXGDXAXASPWXWGVXXGXQXLRGGKXNXGRGPXGAFVXGGXNNLLRGLXXWXFAKXLGXXRXAWFLLXFSNGGXFPTGNI

SEQ ID NO: 204537 - protein, 59 aa, Triticum aestivum
  unsure (1)..(59): unsure at all Xaa locations
  Clone ID: PAT_TA_98955.pep
APLNGLWXXXVCPSAPWGVVXFXPXQGXSRRFCILGPPPAFPPFPGGQSTDPXGFCAEA

SEQ ID NO: 204538 - protein, 81 aa, Triticum aestivum
  Clone ID: PAT_TA_98956.pep
ANPTRANHPELFPQAAATTHPARRNRRRRTSPRSAIHCRRTSPRWPRCLRKRRLLRAELRDAMEFLGQPSSAWEGGAPAAS

SEQ ID NO: 204539 - protein, 123 aa, Triticum aestivum
  unsure (1)..(123): unsure at all Xaa locations
  Clone ID: PAT_TA_98957.pep
MXRGLKKHLKRXNAPSHWMLDKLGGAFAPKPSSGPHXARECLPLILILRNRLKYALTYRESXSILMQRHIMXXDEKXRTDKTYPXGFMGIISIPKDWGXNYXLLYDTKXXXPLSRGGVLKFKA

SEQ ID NO: 204540 - protein, 96 aa, Triticum aestivum
  unsure (1)..(96): unsure at all Xaa locations
  Clone ID: PAT_TA_98958.pep
MEGEKNXSGDLMSNNKLVAEAAKTAYEKXSVEGIDKEKVXAASADILHSAXKYGXSWEDKPVGXYLPRKAXGXLENXTNSPXGTEKGEKTDAPLLA

SEQ ID NO: 204541 - protein, 118 aa, Triticum aestivum
  unsure (1)..(118): unsure at all Xaa locations
  Clone ID: PAT_TA_98959.pep
PFPIXSSLXACCFXPLQXNFAARRAGSIRXARPPIRRPAXASSWLGHPDPALCPSSSSTGDPRIRIRLPSXCHARIRPLQAPXARRRRRSTXSSRATPNRSTRRVEPIQKVCSSFIPV

SEQ ID NO: 204542 - protein, 156 aa, Triticum aestivum
  unsure (1)..(156): unsure at all Xaa locations
  Clone ID: PAT_TA_98960.pep
VRVQHKSGRNTVDVTIDCDSKVSTAVTFDEVVPGLKTSFGFKVPDQKSGKLDLQYLHDRFALNSTIGLTSAPVIELATTIGHKRTCXGAEVGFDXTSASVTKYNSGVXYTKDDFSAALQMAEXKGXTLRASYIHLFKPRSKRSWAGGKRTRVEKQR

SEQ ID NO: 204543 - protein, 125 aa, Triticum aestivum
  unsure (1)..(125): unsure at all Xaa locations
  Clone ID: PAT_TA_98961.pep
MADQLTDDQIAEFKEGFSLFHKDGDGCITTKELGTVMRSLGEXPTEAXLQDMXNEVGAXGNGTIDFPXFLNLMXRXMKDTDSDEXLXEXFRAFXKXDQNGFISXGELGHVMXNLGXXLTDXXVRW

SEQ ID NO: 204544 - protein, 129 aa, Triticum aestivum
  unsure (1)..(129): unsure at all Xaa locations
  Clone ID: PAT_TA_98962.pep
PAPPPNVVPSSAAALVSSPSRATAALLSAFTVRCRPCYRCSRIPWRALRPVFWKRIXGSERAGKAVARANAQVPVXGGGGVTPSGXAQGXXGVGLLXQCNGRKGKGIQTPTWLRSXCGGXGLPPGRGAE

SEQ ID NO: 204545 - protein, 156 aa, Triticum aestivum
  unsure (1)..(156): unsure at all Xaa locations
  Clone ID: PAT_TA_98963.pep
SIQPAMAGXESTTXNLVSXTKKGGGEGLPARRLTXAXTCTGYXTGDGGDRHRQRGRVRSGSPRRRSTTSTRSTSXRWAPPAAGSLRPLREARGEERTRXHAHKHKDFMEGGWAAAXKXFXARXXFFXXXATNXEEXKAHKGRAKGRXXGXRRKXPX

SEQ ID NO: 204546 - protein, 89 aa, Triticum aestivum
  unsure (1)..(89): unsure at all Xaa locations
  Clone ID: PAT_TA_98964.pep
TASLEATAVAVTALAGRTLARGGRRLHSNGGDXRAAAASSPCRIRRRALPRSALLPRSTHPHXGLLLXVFAFVFLVLLFLLRXWWGRGA

SEQ ID NO: 204547 - protein, 129 aa, Triticum aestivum
  unsure (1)..(129): unsure at all Xaa locations
  Clone ID: PAT_TA_98965.pep
MSEEKHHHLFHHKEGEDFQPAADGGVDTYGYSTETVVTATGNDGEYERITKEEKHHKHKEHLGEMGAAAXGAFALYEKHEAKKDPEHAHKHKIEEEVAAAATVGAGGFVFHEHHEKKQDHXEGQGGQAA

SEQ ID NO: 204548 - protein, 78 aa, Triticum aestivum
  unsure (1)..(78): unsure at all Xaa locations
  Clone ID: PAT_TA_98966.pep
MSCNCGXXCSCGSNCKCGKXMYPDLTEQGSAAAEVAAVVVLXVXPENXXGQFXVAAGQSGEXGCXCGDNCKXCNPCNC

SEQ ID NO: 204549 - protein, 122 aa, Triticum aestivum
  unsure (1)..(122): unsure at all Xaa locations
  Clone ID: PAT_TA_98967.pep
YHRSSVLVKWAQALPVSNPSCSSPSFPDTSGRAAVPSISTLRYTDVEAPTAPHPXRLPPASGYINLRAAHRDAASHFPLPSLTNIRGRWNLFXSVARSRRPRXANAVAPRXAXEKRRXXTRX

SEQ ID NO: 204550 - protein, 119 aa, Triticum aestivum
  unsure (1)..(119): unsure at all Xaa locations
  Clone ID: PAT_TA_98968.pep
ESHLDHDRHLAGTASQREPSPGLRRRRSPSPSSXSAGSWXSPDDADLRXLVXRVLXHYEXXYRAKSAGASADVLPMFAPSWISATESLYLWXGGWXPTSXXXLLXSKSGLQVXGXLPGF

SEQ ID NO: 204551 - protein, 127 aa, Triticum aestivum
  unsure (1)..(127): unsure at all Xaa locations
  Clone ID: PAT_TA_98969.pep
MAXASMLTTVFSPLALLRPSGSFARLRRAGPAAAXXVRAAAKSXXXAGGPXKXXAAPTXIXXPRSVXPAVYAFXGAXEVXXTDXMXRIWXXINSXKISXNPXDKXGPLRRWKPVLHTTRLGFPGEIC

SEQ ID NO: 204552 - protein, 127 aa, Triticum aestivum
  unsure (1)..(127): unsure at all Xaa locations
  Clone ID: PAT_TA_98970.pep
MAGRKGXDRKKAVTRSVKAGLQFPVGRIGRYLKKXRYAQRVGSGAPVXLAAVLEYLAAEVLELAXNAAKDNKKTRIIPRHLLLXVRNDXELGRLLAGVXIXHGXGVXPNXNSVLXPKKSAXAXKEGK

SEQ ID NO: 204553 - protein, 80 aa, Triticum aestivum
  Clone ID: PAT_TA_98971.pep
AILIEQVEQLKSESATLFKQLTEANQQFTTAVTDNRILKSDVETLRIKVKMAEDMVARGAVSCGLGQQLGLAPFLNSRKM

SEQ ID NO: 204554 - protein, 85 aa, Triticum aestivum
  unsure (1)..(85): unsure at all Xaa locations
  Clone ID: PAT_TA_98972.pep
MSSXEXXWTLAVLIXHXXGIPIXSDKIATVGKAAXIKXXGYWXALXPKLLXKXXVDELILSXGSGGGGXPXAGAAAPAAGGAAAR

SEQ ID NO: 204555 - protein, 91 aa, Triticum aestivum
  unsure (1)..(91): unsure at all Xaa locations
  Clone ID: PAT_TA_98973.pep
XXGEPRREVIVDQTGEREGTYEGLXQRTSLRMTXRFAGFDFXFXNPGDVAKEQDLLYLLXPGQRKXEGAKMTLREQQTRKFQEGPWDGIXI

SEQ ID NO: 204556 - protein, 137 aa, Triticum aestivum
  unsure (1)..(137): unsure at all Xaa locations
  Clone ID: PAT_TA_98974.pep
MAAAASSTVSGLAXAALARRTAFSTSFXSXGRVSAXNPLMTRNLERNGRITCMTFPRDWLRRDLNVIGFGLIGWLAPSSIPLINGNSLTGXFFSXIXEELAHFPSPPXLXSXKFWLWXVXWXLGLFITLTFGQIGFK

SEQ ID NO: 204557 - protein, 98 aa, Triticum aestivum
  unsure (1)..(98): unsure at all Xaa locations
  Clone ID: PAT_TA_98975.pep
RFPSHATXHASLPGPAPPASSLAPPTPGGFGRAAPARQLXRXSDRLASMYIXSQSGXKGPPTSIKXXFQQKTXFLEYQNKKVASQITGQPLPKXTKKV

SEQ ID NO: 204558 - protein, 87 aa, Triticum aestivum
  unsure (1)..(87): unsure at all Xaa locations
  Clone ID: PAT_TA_98976.pep
MVRKAGLEHSGDIIEDSFSIRCDLTLKDIGEQFVVVPPSDMHLHFGSLLESMDGADVAFLVXGEKFSXHKLVLAARSSVFKRSSSAP

SEQ ID NO: 204559 - protein, 63 aa, Triticum aestivum
  Clone ID: PAT_TA_98977.pep
VLTCKNQQEMNRIKETAEHRGIPTFIVADAGRTQVLAGSKTVLAVGPGRKADIDSVTGKLRLL

SEQ ID NO: 204560 - protein, 121 aa, Triticum aestivum
  unsure (1)..(121): unsure at all Xaa locations
  Clone ID: PAT_TA_98978.pep
MANLGWLASLAAAAVVAVALRSPLVAAQLRPGYYAGICPNLETIVRNSVRQSMVQSQISAGATLRXFFHDCXVRXCXASIMIVNSXGDDEWGXPDDQSLKPQGFQKVLDAKAAVDKDPQCR

SEQ ID NO: 204561 - protein, 149 aa, Triticum aestivum
  unsure (1)..(149): unsure at all Xaa locations
  Clone ID: PAT_TA_98979.pep
SLSPSSLLLLPSKEEALLKQVELCLMACAFFFDAEPLGEPGVRXXGPXLEXDACALCTXPLQSNSXIFMXKGDTPFCSEXCRYXQMHFDXAMVRXXAKRQAEXAAAAGPGAAQRAXRRRPCSPRXTCPWGXSCXAPASXLAGRNXXPFL

SEQ ID NO: 204562 - protein, 55 aa, Triticum aestivum
  unsure (1)..(55): unsure at all Xaa locations
  Clone ID: PAT_TA_98980.pep
HGGDTPXCXGHPDRLHRSVXYQXLDNQXTXXLTHLXGVXVVXQXRXRDTLXXACE

SEQ ID NO: 204563 - protein, 93 aa, Triticum aestivum
  unsure (1)..(93): unsure at all Xaa locations
  Clone ID: PAT_TA_98981.pep
LQEFGTSPIPPRVLTXCREKCIIQKXNNFKQAGERYRSFDPARQDRFIQRWVDALTDPRVXHEHRTIWXSYWSQCDAALGXKLASRLNLKXSM

SEQ ID NO: 204564 - protein, 61 aa, Triticum aestivum
  unsure (1)..(61): unsure at all Xaa locations
  Clone ID: PAT_TA_98982.pep
AKTPGLQRPQXXARAKSGSDPNXXQTRFPWSTPXAXQSXKLVKGXFHXSXEAPKXXTPXXP

SEQ ID NO: 204565 - protein, 143 aa, Triticum aestivum
  unsure (1)..(143): unsure at all Xaa locations
  Clone ID: PAT_TA_98983.pep
MAPKAAEKKPVATAEKTTAGKKPXAEXRAPASXEAGGEGKTRGRKKGSKAKKSVETYKIYIFKVLKQVHPXDVGISSKXMSIMNSFINDIFXKLAXXSRPKLVRYNKXATITSRXEXQXSVRLXLPGXLAXHAVLPGTGSPSP

SEQ ID NO: 204566 - protein, 165 aa, Triticum aestivum
  unsure (1)..(165): unsure at all Xaa locations
  Clone ID: PAT_TA_98984.pep
RGCSCCGPPAPGRRPRSSPAPGGDPASCRSPSPVSRPPHQDHHRVGSXGRAXGGAMPSPSPSPLRSPATRSPXRGRPRTGRPARLRKRRNGHRARRLSXGSKPPGGSPKRGGCRWRCTGGAGRLPAKAWDKGPPSSTPGGSSPDPPYQPPLLQRSIAPGMGTNLP

SEQ ID NO: 204567 - protein, 136 aa, Triticum aestivum
  Clone ID: PAT_TA_98985.pep
CYVSLIPFTKWQNSHFIVTIVAWVTLIHSARVPCTTDKALLSEASIPAAMCIGEADPATLLVRASWMCYRCPPGPTEDLCVVVPQAHLDSKVTCEEVRCDVLAHSDWNKCLFSCSSEHPRPLVCKGHPRCLPSPQI

SEQ ID NO: 204568 - protein, 148 aa, Triticum aestivum
  unsure (1)..(148): unsure at all Xaa locations
  Clone ID: PAT_TA_98986.pep
MALPNQNTVXXPSFKLLIXGDGGTGKTTFVXRHLTGEFEKKYEPTIGVEVHPLXFTTNCGKIRFYCWDTAGQEKFGGLXDGYVYXMXQCAIIMFDVTSRLXTYKXNVPTWDRDLVXXFVXNIPXIVLCGXRFARNALRAKARVNIPTE

SEQ ID NO: 204569 - protein, 136 aa, Triticum aestivum
  unsure (1)..(136): unsure at all Xaa locations
  Clone ID: PAT_TA_98987.pep
MYTARKKIXKDKGVEPSEFEDTVAQAFFDLENGNQELKSDLKDLYINTAIQMDVVGNRKAVVIHVPYRLRKPFRKIHVRLVRELEKKFIGKDVVFVATRKIVRXPKXGSAVQRPRTXTLTXAVQXGILGXDVVYPS

SEQ ID NO: 204570 - protein, 132 aa, Triticum aestivum
  unsure (1)..(132): unsure at all Xaa locations
  Clone ID: PAT_TA_98988.pep
PTWEXSLQXAXTLMPAKXXGRASSARPSXXVXRAFGVDXGARITCSLQXSDIREVASKCADAAXIAGFXLXXSXLLVSGAXAEGGPNRXLTFDXIQSKDLHWRXEGYRATXNNXRXXYGGVDSLXPSXAGKL

SEQ ID NO: 204571 - protein, 134 aa, Triticum aestivum
  unsure (1)..(134): unsure at all Xaa locations
  Clone ID: PAT_TA_98989.pep
MKAKAGSRAGDSRLTVNKSKAXEKDPNKPKRPPSAFFVFMXTFRXEXKEKHPXVKQVXVVGXAGGXKXKSLSDAXNAPYTAXAEKXMAXYTKKXINAYNXPNRAREEASGDSDXSXXXVNDHGQRXXDPIDRPH

SEQ ID NO: 204572 - protein, 123 aa, Triticum aestivum
  unsure (1)..(123): unsure at all Xaa locations
  Clone ID: PAT_TA_98990.pep
MADQLTDEQIAEFXEAFSLFDKDGDXCITTKELGTVMRSLGQNPTEAELQDMINEVDADXNXTIDFPEFLNLMAKXMXDXXSEEEXXEAFRVFXDKEQNXFISXXXLRQXXTXPGLTGPGSPK

SEQ ID NO: 204573 - protein, 142 aa, Triticum aestivum
  unsure (1)..(142): unsure at all Xaa locations
  Clone ID: PAT_TA_98991.pep
MAGRKGGDMKKAVTRSVKAGLQFPVGRIGRYLKKGRYAQRVXSGAPVYLAAVLEYLAAEVLELAGNAAKDNKKTRIIPRHLLLAVRNDQELGRLLAGVTIAHGXVIPNINSVLLPKKSXPQAEKEAXXPKXEGRHQXPPXXK

SEQ ID NO: 204574 - protein, 140 aa, Triticum aestivum
  unsure (1)..(140): unsure at all Xaa locations
  Clone ID: PAT_TA_98992.pep
EFETLSYXXXLSTEALLKQVDYLIRSKWVPCLEFSKVGFIFREHNASPGYYDGRYWTMWKXLPMFGCTDATQVINRGGKRSRKEYPDAYVRIIGFHKHAPRCSAVSFNXPSXQPGRRSPGKGPKTSSITTGYSANCVLKP

SEQ ID NO: 204575 - protein, 138 aa, Triticum aestivum
  unsure (1)..(138): unsure at all Xaa locations
  Clone ID: PAT_TA_98993.pep
MAGRKGGDRKKAVTRSVKXGLQFPVGRIGRYLKKGRYAXRVGSGAPVYLAAVLEYLAAEVLELAGNAAKDNXKXRIXPRHLLLAVRNDXELGRLLAGRHHRPXXGXXPNINSXLLPKKVPRRRRRKEKVQERKAAFPQ

SEQ ID NO: 204576 - protein, 73 aa, Triticum aestivum
  unsure (1)..(73): unsure at all Xaa locations
  Clone ID: PAT_TA_98994.pep
VAXPXXXIXSHCGVSDDPQCWHLFPLFAGHGAEGASLLDRLLFFFFEGFLGRCTDGGASGSQMGLSGGELMTG

SEQ ID NO: 204577 - protein, 116 aa, Triticum aestivum
  unsure (1)..(116): unsure at all Xaa locations
  Clone ID: PAT_TA_98995.pep
NPAVVLRRRRGTQSVPVDDAARPQLVVFWDLTAARYDASPEPHSGYYFVAVAGADVXLAVGDLAAEFVEERFEGRIPKAAALTVPFARRERVVAPDPAAMHTRRVRFAGGRPGSRK

SEQ ID NO: 204578 - protein, 58 aa, Triticum aestivum
  unsure (1)..(58): unsure at all Xaa locations
  Clone ID: PAT_TA_98996.pep
AAFREVRARRRGRRDGQQGRXEEEXGEAXPSXPXXISXSXASGASSXXAAXPXAXGPA

SEQ ID NO: 204579 - protein, 157 aa, Triticum aestivum
  unsure (1)..(157): unsure at all Xaa locations
  Clone ID: PAT_TA_98997.pep
LXSXLGRLXXXCXFXXEPPGXPSRGAGPPQFRRKXAGHLPPPGXTTMRHEAGSPRPFPGALRAARRRRAQWRRGERRGGAPAPAQEHSILRRIGLLPCKNRTARAAQLAAPSFLCRRISQATGLTGAHERCADSAASQSSRWSVVTAGARRFSLWMK

SEQ ID NO: 204580 - protein, 164 aa, Triticum aestivum
  unsure (1)..(164): unsure at all Xaa locations
  Clone ID: PAT_TA_98998.pep
TGXTNSXIRRGQRPEEVDGAPYIRFQAPEANGATPGHRKLMSEPRCPRGRGAGPASAATPDEQAGPHHHPRPPPRRTRDPLPERRSSREPRRRPPRRPHGLARRLPPTTARERGSMRVAARRNPSRPRGQCRVVSEEEKSTKSYRRNITHAYKMTGNMGRLENN

SEQ ID NO: 204581 - protein, 147 aa, Triticum aestivum
  unsure (1)..(147): unsure at all Xaa locations
  Clone ID: PAT_TA_98999.pep
NKRGAWAAPXPSPPRPPPXLPQPRPPWSLSRPRRAPRPPVRPQLLARAPSSPLPQLLPAPPPWSPQPRRGQAPRLRPPPARGLPPSSRPPRRRPASPPRAPPPSARPMGSGHQRWPLPSWMQENDRSGRGWLAEASATLIRECEARV

SEQ ID NO: 204582 - protein, 105 aa, Triticum aestivum
  unsure (1)..(105): unsure at all Xaa locations
  Clone ID: PAT_TA_99000.pep
KDRKVAGNFFQPQLTQRIQPPRERSEWEGRVWILAEPGARTHARTHAQDGERRQPEAAVLCLMRKSGTKEGIEGSIGFKHGIDVNPSSVSTQTGGTPIXFDDSSV

SEQ ID NO: 204583 - protein, 118 aa, Triticum aestivum
  unsure (1)..(118): unsure at all Xaa locations
  Clone ID: PAT_TA_99001.pep
QGDKFVFRSTRDGGKDKFHKNLYIMEDAEEGEFGHGTVXRLTXGPWXDTHCIWSPKGDWIFFSSTREMPASAPXDXPXLDSGYFAXYLXKVTDPXVVVRXVQXSATLAGXFNXXXFQA

SEQ ID NO: 204584 - protein, 151 aa, Triticum aestivum
  unsure (1)..(151): unsure at all Xaa locations
  Clone ID: PAT_TA_99002.pep
MAGRKAGDRKKAVTRSVKAGLQFPVGRIGRYLKKGRYAQRVGSGAPVYLAAVLEYLAAEVLELAGNAAKDNKKTRIIPRHLLLAVRNDQXEXGKLLAGVNIAHXGLIPNINSVLLPKKSPARRREGXQSRPTKERXTPSSPXKEERRKGVP

SEQ ID NO: 204585 - protein, 106 aa, Triticum aestivum
  unsure (1)..(106): unsure at all Xaa locations
  Clone ID: PAT_TA_99003.pep
YXXXGAHSIQIPIISVKFXIVTSGAPXGRNARAPNRFPAKSSVDTIPTTTPLSEQNTTDHAQRPDGHRQWNTGNQKLKSGFQEIIRHNWNTAPNSNNPNLKGVHLS

SEQ ID NO: 204586 - protein, 156 aa, Triticum aestivum
  unsure (1)..(156): unsure at all Xaa locations
  Clone ID: PAT_TA_99004.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNSAPSNAKXRVTNMPKDXKLARRIRXEEGLKAPLSFYKGFLGLKPVLA

SEQ ID NO: 204587 - protein, 94 aa, Triticum aestivum
  unsure (1)..(94): unsure at all Xaa locations
  Clone ID: PAT_TA_99005.pep
RRRRPRWRSRSPPRRSRRRRKPPRRWRPKSRRLPPSRLRRPRRRRRQQLRQRRRRXPSQXLRPNRSRGXPPVGRDRXPXRPVAAAAAREKRRLV

SEQ ID NO: 204588 - protein, 155 aa, Triticum aestivum
  unsure (1)..(155): unsure at all Xaa locations
  Clone ID: PAT_TA_99006.pep
MAPKAAEKKPVAVAAEKTAAGKKPKAEKRAAATKEAGGEGKTRGRKKGSKAKKGVETYKIYIFKVLKXVHPDVGISSXAMSIMNSFINDIXXEKLAXESXAKLARFXKEAQHYVPGRFNTSVRLXLPRXXSQCKPVXGGAXXAVNXFTSIKVSSV

SEQ ID NO: 204589 - protein, 138 aa, Triticum aestivum
  unsure (1)..(138): unsure at all Xaa locations
  Clone ID: PAT_TA_99007.pep
GFGRIGRLVARVALQSDDVELVAVNDPFITTEYMTYMFKYDTVHGHWKHSDIKLKDDKTLLFGEKPVTVFGVRNPEEXPWGEAGAXYVVESTGVFTDKDXAAAHLXGGCQRXWSXPAPSKRXPPXFXGWSMKDKPPDG

SEQ ID NO: 204590 - protein, 150 aa, Triticum aestivum
  unsure (1)..(150): unsure at all Xaa locations
  Clone ID: PAT_TA_99008.pep
RGEREPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFTVYPSPQVSTSVVEPYNXSVLSTHSPSLKHTGXVLILPKHPMTICPA

SEQ ID NO: 204591 - protein, 112 aa, Triticum aestivum
  unsure (1)..(112): unsure at all Xaa locations
  Clone ID: PAT_TA_99009.pep
AXVXYRCFVGGLAWATDXHSLQNAFSKYGDVIXSKIITDRETGRSRGFGFVTFASDEAXRQAIXAMNGHHLDGRNIXVNDXHSRXSGXGGGGGFGGGXXGYXGHXREXRCGG

SEQ ID NO: 204592 - protein, 154 aa, Triticum aestivum
  unsure (1)..(154): unsure at all Xaa locations
  Clone ID: PAT_TA_99010.pep
GVQPSXFXDTVAXAFFDLENGNHELKSDLKDLYINTAIQMDVVGNXKAVVXHXPYRLRKPFXXXHVRXXRELQKXFSGKDVVFVXTXKXXRPPKXGSAVQRXXTXXLTXVHXXILXDVVYPXENCGEACQGXXLDGAKGQNLWKQTTTGQSLGE

SEQ ID NO: 204593 - protein, 91 aa, Triticum aestivum
  unsure (1)..(91): unsure at all Xaa locations
  Clone ID: PAT_TA_99011.pep
VQTGRLSXXTVLXAGYXFAMTQRYNTNKSIXVSFKKXXGYNNAXIXGTXTTMLGAXSRSGHXFDHSTTKGQRTCMPSXLQSVRPXFKXXVP

SEQ ID NO: 204594 - protein, 121 aa, Triticum aestivum
  unsure (1)..(121): unsure at all Xaa locations
  Clone ID: PAT_TA_99012.pep
MADQLTDEQIAEFKEAFXLFDKDGDGCITTKELGTVMXSLXQNPXEAXLXXXINXVXADXNXTIXFPEFLXNLMARXMKDTXSEEELXESVXPCXXNEQKXLXLXRAEXXHLDTLPGRTGP

SEQ ID NO: 204595 - protein, 100 aa, Triticum aestivum
  unsure (1)..(100): unsure at all Xaa locations
  Clone ID: PAT_TA_99013.pep
RPPPTXLRAPVPRRLISVXASRLDPCLALPFPSPHXXRAVPPRPSPARRPPVFRRAPWPCPALXQLSXPTGPRXNTAHXVXRPCFKLLDPXNVLKHQGSQ

SEQ ID NO: 204596 - protein, 119 aa, Triticum aestivum
  unsure (1)..(119): unsure at all Xaa locations
  Clone ID: PAT_TA_99014.pep
MDSSRAALFCFLAVASSLLHPARXDXEXXQLXXGIXXYRASLKVXALTQNXNADCLAEQLXKKFXGQXASTPTGANNVPXTEAAVXRLTPSSSDRWQPQPVPFTRGKGDCPAMPGGPDF

SEQ ID NO: 204597 - protein, 87 aa, Triticum aestivum
  unsure (1)..(87): unsure at all Xaa locations
  Clone ID: PAT_TA_99015.pep
EEDLIQPPRGTRTVEGLRLNTRVGVQYLAAWLGGSGSVPLYNLMEDAATAEIXRXXNWXWLRHGAVLDAGGVAVRXXPXLLXRVXXE

SEQ ID NO: 204598 - protein, 71 aa, Triticum aestivum
  unsure (1)..(71): unsure at all Xaa locations
  Clone ID: PAT_TA_99016.pep
MATTAXXGGRGXXKGNXXVSXXVKGGLQFPVCRXXRHLKXGRXXKRVGAGAPVLPRPSSFARPFLARLGRR

SEQ ID NO: 204599 - protein, 63 aa, Triticum aestivum
  unsure (1)..(63): unsure at all Xaa locations
  Clone ID: PAT_TA_99017.pep
XGVNCRHCPYSXWRPDXPPXCXXQPTWRXXWRRXXDLAPFMAGFLGGGGGGERALXVWVXERR

SEQ ID NO: 204600 - protein, 138 aa, Triticum aestivum
  unsure (1)..(138): unsure at all Xaa locations
  Clone ID: PAT_TA_99018.pep
MARXNXTARKSTGGKAPRKQLATKAARKSAPATGGVKKPHRFRPGTVALREIRKYQKSTELLIRKLPFQRLVREXXXDFKTDLRFQSSAVXALQEAAXAYLVGLFXDTXNLCAIHXKARSTXNAPKDIXLAPAAIPEP

SEQ ID NO: 204601 - protein, 104 aa, Triticum aestivum
  unsure (1)..(104): unsure at all Xaa locations
  Clone ID: PAT_TA_99019.pep
MGRVRTKNXNKTSRQVIEKYYSRXTLDFHTNKKVLEEVXILXSKRLRNXVGGFTTHLMRRIHRGPXXGIXLKLQEEEAFAANSFRFATSKSDGRPDNAFLPHTS

SEQ ID NO: 204602 - protein, 162 aa, Triticum aestivum
  unsure (1)..(162): unsure at all Xaa locations
  Clone ID: PAT_TA_99020.pep
LNWLYSVLVNEYSDVNRTYHDAAEALSNYPSLSPKTEPYTYENGSSALLLLLSGTLPVTFRGATYGFPVAIWVPXSYPREPPIVYVTPAQDMVLRPGXQHVSTDGXIYHPYLAQWGXYWEKSKLXDXLAVXKXGSLXKKQXXANXPXNKQARQYKAKPKATP

SEQ ID NO: 204603 - protein, 127 aa, Triticum aestivum
  unsure (1)..(127): unsure at all Xaa locations
  Clone ID: PAT_TA_99021.pep
MARLNSKAVVSAVVLAAVVLMMAGREATALSCGQVDSKLAPCVSYVTGKAPSIXKECCSGVQGLNGLARIKPDRXIACRCLKXSLATIIKSXKHGXRSPAFPGKXGXSXPPSPIQCTAKNGPFIKPL

SEQ ID NO: 204604 - protein, 61 aa, Triticum aestivum
  unsure (1)..(61): unsure at all Xaa locations
  Clone ID: PAT_TA_99022.pep
RIXTXHXNTWKQDLXWXLSASXVAPSNCYAESKEAPLSFLNTTNXPVLISSQQIQNXKVGG

SEQ ID NO: 204605 - protein, 128 aa, Triticum aestivum
  unsure (1)..(128): unsure at all Xaa locations
  Clone ID: PAT_TA_99023.pep
KKLXTKKGGAXXXKXFQXXRTKKXGKGGDLPAXERXXXWLGGCXGACXXAVVWRRGCXXXMRXQGARGGLPCACQAGGRAPHGXPPGLLXHALSXTXCSSXVXLQPPLLCAXHAXLAANAPFXPAAVG

SEQ ID NO: 204606 - protein, 108 aa, Triticum aestivum
  unsure (1)..(108): unsure at all Xaa locations
  Clone ID: PAT_TA_99024.pep
MVKAVAVLTGSXGVKGTIFFXQEGDGXTTXTGXXTGLKEGLHXFHVXHXLGDTTNGCXSTGPHFKPRLVMCMGPNSCLVNLKCDWKPGGVTSNLPSPSGSTIQFFPLF

SEQ ID NO: 204607 - protein, 54 aa, Triticum aestivum
  unsure (1)..(54): unsure at all Xaa locations
  Clone ID: PAT_TA_99025.pep
KSXGSPRTGVGXFXGXTIGXGXSXAIXCAPKPTEAXAKERXLXPWDXGEWRAAX

SEQ ID NO: 204608 - protein, 112 aa, Triticum aestivum
  unsure (1)..(112): unsure at all Xaa locations
  Clone ID: PAT_TA_99026.pep
VTKKXSPVPKNXXLIPLXLHDXRLVQRPTLLVXLVIXLWMPFGFALALLXVXIKXPLPEXIXFXIYHXMGIKLIXNGNXPPXPXXGSPGVXFXAXHRTXLDXNXXSAXALAK

SEQ ID NO: 204609 - protein, 137 aa, Triticum aestivum
  unsure (1)..(137): unsure at all Xaa locations
  Clone ID: PAT_TA_99027.pep
SAGXTHRERKEARGGTXXMGCYXVCXEQRKXPPWWWRQXWAPXMALXRPXXPVPLGXXAPLALTPXRRRAXGPRPVXLXLRSSSRPRLPHRRLFSRRMRNXAMGHHPXLAWGXQXEVLLSASLXPXGHNXAYIKXAX

SEQ ID NO: 204610 - protein, 125 aa, Triticum aestivum
  unsure (1)..(125): unsure at all Xaa locations
  Clone ID: PAT_TA_99028.pep
MKHHFESKADSGASKTYPQQAGAIRKGGHIXIKARPCKVVEVSTXSKTGKHGHAKCHFVAIDIFNGKKLEDIXPSXHNCDVPHVDRQDYXLIDINDDGYXSLLTEEWQHXXMTXSFPTDDSAPNW

SEQ ID NO: 204611 - protein, 68 aa, Triticum aestivum
  unsure (1)..(68): unsure at all Xaa locations
  Clone ID: PAT_TA_99029.pep
LXSSTTTITRRRPPSSRAGLGXRSGAXNTNXAAGQARGXNXDGTPVAEAGEWALVGDGRGEXGGLRLA

SEQ ID NO: 204612 - protein, 131 aa, Triticum aestivum
  unsure (1)..(131): unsure at all Xaa locations
  Clone ID: PAT_TA_99030.pep
MATVPAPATAASTARTVXDVNPHEFVKAYSAHLKRSGKMELXEWVDIVKTAXFKELPPSDADWYYIRAASMARKXYLRQGIGIXGFXKXYGXRXXEXGSTPXXLXAXXQXVLFSNPPGIGAINFPQVGRIT

SEQ ID NO: 204613 - protein, 123 aa, Triticum aestivum
  unsure (1)..(123): unsure at all Xaa locations
  Clone ID: PAT_TA_99031.pep
AITSLSTLNYXRTSILLQYFMEHGEVLTPQQVAKQEHILPFWSSWRKLLRVKLPHELXHLGAKASMLTHSDMLLIAKTRSYYSNANYFLLDKESKCSYLHPQSRQVATDVLKSFIHGTXLXNA

SEQ ID NO: 204614 - protein, 114 aa, Triticum aestivum
  unsure (1)..(114): unsure at all Xaa locations
  Clone ID: PAT_TA_99032.pep
RQKXEGXPAXQVRAXXELIXGPALXADAHRHVPLRHLGAAAAGRRRGLLRRAELPVRRGGSRGGGVGRGDAGEPSEEALHGAGGGGGEEKSWVLGAGEGRESAGVKALVCLQWT

SEQ ID NO: 204615 - protein, 77 aa, Triticum aestivum
  unsure (1)..(77): unsure at all Xaa locations
  Clone ID: PAT_TA_99033.pep
WWRXSSLXXGFSXYXNENVXCRXPPXWRRARTRPXXACRARRXAGXXRRRXRLLXPPXYXCVXFLASSSFRXRAHSS

SEQ ID NO: 204616 - protein, 90 aa, Triticum aestivum
  unsure (1)..(90): unsure at all Xaa locations
  Clone ID: PAT_TA_99034.pep
LGGRDXTNXFGPSIHSXTXRLXXGRISRSLQLQQQQQXASHGNPQXANARRXRSQXVRSIPPASPPQQQVDKLRDRSPAXYLRVFFVRRW

SEQ ID NO: 204617 - protein, 91 aa, Triticum aestivum
  unsure (1)..(91): unsure at all Xaa locations
  Clone ID: PAT_TA_99035.pep
XAPXNXVGFPXGCKEIXQRXAKATXXETXXNXKKRXPXRGLPXRXWEASGCCXXAELLDGRTRSAPPSPAAMAFSXXPRRLPTXQXEMVEP

SEQ ID NO: 204618 - protein, 118 aa, Triticum aestivum
  unsure (1)..(118): unsure at all Xaa locations
  Clone ID: PAT_TA_99036.pep
XXAFXDTXAGVXGLVXXGXTXLPPXXRQSPESLXGITXSNHDAXAIPXVXLSAXRRXDTVAXVLXLXRDSGLLXCGQPQRARLKLIGRHALKSXXXVXLNGXRPRRXXRXIYNKGSKA

SEQ ID NO: 204619 - protein, 87 aa, Triticum aestivum
  unsure (1)..(87): unsure at all Xaa locations
  Clone ID: PAT_TA_99037.pep
XNXSSLFPLLVPIAAXPPPLEFLXXIAXLLPIPXPXXSSHXXLLQWKTXAXVXVPXSAXRAALPFPXPXKXQGXXFAXPPXRXXWGA

SEQ ID NO: 204620 - protein, 134 aa, Triticum aestivum
  unsure (1)..(134): unsure at all Xaa locations
  Clone ID: PAT_TA_99038.pep
FXRXALXGYDAPKTKXPPSRTCNCWPXWCVCCFXFGNRKNXKKVXXPKTEKKKRLFXXKEENQSPXYALSXIDXAXAGAETHXAGIXNYQKXXKKFGQXXVFVASTLLENXGTXRGDNPTFSSEXKPXHXXGCG

SEQ ID NO: 204621 - protein, 137 aa, Triticum aestivum
  unsure (1)..(137): unsure at all Xaa locations
  Clone ID: PAT_TA_99039.pep
MCCSECGCYDAFCDCCCPCVSYDARETILCCAACLAVLAGVVLXXVLLAAYGFIRRPXVAVVDASLTRLALATSPATAFAXKLSLTLTVRNKKLGPLSVKEHQAGWXADLQLSXXPALSKRGQGFSXPRXSXPPPPG

SEQ ID NO: 204622 - protein, 96 aa, Triticum aestivum
  unsure (1)..(96): unsure at all Xaa locations
  Clone ID: PAT_TA_99040.pep
KEKRXXEVPPHHXRXGRAGLLGGVGQRGGGDXVVXDXRPLHLPRAGVRRRLLXVLRRRGRDHGXVGXILLGRRLLAGRLQLQLQVDGLXEAPLAGG

SEQ ID NO: 204623 - protein, 125 aa, Triticum aestivum
  unsure (1)..(125): unsure at all Xaa locations
  Clone ID: PAT_TA_99041.pep
DFAKFLAGFSNITKLVICTRHSPLNGAIILERLQCKFGNLKSLTLYTQFCELPSILSTYCLLRNAPNLERLKILIDNSAEQKFEAHEEFQNSQWTGGMCANLQXVQITGIHWLXNEMTFIELILL

SEQ ID NO: 204624 - protein, 86 aa, Triticum aestivum
  unsure (1)..(86): unsure at all Xaa locations
  Clone ID: PAT_TA_99042.pep
NXXNPGXXRIRXEXXXXFPPPPXVXXPLFSRSIGTAXTVXXSXXKIXERGGGEGGGLXGGXTPEEEEEEAXTARLGERGCDEVGAG

SEQ ID NO: 204625 - protein, 60 aa, Triticum aestivum
  unsure (1)..(60): unsure at all Xaa locations
  Clone ID: PAT_TA_99043.pep
MXDGEDIQPLVXCXNXTGMVKAGFAGDDAPRAVFPSISWSPLGTMGVMVWMGAXRDIFRW

SEQ ID NO: 204626 - protein, 104 aa, Triticum aestivum
  unsure (1)..(104): unsure at all Xaa locations
  Clone ID: PAT_TA_99044.pep
MAMEGYXRQFWQFXDXLRLXTGXFSXLSLGDSIWSPADAAPRARNAEPXLFSPSXAGQKNXXNXXXRRQXXRGALKGPXLXGSGKLXXWGQQKRQKAFPPRAKA

SEQ ID NO: 204627 - protein, 101 aa, Triticum aestivum
  unsure (1)..(101): unsure at all Xaa locations
  Clone ID: PAT_TA_99045.pep
SXRAXTIXPGRXHRSGAMERATXGXEPAXLXXRTAHLVGQGXLXLRRLXRRPXPPQPQXGWGDYXGHXXPXVIHHQAEDLXNNFKEIXCXXLKDXKKXXGE

SEQ ID NO: 204628 - protein, 80 aa, Triticum aestivum
  unsure (1)..(80): unsure at all Xaa locations
  Clone ID: PAT_TA_99046.pep
LRTRAASTXXGKADTSKKGEGRLKAAGGASKRKKDAAAAGKPKXRPPSAFFVFMSEFRQQYNXGETQQQEXLQRLSKAAG

SEQ ID NO: 204629 - protein, 82 aa, Triticum aestivum
  unsure (1)..(82): unsure at all Xaa locations
  Clone ID: PAT_TA_99047.pep
KYMMGXFLHWHNFIXGIHINVNIFPVALRTIXEMGGLRRIFYINWQIQPSYIISLDNINFCQKRPFIVYYSKLSCNYMVFQK

SEQ ID NO: 204630 - protein, 94 aa, Triticum aestivum
  unsure (1)..(94): unsure at all Xaa locations
  Clone ID: PAT_TA_99048.pep
TFDYNFSAXQXEINSVXHKVYLHYHIHTXFSIYIXSXVIXXLPGRXAIXLMLRTKETLLENVSTRQGKLILQTSRYLFIITYKICVQTIXISLV

SEQ ID NO: 204631 - protein, 62 aa, Triticum aestivum
  unsure (1)..(62): unsure at all Xaa locations
  Clone ID: PAT_TA_99049.pep
DETXADEXSYGTGKMVGGXNPSSGWGRWRRRLEXDRXCCLRXXSXXGXCLXRKXXGGXRHGG

SEQ ID NO: 204632 - protein, 74 aa, Triticum aestivum
  unsure (1)..(74): unsure at all Xaa locations
  Clone ID: PAT_TA_99050.pep
QPNPHPLPLLHARELFNPPREREAKEXLHIQGGQCGNQIXSNFXEVXCDQXRHXXHRGGXXAPPTCMLXRXNVY

SEQ ID NO: 204633 - protein, 72 aa, Triticum aestivum
  unsure (1)..(72): unsure at all Xaa locations
  Clone ID: PAT_TA_99051.pep
MGISRDSMHKRRATGGKXKAWRKXPKYELGRQPANTKLSXQQDKFRRVXVFAXGNXKWEGSPVFDTGNFSWG

SEQ ID NO: 204634 - protein, 144 aa, Triticum aestivum
  unsure (1)..(144): unsure at all Xaa locations
  Clone ID: PAT_TA_99052.pep
LEIXXLXHXAXPPKNFPCFPRQSXXNXGXPALGAXSGRVRARALRKSHNLHIRRRAGGXAQALLLQRRPWPAASFRTSQDLVEIARDTRGLGFGLWESSVSGVREHERRGGRRLPAGLWQVGSQASDCSGKHEHARERGVGDAV

SEQ ID NO: 204635 - protein, 89 aa, Triticum aestivum
  unsure (1)..(89): unsure at all Xaa locations
  Clone ID: PAT_TA_99053.pep
MEAETAAKRXRENEGAAAADRTWXXAGISAVIPGXFSEXSPMXPGEAHXLKXEKVXFQXQVXLPXTLLVFXSSTYXGPPNGVDSVDLRG

SEQ ID NO: 204636 - protein, 142 aa, Triticum aestivum
  unsure (1)..(142): unsure at all Xaa locations
  Clone ID: PAT_TA_99054.pep
QLKYAESKVREAGLEDHITFLLCDYRLIPPYKYDAIISCXMIXHVGHEYMDEFFACCEXYLAEXGIXVLXFIXIAXERYXNTKEGXHXVKXYIXXGGCSPSLAXXMSXMTXSSRXXIXHVXXIXANHYXTLMHXRGLHLANK

SEQ ID NO: 204637 - protein, 83 aa, Triticum aestivum
  unsure (1)..(83): unsure at all Xaa locations
  Clone ID: PAT_TA_99055.pep
ERXXXEGXWXXHHPRVKXSXAVAWXXRAYXPCGGHLCXSLWKGMXPPXXAXSLGAXFXNNISFDCGLVXTXREQEQHVSMXVA

SEQ ID NO: 204638 - protein, 118 aa, Triticum aestivum
  unsure (1)..(118): unsure at all Xaa locations
  Clone ID: PAT_TA_99056.pep
SHISSQLAAITNEHAFYXDPIEXKAGQAAXFLNILPKFCXAFSSMVEGKNEXISTIEXSGGAHIHXIFQSXXVKSLXGVXPLCLKDTHGYQKCSRALLFPERWPFCVLFPSKIKHPGG

SEQ ID NO: 204639 - protein, 124 aa, Triticum aestivum
  unsure (1)..(124): unsure at all Xaa locations
  Clone ID: PAT_TA_99057.pep
MSDTDEHHFESKADSGASKTYPXQAGAIRKGGHIVIKARPCKVVEVSTSKTGKHGHAKCHFVAIXDIFNGKKLEDIXFPSSHNCGRSPXVDRXXFXXLDWTITGMIGXXVKXFQEEVGKPGDCT

SEQ ID NO: 204640 - protein, 69 aa, Triticum aestivum
  unsure (1)..(69): unsure at all Xaa locations
  Clone ID: PAT_TA_99058.pep
KNRLXCRGPRKXAXVXLXPLXLIXAEXQWQIVQSFSVTACRRQSEKXXMESGSGDXQAALXFPSRRRKK

SEQ ID NO: 204641 - protein, 66 aa, Triticum aestivum
  unsure (1)..(66): unsure at all Xaa locations
  Clone ID: PAT_TA_99059.pep
RRFEPPPNQQQSTGXAAMARXKQTARKSTGGKXPRKQLATKAARKSAPTTGGVKKPHRYRPGTVGL

SEQ ID NO: 204642 - protein, 87 aa, Triticum aestivum
  unsure (1)..(87): unsure at all Xaa locations
  Clone ID: PAT_TA_99060.pep
MVSEQTPVTTEPELESGDAAPVIKAEEPAEDGAPVVEDVKEGDGDEDXEEDEDDDEDDEDEDGNHVPAPFCISTLPCDIFFQLHCTV

SEQ ID NO: 204643 - protein, 111 aa, Triticum aestivum
  unsure (1)..(111): unsure at all Xaa locations
  Clone ID: PAT_TA_99061.pep
SIHIGQAGIQVGNACWELYCLEHGIQPDGQMPGDKTVGGGDDAFNTFFSETGAGKHVPRAVFVDXEPTVIDEVRTGAXRXLFXXEXLIIGNEDASNNFXPSHHCQGLFFIR

SEQ ID NO: 204644 - protein, 122 aa, Triticum aestivum
  unsure (1)..(122): unsure at all Xaa locations
  Clone ID: PAT_TA_99062.pep
AGTQLHRGPRPWQHVHVDHQSSNATAAHHQPAEPSSGEFRPARAAGETKRIDPSVGRPIMILGLGGCCGAAAAAAAVSPAAVGKQLGGHLXASERQQKKRGASDXAXDEQGRRAGSGGSSWG

SEQ ID NO: 204645 - protein, 53 aa, Triticum aestivum
  Clone ID: PAT_TA_99063.pep
KQDPSKAHSPAPAGRRQAAQAQQPNGHHQAPPRRPPSSPVPPSPGRRPYVCPS

SEQ ID NO: 204646 - protein, 96 aa, Triticum aestivum
  unsure (1)..(96): unsure at all Xaa locations
  Clone ID: PAT_TA_99064.pep
GGVDSAAAAQAASFKKANEGRKAYIXXIAXXXALASWXXTFVVCLHALXLXXXXFXXFXXAFXIXLFRXXFMCFGCVTVXVXVXXXFYXSXYXSFL

SEQ ID NO: 204647 - protein, 76 aa, Triticum aestivum
  Clone ID: PAT_TA_99065.pep
HLSQIAAINRLVSLLRPTSPPALPLRSFHLAALVAAGAAQSPPTHPSRVPSPSLHTAPSTPPATVDSGDVRRTPPP

SEQ ID NO: 204648 - protein, 100 aa, Triticum aestivum
  unsure (1)..(100): unsure at all Xaa locations
  Clone ID: PAT_TA_99066.pep
LSSDQPQXHTSTXLQLXSLSHSGHFLASTTAMATADVXNPTAALTEEAPAVGDAGGRRGGPEDGRRSPAPXREAEGXGXLPPSEXFXRDQXMXXSXGXPA

SEQ ID NO: 204649 - protein, 69 aa, Triticum aestivum
  unsure (1)..(69): unsure at all Xaa locations
  Clone ID: PAT_TA_99067.pep
KKQRGXXEXEKKLPPAAAGAAXASSFLAGASAPRFPAAMLRVILGGIAGAAAVATGDLRLGGIARLVDW

SEQ ID NO: 204650 - protein, 89 aa, Triticum aestivum
  unsure (1)..(89): unsure at all Xaa locations
  Clone ID: PAT_TA_99068.pep
MKGTKLAAILILQAVLVMGVLSHVNADFFPKCCNNCRSFSGVDVCDDAHPKCPKGCSACRVVSTXPEMWRCADMKSTVDGTCGGPCKKX

SEQ ID NO: 204651 - protein, 51 aa, Triticum aestivum
  unsure (1)..(51): unsure at all Xaa locations
  Clone ID: PAT_TA_99069.pep
MXVTESXXKXRKRXRXXKEXTRHRKPRVAEPLRREVSACAAHGGEDRRVLR

SEQ ID NO: 204652 - protein, 55 aa, Triticum aestivum
  Clone ID: PAT_TA_99070.pep
MSLAQATKGDMPYQVRSLYRSLLRQGGQFASYNFREYAKRRTRDAFRDHQKEVGE

SEQ ID NO: 204653 - protein, 117 aa, Triticum aestivum
  unsure (1)..(117): unsure at all Xaa locations
  Clone ID: PAT_TA_99071.pep
SGSFVCEYVGEVLQETEAERTENDEYLFDIGRDDDDDEEEEEGSESSKSEMTAEGLGYTIDAAKCGNVGRFINHSCSPNMHAQDVLWDHDDRRXPHVMLFAEKNIRPLQELTYDYLH

SEQ ID NO: 204654 - protein, 101 aa, Triticum aestivum
  unsure (1)..(101): unsure at all Xaa locations
  Clone ID: PAT_TA_99072.pep
GIERWIFDQRFPLETIVEVTESTLVEHGDLKVVATIGGFVYFSTMETFLDGHNPSWFMSLCMETGELATLFXRRFDGHPHPYIMAWPPCXIDNQVHQLEGA

SEQ ID NO: 204655 - protein, 57 aa, Triticum aestivum
  unsure (1)..(57): unsure at all Xaa locations
  Clone ID: PAT_TA_99073.pep
XGFLLRFYSFLSXXGAXMGXXNERNPXXWFNLHQRGSGFXSPXRXAFXXNSSVPQXS

SEQ ID NO: 204656 - protein, 51 aa, Triticum aestivum
  unsure (1)..(51): unsure at all Xaa locations
  Clone ID: PAT_TA_99074.pep
TASXTVNNRXLITYSTTNSKPIFNYLLYTKLLTLLLHYTTGLTEKVSISFN

SEQ ID NO: 204657 - protein, 127 aa, Triticum aestivum
  unsure (1)..(127): unsure at all Xaa locations
  Clone ID: PAT_TA_99075.pep
VGQVKQETPLDSMTGAIVCVTLSDDDDYMMAEEAPTISSSDQVRDPEVAERPMAMVQPASSQADLAPQADSRRHGTKKQASHSKSSGSTCLGAHWKAQGRTQKPWXKXASPAXLANPXKKSVHNTYR

SEQ ID NO: 204658 - protein, 109 aa, Triticum aestivum
  unsure (1)..(109): unsure at all Xaa locations
  Clone ID: PAT_TA_99076.pep
APPPPPSSSTPPARPPGPSSPPPPPPPPPRAPPPPSSQTGGTPRSPPSPXSAGTPPSPPHTPITPTPPPPXTGYAWIAAIPAAVFMLGLGRCNCPPDWETQPSSANQRP

SEQ ID NO: 204659 - protein, 106 aa, Triticum aestivum
  unsure (1)..(106): unsure at all Xaa locations
  Clone ID: PAT_TA_99077.pep
MADXLTDEXIAEFKEXFSLFXKDGDGCITTKELGTVXRSLGQXPTEAXLXDMXNXVXXDGNGTIXFPXFLNXMARKMNETXSXGGSSKGGVSLFQRTKLSSCGAFP

SEQ ID NO: 204660 - protein, 86 aa, Triticum aestivum
  unsure (1)..(86): unsure at all Xaa locations
  Clone ID: PAT_TA_99078.pep
MAAPLLCFAVVAAAALAGASGQELTADYYDXACPQALSAIKLVVGAAVVKEPRMGASLVRLHFHDCFVNGCDGLHSAGTPRTSGEE

SEQ ID NO: 204661 - protein, 110 aa, Triticum aestivum
  unsure (1)..(110): unsure at all Xaa locations
  Clone ID: PAT_TA_99079.pep
LQLACSVCHSGHFLASTXAMATADXHNPTAXLTEEAPAVETPVAXEEVANTXEVPXPVEARSPXACPXRGXCEQRGRTGRRPRXRETKGAXTSXCLXDXXGRRRPKKXXR

SEQ ID NO: 204662 - protein, 102 aa, Triticum aestivum
  unsure (1)..(102): unsure at all Xaa locations
  Clone ID: PAT_TA_99080.pep
MXECISIHIGQAGIQVGNACWELYCLEHGIQPDGQMPGDKTVGGGDXAXNTFFXSENGAGKHVPXAVFVDLXPXXIELXEGTGXLXXQPPFTPVSNLPCRGD

SEQ ID NO: 204663 - protein, 75 aa, Triticum aestivum
  unsure (1)..(75): unsure at all Xaa locations
  Clone ID: PAT_TA_99081.pep
XKXRFGYXXHSKXXNHSFLKMIYPSSSVCXXTILPMGWKKDHTTFIINHLEVILHANSPYISXGVARDQHXMYQE

SEQ ID NO: 204664 - protein, 67 aa, Triticum aestivum
  unsure (1)..(67): unsure at all Xaa locations
  Clone ID: PAT_TA_99082.pep
NGTCCEKYCGCPKMCKNRFRGCHCAKSQCRSRQCPCFAADRECDPDVCRNCWVGCGDGSXGXPXPPA

SEQ ID NO: 204665 - protein, 133 aa, Triticum aestivum
  unsure (1)..(133): unsure at all Xaa locations
  Clone ID: PAT_TA_99083.pep
PAPREDGDQARSDHRLGRVPRRAGGVRGRQHLLQRLDEVTHLQPAALCXRPQGEPLAAGGFSRGVRTQLRLLRQQEVDVLLPQGGRDLEGCPLREARXRPTLGHLGPGLNPVSSFXRTWLXXRGVADCFSVPX

SEQ ID NO: 204666 - protein, 61 aa, Triticum aestivum
  unsure (1)..(61): unsure at all Xaa locations
  Clone ID: PAT_TA_99084.pep
CXGKXLGNSXXDSXIAVHSFSAGXFTSTTSSTLDAIDRSTGMQGCNAXKAXASYLSSEVTV

SEQ ID NO: 204667 - protein, 104 aa, Triticum aestivum
  unsure (1)..(104): unsure at all Xaa locations
  Clone ID: PAT_TA_99085.pep
REPPXNRXEVXNEKNIFXWXEKLXKSLGXQRFLLAAWPXPXQGSKFSELXXRPEREEDGGEEDPPXEGXEPHXNLRRRXAGRGKXPAGYXGXGGXGXAAXXWEL

SEQ ID NO: 204668 - protein, 98 aa, Triticum aestivum
  unsure (1)..(98): unsure at all Xaa locations
  Clone ID: PAT_TA_99086.pep
MXEETPTPVVAPIXAPTLVLGEPMXLMTALQLXXKXSXAHDGLXKGLPLRLPSXXXXHXAQXXXLADDCXXPDYVXXVKALXPEHNXXLGWCQRANLL

SEQ ID NO: 204669 - protein, 100 aa, Triticum aestivum
  unsure (1)..(100): unsure at all Xaa locations
  Clone ID: PAT_TA_99087.pep
MAASLQAAATLMPAKIGGRASSARPSSHVARAFGVDAGARITCSLQSDIREVASKCADXAKMAGFALATSALLXVSGAXAEGAPXRLTFDEXXSKTYNGR

SEQ ID NO: 204670 - protein, 112 aa, Triticum aestivum
  unsure (1)..(112): unsure at all Xaa locations
  Clone ID: PAT_TA_99088.pep
MARAQVMLMAVALVLMLAAVPRAAVAIDCGHVDSLVRPCLSYVQGGPGPSGQCCDGVXKNLHNQARXQSDXQSACNCLKGXARGIHNLNQDNAPXHPPQSAGXXPPNNTNQV

SEQ ID NO: 204671 - protein, 135 aa, Triticum aestivum
  unsure (1)..(135): unsure at all Xaa locations
  Clone ID: PAT_TA_99089.pep
EQPSSDXQXNTKARAMXSXSLXARLLRRAASSXRVSTLSRRXAHSSAMXRAPVXLARFXPPPPPPPPPLQGENDRRFLXXAISXVXLQNXXXRXXEGGSSXLKXKCGPPXRRRXXPHQNFFTXXXFPXRXNDXPX

SEQ ID NO: 204672 - protein, 55 aa, Triticum aestivum
  unsure (1)..(55): unsure at all Xaa locations
  Clone ID: PAT_TA_99090.pep
EKXNIEXIHLIPQHPRAKAAAAGAGPGAHARGEAVEHPAAHAPQPPPHRHSARPC

SEQ ID NO: 204673 - protein, 110 aa, Triticum aestivum
  unsure (1)..(110): unsure at all Xaa locations
  Clone ID: PAT_TA_99091.pep
STSRPGPPPGAAAPRRXPPPPPPPAAAACRAARLPAAACRAARLPAPACRAARXTPTRWPPSGSAASTSLPPTRRRPAPASRPRCXTTTXPSPPXAPGSAPSAGARAPPA

SEQ ID NO: 204674 - protein, 65 aa, Triticum aestivum
  unsure (1)..(65): unsure at all Xaa locations
  Clone ID: PAT_TA_99092.pep
KEXMXNXXEXKXXEXGEIXXPKXVEHHSRTARPSRRGRGSXMRCTGXXRPPSPPRAVCGRFAWRL

SEQ ID NO: 204675 - protein, 81 aa, Triticum aestivum
  unsure (1)..(81): unsure at all Xaa locations
  Clone ID: PAT_TA_99093.pep
GGXXPLXXSXKFXAXXHCXWLSACFXTSSVMXLPVSXLKEXLNFXTPSRXSASPGGQSTXPXGFCAEAQTERRFRLLMMID

SEQ ID NO: 204676 - protein, 74 aa, Triticum aestivum
  unsure (1)..(74): unsure at all Xaa locations
  Clone ID: PAT_TA_99094.pep
QXTHTPRAGIHXXCGQAKPPLTLQEQSGISTGNTPPRRDEAAYDEPRAPRRRLQEGYDVSAPPPPDPGVRVSSG

SEQ ID NO: 204677 - protein, 56 aa, Triticum aestivum
  unsure (1)..(56): unsure at all Xaa locations
  Clone ID: PAT_TA_99095.pep
LASSLRNFQLAIDGSSQQQGCGVRRGPGXXGANXCRQGRXQHXLAGMWDXNLRARS

SEQ ID NO: 204678 - protein, 94 aa, Triticum aestivum
  unsure (1)..(94): unsure at all Xaa locations
  Clone ID: PAT_TA_99096.pep
SVEMHHESLLEALPGDNVGFNVKNVAVKDLXRGFVASNSKDDPAKEAANFTSQVIIMNHPGXQXGNXYAPXLDCHTSHIAVKFAEPVTKXYKXW

SEQ ID NO: 204679 - protein, 84 aa, Triticum aestivum
  unsure (1)..(84): unsure at all Xaa locations
  Clone ID: PAT_TA_99097.pep
EGCPMANCXXTVEKXSXXLTGPDXXEGEGXXFXKVLXLIEDXLWTPWXQTXXGARGXRGIRXCVXGXRPPLPSAAADGGWGPRG

SEQ ID NO: 204680 - protein, 59 aa, Triticum aestivum
  unsure (1)..(59): unsure at all Xaa locations
  Clone ID: PAT_TA_99098.pep
MARGLKXHLKRLNAXSHWMLDKLGGAFAPKPSSGPHXGRECLPLILILRNRLKYALTXR

SEQ ID NO: 204681 - protein, 131 aa, Triticum aestivum
  unsure (1)..(131): unsure at all Xaa locations
  Clone ID: PAT_TA_99099.pep
MGRRPARCYRQIKNKPYPKSRYCRGVPDPKIRIYDVGMXKKGVDXFSHCVHLVSWEKENVXSEALEAARIACNKYMTKXAGKDAFXLTVRVHPFHVLRINKMLFVXPGADRLXDXXIEGCFWXNPHGSGAL

SEQ ID NO: 204682 - protein, 60 aa, Triticum aestivum
  unsure (1)..(60): unsure at all Xaa locations
  Clone ID: PAT_TA_99100.pep
WQXKXVVXLKXXLLGIIVADKXLXXQELHXSVXSSFVGNVLXXFVNXFFFGVXXFVVVPT

SEQ ID NO: 204683 - protein, 79 aa, Triticum aestivum
  unsure (1)..(79): unsure at all Xaa locations
  Clone ID: PAT_TA_99101.pep
NXXSLPRAXWXXSSXYSRPPSLNAGXRFXGXGLXGCXXXLGLXRHRXFLXLGGHGCRXYFAGETRGIVGCAWCFAGRWL

SEQ ID NO: 204684 - protein, 112 aa, Triticum aestivum
  unsure (1)..(112): unsure at all Xaa locations
  Clone ID: PAT_TA_99102.pep
MARAQVMLMAVALVLMLAAVPRAAVAIDCGHVDSLVRPCLSYVQGGPGPSGQCCDGVKNLHNQARSXKRSPKALCNCLKGIXRXIHNLNEDNARSXPPQIAVPSIHHVQFQR

SEQ ID NO: 204685 - protein, 131 aa, Triticum aestivum
  unsure (1)..(131): unsure at all Xaa locations
  Clone ID: PAT_TA_99103.pep
GVRPALPRAPGRPCXDXGADALANCVLGQRQCXHXEXVRRRGGCHVGXGVLFCXXGSTXXRXWHVSWRGXXNGTTVRXVXXLCXYVMXHACVCXIVCVGVNLLCKCXXXCXCXVHXVXNGTKGXXPXXXLK

SEQ ID NO: 204686 - protein, 103 aa, Triticum aestivum
  unsure (1)..(103): unsure at all Xaa locations
  Clone ID: PAT_TA_99104.pep
GSAGEVDVHISETTKTLLKSDDLYDYMXNTMVYXRENEXMXELRQITXSEHVFXFMSSXXDXGLLLSLXLKVXGAKRTIQVGHRGAPFLPPRQSLGRKGRFFS

SEQ ID NO: 204687 - protein, 72 aa, Triticum aestivum
  unsure (1)..(72): unsure at all Xaa locations
  Clone ID: PAT_TA_99105.pep
SXXAPCGXNGYLKRRSRPSSASSRVXIXFSFGVENAIAHKXSSSLLIWVAMVAAXEEELDASAASCEATARA

SEQ ID NO: 204688 - protein, 121 aa, Triticum aestivum
  unsure (1)..(121): unsure at all Xaa locations
  Clone ID: PAT_TA_99106.pep
MASSXXSLAMFXLAIIMAVVAGVXAQNTXXDFVNLHNRXARASDXVGAVTWDNXVARFXPGLLXQSAPPTAXLQHSARGRFXXNILLGGXPWQPGTCPAPFLGGDRKSRGLTLKQPFGSAR

SEQ ID NO: 204689 - protein, 123 aa, Triticum aestivum
  unsure (1)..(123): unsure at all Xaa locations
  Clone ID: PAT_TA_99107.pep
PASSVLTASSQSLASFPRRHPPRKGGCLAAAATAGAAPAASAATAAAGAXCSPTWRPPPAPPPWSCPPPPTRGAPAGSRRPGRPAAATAPPAXAAPRAAAPAAAATEARRPXSRPAXAXHEGM

SEQ ID NO: 204690 - protein, 92 aa, Triticum aestivum
  unsure (1)..(92): unsure at all Xaa locations
  Clone ID: PAT_TA_99108.pep
LERLEAAFGAPVLEXYAMTEASHMMTSNPLPQDGARKPGSLGRXAGXLEVAVLDQAGIXGPRRRSXGEVXXPGXNLTXGYNHXPIPVAKAAP

SEQ ID NO: 204691 - protein, 96 aa, Triticum aestivum
  unsure (1)..(96): unsure at all Xaa locations
  Clone ID: PAT_TA_99109.pep
XFXNGIHRGAAXXSHNWXLLAFSNXGSKGLCNXVXQTFGXCXXXPXXSYXFGPXEXPPKXSFFNFXPLFXXXLLVXXPPPXPNNXXTSXXTPXXFG

SEQ ID NO: 204692 - protein, 88 aa, Triticum aestivum
  unsure (1)..(88): unsure at all Xaa locations
  Clone ID: PAT_TA_99110.pep
MAPKAAEKKPVEKTPAGXKPXAEKKVXASXEGGDKKGXXNAKXSXETYKXYIFKXLNQVHXXIXISSKXXMPSFXSXTXDIFXNLXRP

SEQ ID NO: 204693 - protein, 104 aa, Triticum aestivum
  unsure (1)..(104): unsure at all Xaa locations
  Clone ID: PAT_TA_99111.pep
MARLNXKAVVAAVVLAAVVLMMAGREASAALSCGQVDSKLAPCVAYVTGRASXITXECCSGVHGLNXMAPLRVTITVASPTIQSISNLAFPAPGSSRVPFPTGP

SEQ ID NO: 204694 - protein, 87 aa, Triticum aestivum
  unsure (1)..(87): unsure at all Xaa locations
  Clone ID: PAT_TA_99112.pep
VPAQNMFYVPAXKREXFXYLTDYGMFRFCVXNXELDWXPGTXXYKFIQHCLLXRGPAXASRXSIFLXHRVPGNPSATFLPERDRNPQ

SEQ ID NO: 204695 - protein, 102 aa, Triticum aestivum
  unsure (1)..(102): unsure at all Xaa locations
  Clone ID: PAT_TA_99113.pep
MDASATGAGANSKKGAAGRKAGGPRKKSXVTRSVKAGLQXPVXGRIGRYXLKNGRYRESASXTGRPRLTRPPSKPGRPKLPGASPGNGPKGQTKVLAIVSPV

SEQ ID NO: 204696 - protein, 106 aa, Triticum aestivum
  unsure (1)..(106): unsure at all Xaa locations
  Clone ID: PAT_TA_99114.pep
MARGLKKHLKRLNAPSHWMLDKLGGAFAPKPSSGPHKARECLPLILILRNXLKYALTYXEXQSILMQXHIXLMGKGSXTDKTYPAGFXGQSISISQTTWVEENAFN

SEQ ID NO: 204697 - protein, 137 aa, Triticum aestivum
  unsure (1)..(137): unsure at all Xaa locations
  Clone ID: PAT_TA_99115.pep
MAPKAEKKPAAKKPAEEEPAAEKAEKAPAAKKPKAEKRLPAGKTASKEGGXNKGKKKSKKSVETYKIYIFKVLXKQVHPDXGISSKAMSINXXPSLNDIFRRKRGEGLPLAPPKQKKAPTIPPRGKNTLPVPALRSF

SEQ ID NO: 204698 - protein, 50 aa, Triticum aestivum
  unsure (1)..(50): unsure at all Xaa locations
  Clone ID: PAT_TA_99116.pep
FFFLARERGXXATRELXVXGDHXHXXHAQARQDHXXVGAFXXTVVQXQGG

SEQ ID NO: 204699 - protein, 110 aa, Triticum aestivum
  unsure (1)..(110): unsure at all Xaa locations
  Clone ID: PAT_TA_99117.pep
WAXXSLALAGRPXVPXLXHEERSXCXGPXXLWXXSAQRXPSTXXXGSPCSFGGRRRRNRPLMAXMXXLVLCVXGXFGXXLIEQSLXFGVRXAXLMXIGAXGEGERGEXXS

SEQ ID NO: 204700 - protein, 134 aa, Triticum aestivum
  unsure (1)..(134): unsure at all Xaa locations
  Clone ID: PAT_TA_99118.pep
NPLCGGGIQXTKXEXCWXXSDFXKGXXXSXTXXGGXYGGXWYSXRQQERVFXINPRQEXTXPXQPGSSXARPCSSTKXGNALYDHPSSTTKSSTALSHHPSSTRSNCTTYQLTVLXRCPPWKGQPPHHCYQTMP

SEQ ID NO: 204701 - protein, 78 aa, Triticum aestivum
  unsure (1)..(78): unsure at all Xaa locations
  Clone ID: PAT_TA_99119.pep
SPLRRHGSLIPLXLXSXSPSRSRHXXPNQTASSLSGPLPPPPPXPHLLTCXATWXSADLGGXXRVSMAXMPISPVREN

SEQ ID NO: 204702 - protein, 139 aa, Triticum aestivum
  unsure (1)..(139): unsure at all Xaa locations
  Clone ID: PAT_TA_99120.pep
MFAARSFARAAPRQALARAPARAGRRNYSSESPKQFAGTEDNEFNRERAHIAQHAAESGEFWRKLSLYVAVPCIIVASVNAKVRWDAHWEHVXHEEHENPRSEEARSXHTKNIRTKNYFWXEDGDKXLFWNDKVNYHKK

SEQ ID NO: 204703 - protein, 98 aa, Triticum aestivum
  unsure (1)..(98): unsure at all Xaa locations
  Clone ID: PAT_TA_99121.pep
LKHRLFLKLLXAVLKTGNRLNDGTFRGGANAFKLDTLLKLSDVKGADGKTTLLHFVVQEIIRSEGVRKARLAMESERTQPSGDDNGSVQEDGVLLARA

SEQ ID NO: 204704 - protein, 83 aa, Triticum aestivum
  unsure (1)..(83): unsure at all Xaa locations
  Clone ID: PAT_TA_99122.pep
MARLNXKAVAAAVVLAAVVLMMAGREAXAALSCGQVDSKLAPCVAYVTGRASXXXKECCSGVHGLNGLARNSPXRXITCRCLQ

SEQ ID NO: 204705 - protein, 105 aa, Triticum aestivum
  unsure (1)..(105): unsure at all Xaa locations
  Clone ID: PAT_TA_99123.pep
SXNKALPLTPLNNLLFGXHKLPSTPSVQETLRGTMGGRGKRXHRPRRMGLTRRSKPKGGRMXVGWSXEPWVVXGRXNXGFXPXFQPSLTPKGRQEPPKXXKGGAS

SEQ ID NO: 204706 - protein, 60 aa, Triticum aestivum
  unsure (1)..(60): unsure at all Xaa locations
  Clone ID: PAT_TA_99124.pep
LXVTXGVSPSPXNNPGXLKDTNXCFEASXCVLFSHNPTAVVSSDMIFMXLXHVPNPSLQT

SEQ ID NO: 204707 - protein, 117 aa, Triticum aestivum
  unsure (1)..(117): unsure at all Xaa locations
  Clone ID: PAT_TA_99125.pep
MVKFLKPGKAVILLXGXYAGXKAVXLRVFEEGTPDRPYGHCLVAGLAKYPKKVIRKDSAKNXAKKSPXXVFLKLVNFTXLMPTRYNLRRRPQRRWASRARLPSSDNECGKPAKQAIG

SEQ ID NO: 204708 - protein, 52 aa, Triticum aestivum
  unsure (1)..(52): unsure at all Xaa locations
  Clone ID: PAT_TA_99126.pep
FFFFFFFFXXFXFFXRQSISNPEKHGSHHEYNQTEPNLAHYYNEPWLTSGLQ

SEQ ID NO: 204709 - protein, 120 aa, Triticum aestivum
  unsure (1)..(120): unsure at all Xaa locations
  Clone ID: PAT_TA_99127.pep
VQPSLGPXRQQXXRNGPGVRIXXXLKLPIXXPRNNALXRENXSSKGVSFHSFAQVGSYCMPCQPTSGFLRWVLSLRXGFXIPRVLPMIGGGRXRXDLRAGDGXRGLXISRWQPASXAGRR

SEQ ID NO: 204710 - protein, 115 aa, Triticum aestivum
  unsure (1)..(115): unsure at all Xaa locations
  Clone ID: PAT_TA_99128.pep
MARGLXXHXKRLNAXSHWMLDXLGGAFSPXPSSGPHKAREXCLPLIXIXRNRLKYALTYREVXPILIQRHXMVXGXVRXDXHPTXLGSXDXISIPKTGXNYMLLXYQRLSALSCE

SEQ ID NO: 204711 - protein, 66 aa, Triticum aestivum
  unsure (1)..(66): unsure at all Xaa locations
  Clone ID: PAT_TA_99129.pep
FPPGXGGNFRXEGMRGRGXYPARERLXXGXSTXXIDLIXACTXGGXXCPRXWHVIXRXHXXSIXXG

SEQ ID NO: 204712 - protein, 111 aa, Triticum aestivum
  unsure (1)..(111): unsure at all Xaa locations
  Clone ID: PAT_TA_99130.pep
NTSEXXLVLPTLXXVAXSXDSASLSXPVASSEVSSLSXCLKSSSKXTPRARSVRRSKASXRCGXPXVSAPLHGQHLXADEQIELGLGEAREPPRLLXGAGXAXCSRRRRRR

SEQ ID NO: 204713 - protein, 100 aa, Triticum aestivum
  unsure (1)..(100): unsure at all Xaa locations
  Clone ID: PAT_TA_99131.pep
GGSXILTLAMMHLLHRLLLDWSCRSGGEHGLKMXSVESLQLXRLLLQALQMQLXSPAVHGNEXACPPQXNIMKKLGPXETXWXGSSYXVWRSXSGDVRRP

SEQ ID NO: 204714 - protein, 91 aa, Triticum aestivum
  unsure (1)..(91): unsure at all Xaa locations
  Clone ID: PAT_TA_99132.pep
XEXERXXGETFIXWLRRPKLKPPPGXVLPXTQNSALXRPVXRTWXGGXTNVQAXGXXSYFLRNGVAXRSMRXRLSXGRGXVDRGXXGAPHA

SEQ ID NO: 204715 - protein, 154 aa, Triticum aestivum
  unsure (1)..(154): unsure at all Xaa locations
  Clone ID: PAT_TA_99133.pep
ASSLTASSQSLASFPRRHPPRKGGCLAAAATAGAAPAASAATAAAGARCSPTWRPXPAPPPWSCPPPPTRGAPAGSXRPGRPAAATAPPASAAPRAAAPXAAAATXEPAPXRPAGKXDHEDXGGQATQAPSPXXXPPSRIIHQAALLAGRRNKI

SEQ ID NO: 204716 - protein, 147 aa, Triticum aestivum
  unsure (1)..(147): unsure at all Xaa locations
  Clone ID: PAT_TA_99134.pep
XPKNXLGFPRGWQRNSGNQAKXAXAKGGNPPSSPQSKPNGXFLSNPNNFPSPXPGXPPGRXWQANGQMGLTXMGEPGVGNETIXXEGXCKXGWVQRGAMESWXRKXXNXXSVGSTXNXXKPXXAAPDCLGWQQRVXAXPXXXSGVSL

SEQ ID NO: 204717 - protein, 96 aa, Triticum aestivum
  unsure (1)..(96): unsure at all Xaa locations
  Clone ID: PAT_TA_99135.pep
GAPPRHSCAPSSPPLRPLPPSSSXGPSPTGTXLRSTPPPPXXTTATEPPXSTPSSPSPSTTPSAKPSWSPTMSRWMRSTSISLCRAGCFVEGMGPP

SEQ ID NO: 204718 - protein, 127 aa, Triticum aestivum
  unsure (1)..(127): unsure at all Xaa locations
  Clone ID: PAT_TA_99136.pep
MARGLKKHLKRLNAPSHWMLDKLGGAFAPKPSSGPHKARECLPLILILRNRLKYALTYREVQSILMQRHIMVDXKVRTDKTYPAGFMDIISIPKTGXNYXASCXTPRAAFRLSLCXGIEDAXFXAPA

SEQ ID NO: 204719 - protein, 149 aa, Triticum aestivum
  Clone ID: PAT_TA_99137.pep
AVLPNQHHIHTETQHTANMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPSDQQRLIFAGKATGLNPV

SEQ ID NO: 204720 - protein, 126 aa, Triticum aestivum
  unsure (1)..(126): unsure at all Xaa locations
  Clone ID: PAT_TA_99138.pep
MAPVKLYGATLSWNVTRCVAALEEAGVEXEIVPINFGTGEHNSPDHLARNPFGQXVPALQDGDLYVFESXAICKYACRKNKPKLLRRGDIKDVSXXVDXWLQGGSTTLPHFLLGPLIQSQCGGEYF

SEQ ID NO: 204721 - protein, 41 aa, Triticum aestivum
  unsure (1)..(41): unsure at all Xaa locations
  Clone ID: PAT_TA_99139.pep
MGWKAAEKLIXHWKILXXDNXXIIXGKDXGESXXINQVIRS

SEQ ID NO: 204722 - protein, 115 aa, Triticum aestivum
  unsure (1)..(115): unsure at all Xaa locations
  Clone ID: PAT_TA_99140.pep
GCSVRXLNRRCASXTCSSASARVFSPRLYSAMESFALDQVPELRAEDDGAPRLVVHEEEVELRLDVVGGAVRGRHHVHEXFGDHAVQPQHHGQSIITPDGALIERRGGDIKVVLH

SEQ ID NO: 204723 - protein, 95 aa, Triticum aestivum
  unsure (1)..(95): unsure at all Xaa locations
  Clone ID: PAT_TA_99141.pep
MXXMKVYGWXVSPWMARVLLSLEEAGAEYELVPXXXNXGDHRRPEHLPXNPFGEXPVLQXXGLXPYQSXXIAKHILLQYTTPGFXXSCNPRMSLM

SEQ ID NO: 204724 - protein, 138 aa, Triticum aestivum
  unsure (1)..(138): unsure at all Xaa locations
  Clone ID: PAT_TA_99142.pep
MAPKADKKPVAENKVEKAAEKTPAGKKPKAEKRLPAGKTASKEAGGEAKTRGRKKGSKAKKSVXTYKIYIFKVLKQVHPDIGISSKAMSIXNSFINDIXXEXLAGESXXAXRRFNNEXPTXNLPGKQDLRSLRPPGEA

SEQ ID NO: 204725 - protein, 109 aa, Triticum aestivum
  unsure (1)..(109): unsure at all Xaa locations
  Clone ID: PAT_TA_99143.pep
MKTILASETMEIPEEVTVKVSAKMISVTGPRGTLTRNFKHLNLDFQLXEGGRRLKVDAWFGTRKTMAAIRTAISHVQXNLITGVTXGXRYKIRFLYXYFPHQPSARRAY

SEQ ID NO: 204726 - protein, 133 aa, Triticum aestivum
  unsure (1)..(133): unsure at all Xaa locations
  Clone ID: PAT_TA_99144.pep
MAPKAEKXPAAXKPVEEEPAXEKAEKTPAGKKPKAXNXLPAGKSSACGQGWRQXXXKAKKSVEXTYKIYIFKVLXKQVHPDIXISXXAMSIMNSLHQRTSSKKAXPARXAXLAKXQQRKPXIVLRGRISRSAF

SEQ ID NO: 204727 - protein, 144 aa, Triticum aestivum
  unsure (1)..(144): unsure at all Xaa locations
  Clone ID: PAT_TA_99145.pep
MAPKVAVAKKGDAKAQAAKVAKAVKSGSINKTAKKIRTSVTFHRPKTLSKARDPKYPRISTPGRNKLDQYQILKYPLTTESAMKKIEDNNTLVFIVDXKADKKKIXAAVXKMYYIXAXKVYTLIXPDWQXKRRYEWTPKPTMPP

SEQ ID NO: 204728 - protein, 142 aa, Triticum aestivum
  unsure (1)..(142): unsure at all Xaa locations
  Clone ID: PAT_TA_99146.pep
PXGXSFVLKPXECLGXWFXXXKVGXXGALREXGGRARGARDAIXPKNNRAVGSLVKRFLPGKRXRARVRXSWGSTGANLXLLPRPNQSPSSSQRVFXLQKGLKNLSAWFEXGSPWTNXGGGLXAQPSNXASSQRGXXNGXXA

SEQ ID NO: 204729 - protein, 161 aa, Triticum aestivum
  unsure (1)..(161): unsure at all Xaa locations
  Clone ID: PAT_TA_99147.pep
KTLTGKTITLEVESSDTIDNVKAKIQDKEGIPPDQQRLIFXGKQLEDGRTLANYNIQKESTLHLVLRLRGGMXIFVKTLTGKTITLEVESSDTIXNVKAKIQDKEGNSPGXXSAIFAWQCXWEGWVAPLADYXIPEREVHPPTXVSGGSAGGEMQGSVETP

SEQ ID NO: 204730 - protein, 87 aa, Triticum aestivum
  unsure (1)..(87): unsure at all Xaa locations
  Clone ID: PAT_TA_99148.pep
ELASWLYRAPRYTTVXTWRKWRRRMLSTTVCSLQVKRLEMRAVPSLFSVNICGRLIYVYSMAFNQGRRRHSKSERFIHLRPKKKKKK

SEQ ID NO: 204731 - protein, 118 aa, Triticum aestivum
  unsure (1)..(118): unsure at all Xaa locations
  Clone ID: PAT_TA_99149.pep
XXQKPSIQRRIKXXPFLQGGQALMRLRIXVXEXVPXXQXGGYQVXLLVDGXNVPXSSDIXADERECXSXXFMANALRXGLASXXTGASSLNLEXXLDICKSDXXSYVSVLREQAGVLX

SEQ ID NO: 204732 - protein, 159 aa, Triticum aestivum
  unsure (1)..(159): unsure at all Xaa locations
  Clone ID: PAT_TA_99150.pep
NMKFCLNGGLIIGTCDGANIEITREIGEQNIFLFGNLAEXVEDLRHNHMYSQYQLDPQLANVFDAIHNGMFGDADQFSALINGIVDHGDYYLVXDDFASYIXTQELIDEELQXNLREWTTNDHXQRVARMGVSSQGDKMYRRSMREAIWNVQPLASKKR

SEQ ID NO: 204733 - protein, 67 aa, Triticum aestivum
  unsure (1)..(67): unsure at all Xaa locations
  Clone ID: PAT_TA_99151.pep
VXLKXQXRLXASSVXKCXXGXVXLDPNEVXXISMANSRQNIRXLVKDGFIIXXPQKIXXRXRXTRGT

SEQ ID NO: 204734 - protein, 109 aa, Triticum aestivum
  unsure (1)..(109): unsure at all Xaa locations
  Clone ID: PAT_TA_99152.pep
KKXQEELXEXFQGLXKVIKXVXGDKVXKVIXPXRVXDSPCCLXTGXYGWDRQHGEGLIKAHALXDSXMAGYMSIKKDQWRINPXRNAILVELRKRRRRPTKRTKSSEPW

SEQ ID NO: 204735 - protein, 51 aa, Triticum aestivum
  unsure (1)..(51): unsure at all Xaa locations
  Clone ID: PAT_TA_99153.pep
AALDLGHELVRRGVXLVYXGGSIGLMGLVXXTVLXXGRRVVWVIXXALMPV

SEQ ID NO: 204736 - protein, 85 aa, Triticum aestivum
  unsure (1)..(85): unsure at all Xaa locations
  Clone ID: PAT_TA_99154.pep
RCSTAQLNFHXTXLLXFLPKIHLFNNQTXGKXIKXARDEQKASYGRGGARNIKRRGLHXGXFVFSQTNXQHQXLXGEIPRXSXKG

SEQ ID NO: 204737 - protein, 138 aa, Triticum aestivum
  unsure (1)..(138): unsure at all Xaa locations
  Clone ID: PAT_TA_99155.pep
VDPPCPHHRPPLSPCQADWLLPLMPCPLCGDEVVTAVARTGNNAGHRFYKCIRYDCRFFEFQAHILQEDDSGPNCCCAASSRMAPAGHGFAXHHXNXPXPKWFQAVNXKTPRPQTXTPQTRXFXPARFKAAXAPSXPQ

SEQ ID NO: 204738 - protein, 144 aa, Triticum aestivum
  unsure (1)..(144): unsure at all Xaa locations
  Clone ID: PAT_TA_99156.pep
PRSSSPTPHXPHAFDIFRPPPPXGARLQXWPPMCXPXVSDEYLAVVAKAKRNAPRLHRREELRAPSCSASSWHSXGDLRRXHXXLGGPLSAPLKVPPSXALRIGXQXXGPRXSAVXXCFESHSKGASSPXLLPNAXNSLXKLSW

SEQ ID NO: 204739 - protein, 89 aa, Triticum aestivum
  unsure (1)..(89): unsure at all Xaa locations
  Clone ID: PAT_TA_99157.pep
AALCDSNPRSPAPARSEAKREEXMGRPYAVKGKKXRXLEGXEASRAPPGDXEAVXARGEGKXXXDXXLFSXPWFPHPXXXLXLSPPXFF

SEQ ID NO: 204740 - protein, 107 aa, Triticum aestivum
  unsure (1)..(107): unsure at all Xaa locations
  Clone ID: PAT_TA_99158.pep
MAPVKLYGATLSWNVTKCVAALEXAGVQYELVPINFGTGEHKXSPDHLAXNPFGQVPXLQDGDLXVFXSRXICKXYXCRKNKPXLXXEGDIKGXXMGDXXLQGQQFR

SEQ ID NO: 204741 - protein, 109 aa, Triticum aestivum
  Clone ID: PAT_TA_99159.pep
MPALAKPASRTAKPAAAPKPKPAAAKPKAATAGASHPPYFEMIKEAITALKERTGSSSQASPSMWGTKHGASLPANFKKMLSIQLRWVRSQGQAVGRSRLSYKLSGRRP

SEQ ID NO: 204742 - protein, 106 aa, Triticum aestivum
  unsure (1)..(106): unsure at all Xaa locations
  Clone ID: PAT_TA_99160.pep
MAPKAEKKPVATEKSPAGKKPKAEKRPPASKEGGDKKGKKKAKNSVETYKIYIFKVLXRXXRXIGISSKAMSIMNSFINDIFEKLARFRQSLAFSMEQPNLPGGDP

SEQ ID NO: 204743 - protein, 104 aa, Triticum aestivum
  unsure (1)..(104): unsure at all Xaa locations
  Clone ID: PAT_TA_99161.pep
KQHXNGXDPKIVCXINRVPSRXCDPATXFXKPFLPKDAEGSXKSXXSXMRALCTGSSNFGGLGNLSIARLSIFLVQTRFVXGNRVGLWXRRLXGAQLPTEXTCL

SEQ ID NO: 204744 - protein, 115 aa, Triticum aestivum
  unsure (1)..(115): unsure at all Xaa locations
  Clone ID: PAT_TA_99162.pep
MARTKQTARKSTGGKAPRKQLATKAARKSAPATGGVKKPHRFRPGTVALREXRKYQKSTELLIRKXPFQRLVREXXQDFKXTELRFPKAPPVFXLQGGPQGVSGAPSGKPNPSGA

SEQ ID NO: 204745 - protein, 108 aa, Triticum aestivum
  unsure (1)..(108): unsure at all Xaa locations
  Clone ID: PAT_TA_99163.pep
XSXXGRTIXVFGXWRXXVTGGEXXVSGSFDXHHRXEEGGGXVVGXRXRXPXXGGXRPRQXVVPVQFEFGQAVVRRGGXGQQPRRAQEEEERXPCRRPWLVXLASCEPC

SEQ ID NO: 204746 - protein, 98 aa, Triticum aestivum
  unsure (1)..(98): unsure at all Xaa locations
  Clone ID: PAT_TA_99164.pep
VPNQSIIINNLNLRSVCASAQNPSGSVDRPRGEAERREGVRRCKIFVKTLTGKTITLEVXSSDTIDNVKAKIQDKEXIPPHQQXPIFAESSWKDGRTL

SEQ ID NO: 204747 - protein, 149 aa, Triticum aestivum
  unsure (1)..(149): unsure at all Xaa locations
  Clone ID: PAT_TA_99165.pep
FXKKXFVPXPXXXQLGKVXFSKXPRKRLGKGFXGRETNSGLPXGTXXENPFKINXPPLFXXXAPRVXKENPFFFXSCPFIXLLDQAPHAHLNFFXIREGPIPXXLPLXGNRIARFGXAHCPRXIKSQPPNIRSGKAQGRALXGVSQVVA

SEQ ID NO: 204748 - protein, 108 aa, Triticum aestivum
  unsure (1)..(108): unsure at all Xaa locations
  Clone ID: PAT_TA_99166.pep
ASSLLTVAASSQSSPSSPRHHPPRKGGCLAAAATADAAPAASAATAAAGARCSPTLRPPPAPPPWSCPPPPTRGAXAGSKXPAGXPAAATAPPASSARPAAALLQAAT

SEQ ID NO: 204749 - protein, 78 aa, Triticum aestivum
  unsure (1)..(78): unsure at all Xaa locations
  Clone ID: PAT_TA_99167.pep
AXPLIXSPNPYLHXSPWPRRRXAKRKPXFVKVDQLXARHXXXHTLVRQXCFXSXKPSLXKGPRARXGGPRAXXPXKXP

SEQ ID NO: 204750 - protein, 106 aa, Triticum aestivum
  unsure (1)..(106): unsure at all Xaa locations
  Clone ID: PAT_TA_99168.pep
MARGLKKHLKRLNAPSHWMLDKLGGAFAPKPSSGPHKAREXCLPLILILRNKLKYALTIGESAXSSLCKRHIMVDGKXVALTKTYPCRFQWDIISIPXDWVRTTSL

SEQ ID NO: 204751 - protein, 65 aa, Triticum aestivum
  unsure (1)..(65): unsure at all Xaa locations
  Clone ID: PAT_TA_99169.pep
VGXEFSXXPPXGAFWRGXXNXAPWKXCGFYXDXFRGDTXPXGVGXXRXXLGKAGFFPGLRPSGFV

SEQ ID NO: 204752 - protein, 63 aa, Triticum aestivum
  unsure (1)..(63): unsure at all Xaa locations
  Clone ID: PAT_TA_99170.pep
MSKQGGKAKPLKQAKVXRXTTTKNDLAYLXKKKDEQXALXEXKAKASXKGALGGXXLNKSGKK

SEQ ID NO: 204753 - protein, 80 aa, Triticum aestivum
  unsure (1)..(80): unsure at all Xaa locations
  Clone ID: PAT_TA_99171.pep
MASXRIXKELKDXQKDPPTSCXXGPVGEXMFHWQATIMGPSDXPYSGWEFXYFXIHFPSLNYPFQNXTKKGGRTCPFKSN

SEQ ID NO: 204754 - protein, 84 aa, Triticum aestivum
  unsure (1)..(84): unsure at all Xaa locations
  Clone ID: PAT_TA_99172.pep
ECSVYHXXXYXGVYXPXNDEXKRGYLRWKXGNRCIHQVVXDLCXVVHALLXQIVXELXXHELXGXPPWRSXLQSGHXLVVRASG

SEQ ID NO: 204755 - protein, 86 aa, Triticum aestivum
  unsure (1)..(86): unsure at all Xaa locations
  Clone ID: PAT_TA_99173.pep
LIEPIPAEKKKRRRLSFSFXLRIILPSPLPLPPSHXISPRRSFQNPQKDXPIFASXXGPXKLXSTVXXRLXPGIYXEVQACFKDIV

SEQ ID NO: 204756 - protein, 74 aa, Triticum aestivum
  unsure (1)..(74): unsure at all Xaa locations
  Clone ID: PAT_TA_99174.pep
MRECISIHIGQAGIXVGNACWELYCLXHGIQPDXAMMPGDKTVGGGDDSFNTFFXEDWCWESMSPRAVFVXRPT

SEQ ID NO: 204757 - protein, 114 aa, Triticum aestivum
  unsure (1)..(114): unsure at all Xaa locations
  Clone ID: PAT_TA_99175.pep
MDASKLKXVAGKKFGGPRKKSVTKSVKAGLXFPVGRIGRYLKXGRYAQRVXSGAPVYLAXAVLXXLXAXVLEFVGNXAXDNKKTRXVPKHLLLAIRNDQXLXKVLSALTIXQRG

SEQ ID NO: 204758 - protein, 66 aa, Triticum aestivum
  unsure (1)..(66): unsure at all Xaa locations
  Clone ID: PAT_TA_99176.pep
GPLASKXPGRPVKXXRPRRGGGAAGGRAAXXHGGXXSSVGRRAESXDLDCAAXXEGWAELGSEVLF

SEQ ID NO: 204759 - protein, 105 aa, Triticum aestivum
  unsure (1)..(105): unsure at all Xaa locations
  Clone ID: PAT_TA_99177.pep
LPSRLRSPKWLNPPNPASSFVFPVAXVLAAXFLLPLARSXSSGPNPTALXLAPPPXASRCGLXPGXRSPXYXLELXVRGEXRLXPRTSKLXRNRXPXWXXELPXA

SEQ ID NO: 204760 - protein, 85 aa, Triticum aestivum
  unsure (1)..(85): unsure at all Xaa locations
  Clone ID: PAT_TA_99178.pep
GRRRWSHRQWHDXVTQQTWPGPPRPSRXWCXLGHQCGTDGEXEVERRNGVGRGAAERGWPGSGAVGRXVERXSWXIQGEARMVGR

SEQ ID NO: 204761 - protein, 113 aa, Triticum aestivum
  unsure (1)..(113): unsure at all Xaa locations
  Clone ID: PAT_TA_99179.pep
MXRTKQTARKSTGGKAPRKQLATKAARKSAPATGGVKKPHRFRPGTVALREXRKYXKSTELLIRKLPFQRLVREIXQDFKTDLRFXELRRLRAAGRRVPTSSGSRTPSAPSTP

SEQ ID NO: 204762 - protein, 122 aa, Triticum aestivum
  unsure (1)..(122): unsure at all Xaa locations
  Clone ID: PAT_TA_99180.pep
MAAPXGAALVLAMVLAAMLVAPPATVHAISCSTVYSTLMPCLQYVHXGGSPARGCCTXIQNLLAEANNSPXRXRTICGCLNNVAKRRLRRALNLCAAGAPLPRCRPPPYIPQPLQSSNPTNI

SEQ ID NO: 204763 - protein, 147 aa, Triticum aestivum
  unsure (1)..(147): unsure at all Xaa locations
  Clone ID: PAT_TA_99181.pep
MGAKVPRNFRLLEELEKGEKGLGAXACSYGLDNGDDLLMSDWNGTILGPPHSVHENRIYSVSIHCGPYYPDXPPEIKFTSKINLPCVNPQNGKVDASNLPCLAXWKRDFTMEXILIXLRTYMGAAAQQRXLPXPXEGXTFLMYSHTA

SEQ ID NO: 204764 - protein, 97 aa, Triticum aestivum
  unsure (1)..(97): unsure at all Xaa locations
  Clone ID: PAT_TA_99182.pep
MEGKEEDXRLGANRYSEHQPIGTAAHGGGADXXDYXEPPPAPFFXAGELTSWSFYRAGIAEFLATFLFLYILVLTXMGVVGKPRPGSKXGXGGHSNG

SEQ ID NO: 204765 - protein, 117 aa, Triticum aestivum
  unsure (1)..(117): unsure at all Xaa locations
  Clone ID: PAT_TA_99183.pep
KISXXIFXFSAAXRSKXXSSSGVAPYLIALGRVAAXEARAGGGKGEAQGCGAGMARKRRGAGVRRGHGQKKASAGGSXAPXMVSINNGGSAAAGGASEAWXGRCRQRRRGSSSASVG

SEQ ID NO: 204766 - protein, 65 aa, Triticum aestivum
  unsure (1)..(65): unsure at all Xaa locations
  Clone ID: PAT_TA_99184.pep
GTLAPKICPDLWIXSYPVPSPLLLPXIAPXPPSWXPPSGFRLXFXSAAVXKXPFSXTCGATSPXF

SEQ ID NO: 204767 - protein, 120 aa, Triticum aestivum
  unsure (1)..(120): unsure at all Xaa locations
  Clone ID: PAT_TA_99185.pep
MATQISKKKKFVSDGVFYAELNXMLTRELAEDGYSGVEVRVTPMRTEIIIRATRTQNVLGEKGRRXXXXLTSVVQKRFNFXENGVELYXEXVVNLGLCAIAQGVPATPPSVGLCVAAWFL

SEQ ID NO: 204768 - protein, 78 aa, Triticum aestivum
  unsure (1)..(78): unsure at all Xaa locations
  Clone ID: PAT_TA_99186.pep
CASGAADRPRTRAATPTPTPPVSVLGHCAARIQSHLRSQSIATXSEPFXLVPICTTYKLSAADTIRQRRTYSLLSAWX

SEQ ID NO: 204769 - protein, 125 aa, Triticum aestivum
  unsure (1)..(125): unsure at all Xaa locations
  Clone ID: PAT_TA_99187.pep
TXKSILCXKTXXPCPLEEXLNSVVXXELLXGLWXSXEGNXHAXXWXGSGSWPSFDMPKSSRCFEVVEDPLPALLLXGGARAAGAARLRRRHGPAXLSSVLSTRRARRGSRGGSKYFRFLWERSGS

SEQ ID NO: 204770 - protein, 63 aa, Triticum aestivum
  unsure (1)..(63): unsure at all Xaa locations
  Clone ID: PAT_TA_99188.pep
MXXQGGKAKPLKXAKVPEKDYDENDLAYLQKKKDEQKALKELKAKAXHXGALGGSGLKXSGNK

SEQ ID NO: 204771 - protein, 85 aa, Triticum aestivum
  unsure (1)..(85): unsure at all Xaa locations
  Clone ID: PAT_TA_99189.pep
ITVRCGSXHXSXPXPLXGYXXSPAGXSXLEGXGXRGGDEAGGCFPSPASXYGGXASASQTGWRVGVAXAAIXGXEHGIAXERIRD

SEQ ID NO: 204772 - protein, 112 aa, Triticum aestivum
  unsure (1)..(112): unsure at all Xaa locations
  Clone ID: PAT_TA_99190.pep
VASMLXVALVLVSLAXFPXGVHSXGXXNGVIXNNLPXPSDVXKLYKXXGXNAMXIYXPEXNVXXGLXGSGIGXLMXVGNGXAPRARQTXPSARGPXGXXGNVXPYPGAVSFX

SEQ ID NO: 204773 - protein, 81 aa, Triticum aestivum
  unsure (1)..(81): unsure at all Xaa locations
  Clone ID: PAT_TA_99191.pep
LGXRSXDTXXRRXRFRARKRAXLEGPIXLXGLWXXLGRLLRXEILAAPGSPLVXRXCXSPRAGATXXIXXXXXILXQGPPP

SEQ ID NO: 204774 - protein, 122 aa, Triticum aestivum
  unsure (1)..(122): unsure at all Xaa locations
  Clone ID: PAT_TA_99192.pep
MAGQTFIMIKPDGVXRGLIXEVIXRFEKKGFYLKGLKLXNVXXSFAEXHYXDXSSKPFFXGLVEYIVSGPXVAMVWEXKXXVSPLGRKXIXGXNPLASEXGTXRXDFSVDXGXNXIHGKRLN

SEQ ID NO: 204775 - protein, 125 aa, Triticum aestivum
  unsure (1)..(125): unsure at all Xaa locations
  Clone ID: PAT_TA_99193.pep
MARTKQTARKSTXGKAPRKQLATKAARKSAPATGXVKKPHRFRPXTVALREXRKYXXSTELLIRKAALPAPGCGEXAQGLQGPDLRFQXIPPXFALQGGPXXAYLVGGCEGKQNSWGHSKGVQAP

SEQ ID NO: 204776 - protein, 88 aa, Triticum aestivum
  unsure (1)..(88): unsure at all Xaa locations
  Clone ID: PAT_TA_99194.pep
LYXSRXXRWGIPLESXFPXXNQGXLLGPASPXFXWLXLXNXELSPXLGXLXTPRFWLELCWXSCCFLXXVXXLPHFPVLVAKSFSLGE

SEQ ID NO: 204777 - protein, 136 aa, Triticum aestivum
  unsure (1)..(136): unsure at all Xaa locations
  Clone ID: PAT_TA_99195.pep
PIRNLKLSTRSKTMAEQTFIMXKPDGVQRGLIGEVIXRFEKXGFYLKGLXAXNVEKSFAXQHYAXLSSKPFFAGLVXYIVSGPVVXMVWEGXXVXSTGRKXIGATNPLGXSRPGTXRWGTSXFDIGXXTVIHGKRT

SEQ ID NO: 204778 - protein, 112 aa, Triticum aestivum
  unsure (1)..(112): unsure at all Xaa locations
  Clone ID: PAT_TA_99196.pep
MGIXLXXGGRNKXTKRVXPKSDDVYXKLLVKLYRFLVRRXKXKXNAVILKXXFKXKXNXPXXSMRRLSNFMKGKXERPLLWAVWNHHSNRVPMKRGIRLCRYYGAKGFQMAG

SEQ ID NO: 204779 - protein, 65 aa, Triticum aestivum
  unsure (1)..(65): unsure at all Xaa locations
  Clone ID: PAT_TA_99197.pep
SFRXTTNKQICNXQKEGXXKXTLXXXIEGSXTAXRPAXARXQDCRLXSRXPRPLAFAVMKXAXAQ

SEQ ID NO: 204780 - protein, 51 aa, Triticum aestivum
  unsure (1)..(51): unsure at all Xaa locations
  Clone ID: PAT_TA_99198.pep
LFTFAQXRRGLXYAGTSRXFIXRISLYSRXHXHGRDLXISXSLSSCARSLG

SEQ ID NO: 204781 - protein, 120 aa, Triticum aestivum
  unsure (1)..(120): unsure at all Xaa locations
  Clone ID: PAT_TA_99199.pep
SKNXXIPRXGRNSXXSDGXXVHTEPCXNFPXAMDLWEXGAVLRRAXXVKRSQXLXLEAXXRVXGAGVXXGEEVQGDXLXDRXQVPRRXPPDAXKXXXPPRRPXXAPRLGHPRXLHXAHPR

SEQ ID NO: 204782 - protein, 116 aa, Triticum aestivum
  unsure (1)..(116): unsure at all Xaa locations
  Clone ID: PAT_TA_99200.pep
NVQGIMXTNRAXTLXPALLRPXGRLDKXIQFPLXXRRXKKLXFQVCTAXINLSDHVDXGDYVSKPDKIXACLITAYFAEWACMLRKANGYSSPDFRERGIRPTVKEALETLRTSTK

SEQ ID NO: 204783 - protein, 57 aa, Triticum aestivum
  unsure (1)..(57): unsure at all Xaa locations
  Clone ID: PAT_TA_99201.pep
NPCPFKXLRFKXSXANQESYXXXNCTETGPSQLQKKDSLGVSXCQXFFMVRIXCSPG

SEQ ID NO: 204784 - protein, 59 aa, Triticum aestivum
  unsure (1)..(59): unsure at all Xaa locations
  Clone ID: PAT_TA_99202.pep
XXXIKKDLFEXHSQXQXMLVCHWGXXKRFPYXGXTTGXPFKVFGSNSLGKIXLDLAFWG

SEQ ID NO: 204785 - protein, 127 aa, Triticum aestivum
  unsure (1)..(127): unsure at all Xaa locations
  Clone ID: PAT_TA_99203.pep
PHRVIFNLSSSSSSQATTPAQIAMXGEPXQAPAXQEAGVHIVYVDRPEDADPEEXHXRTLAPVXXXEEXGRGAXLYXYKXAASGXXRKXSTPEXVEDXXKQQVSFKLXPGQDRPTHGNXGGWKPGYV

SEQ ID NO: 204786 - protein, 67 aa, Triticum aestivum
  unsure (1)..(67): unsure at all Xaa locations
  Clone ID: PAT_TA_99204.pep
LCSFXXCTFFGGVKSXAXEXRAALTPFSIILVGGVXRLLPXXYXLPVXLXRTNPSHISXXLRSXTXN

SEQ ID NO: 204787 - protein, 97 aa, Triticum aestivum
  unsure (1)..(97): unsure at all Xaa locations
  Clone ID: PAT_TA_99205.pep
DWEDHLAGQXXXPLRVXSSFRXILFVPKRAPFXLFEDXXXPXXNIKLYXRRVFITDDXTXLXXEWLNFVKGGVDSEDLPLXXSREXLQQEXDYGQRK

SEQ ID NO: 204788 - protein, 108 aa, Triticum aestivum
  unsure (1)..(108): unsure at all Xaa locations
  Clone ID: PAT_TA_99206.pep
HAKNXXRGHPSLRSRKTXXLGGKKKSPMGPSXSHAXXALVXLPXXXAXSSLXXXRXWPXRNLAGGRAVPPRDSGRGSXVWSLRNPEWXGRRCXRXREGLXGFGPGRGT

SEQ ID NO: 204789 - protein, 147 aa, Triticum aestivum
  unsure (1)..(147): unsure at all Xaa locations
  Clone ID: PAT_TA_99207.pep
MGKXGVASMLAMALVLVSLAAFXRGVXSIXVCNXXIXNNLAXPSDVVKXYKXKXINAMRXYAPESNVLKGLXGSGIXLLMDVXNGALPXLAKEPSAAXAWGQGANXXPYPGXSFRYIXXXKRSSRNEPSGHRNPPGRLRPGSGGGRW

SEQ ID NO: 204790 - protein, 128 aa, Triticum aestivum
  unsure (1)..(128): unsure at all Xaa locations
  Clone ID: PAT_TA_99208.pep
CSACLWLCRFLFPTHRYNLLVDCLVEAGXMGXPCVGALLACAAVAXSCCGCFXFQGVAAAGTPXFGDNFXITXAXDHVKTSXDGQTWVPSPLDNXDXAFGVPRRKQKXTWFGVVKAQSFRETARRHRP

SEQ ID NO: 204791 - protein, 110 aa, Triticum aestivum
  unsure (1)..(110): unsure at all Xaa locations
  Clone ID: PAT_TA_99209.pep
AEXLKLXXAPHXATRXQXLXGXXFXAXRLASXPAXLAXKXLRSSPXSRGIHXFAEXQPHANGNARXTQGTRHXSRSKXXSXGRKEVGRKLVXPRXSXWLERLVPNSCIPG

SEQ ID NO: 204792 - protein, 51 aa, Triticum aestivum
  unsure (1)..(51): unsure at all Xaa locations
  Clone ID: PAT_TA_99210.pep
KVPLNYAKFGXXDLKCXTRNFXPESLLXERGFXCVFKGWXXQXGTXXXKPG

SEQ ID NO: 204793 - protein, 94 aa, Triticum aestivum
  unsure (1)..(94): unsure at all Xaa locations
  Clone ID: PAT_TA_99211.pep
SASTHTTTDHLSPPKHPHPHPHPWXPRQPRRSRVEKTPAGKEAKAEKXVPASXEGGXDKKGKKNXKKSVETYKDLHPQCKVHPHGSSSKGHVQS

SEQ ID NO: 204794 - protein, 71 aa, Triticum aestivum
  unsure (1)..(71): unsure at all Xaa locations
  Clone ID: PAT_TA_99212.pep
PXXTKHXXXXXQXTFXVVEXLRVQPFLPXRAPHPLGRDEGAEVXVCGSXRRRGAWXRGGXXWRGRAPCXTT

SEQ ID NO: 204795 - protein, 92 aa, Triticum aestivum
  unsure (1)..(92): unsure at all Xaa locations
  Clone ID: PAT_TA_99213.pep
EITYXLARDKHWXTXAKIGFHTIHCXXVPGKCXCTYKRQXKVXXLXSVKCQXFRGXMXTLFIXXLMGGNFLLDAAGSTIGCXNXTKXXLQXI

SEQ ID NO: 204796 - protein, 93 aa, Triticum aestivum
  unsure (1)..(93): unsure at all Xaa locations
  Clone ID: PAT_TA_99214.pep
GTSAARGPLLGRRCKSSPSPPSPELNPSPDAXGXMXXXGKGISSSVLPYKRTPPSWVKTAVXDVDXLXXKAXXKGQXPXQIGVLLRDQHGIPL

SEQ ID NO: 204797 - protein, 56 aa, Triticum aestivum
  unsure (1)..(56): unsure at all Xaa locations
  Clone ID: PAT_TA_99215.pep
AXGXXFXPASRHXXRGRLEIXPGXXSXAXLXTGALSVVQFKSRRGLXXARRVFGFP

SEQ ID NO: 204798 - protein, 131 aa, Triticum aestivum
  unsure (1)..(131): unsure at all Xaa locations
  Clone ID: PAT_TA_99216.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQRXYKLIDITDDXYVSXLTEEVGTTKXXDLKLPNDDVLLGQD

SEQ ID NO: 204799 - protein, 140 aa, Triticum aestivum
  unsure (1)..(140): unsure at all Xaa locations
  Clone ID: PAT_TA_99217.pep
MSLWHEHLGKTHDDFLRPESLECVQRVNKMADEYWSLYVGDQLPEDLPGHLLTYPVSVDKAGNVSXVTGFEFFPDTEARVLGEPNGNKRLFSEQKSSKFALVLNKSLGTGFFFPPGLSLLTYGQKKMGLFLGKAGNFPQK

SEQ ID NO: 204800 - protein, 72 aa, Triticum aestivum
  unsure (1)..(72): unsure at all Xaa locations
  Clone ID: PAT_TA_99218.pep
LNVEFSAAXSSSLSTLPEERSLVCTNRAAALPGARSAALAAAAIDIXAARRENPSTLWMDPLXGRLSNPLSP

SEQ ID NO: 204801 - protein, 138 aa, Triticum aestivum
  unsure (1)..(138): unsure at all Xaa locations
  Clone ID: PAT_TA_99219.pep
MFGFGHHHKDQAPAASGPNQIFKIYCRASEDYCLAVRDGEVVLAPVNPKDETQHWLXDMRFSTTVKDEEGMPVFALVNKGTGARPVKHSIGPXPNPVKAGGRSRVPGTRFCWGRDVGQRVSRHPWVKKQPGLNFRPLQ

SEQ ID NO: 204802 - protein, 126 aa, Triticum aestivum
  unsure (1)..(126): unsure at all Xaa locations
  Clone ID: PAT_TA_99220.pep
MLVYQDKLSGDELLSDSFPYRELENGVLWEVDGHWVVQGAVDVDIGANPSAEGGGDDEGWRMTKAVKVVDIVDTFRLQEQPAFDKXQFNSHNEALHXXNLSGKLEXGDXLNVFXXECXSPAKKYPS

SEQ ID NO: 204803 - protein, 117 aa, Triticum aestivum
  unsure (1)..(117): unsure at all Xaa locations
  Clone ID: PAT_TA_99221.pep
EGFAIGSAALVSLALFGAFVNKAGXKVLMSYLPRXSXXXLAEPSFRNGSLXMXXKNXXKCCXQKWFEXGPXGNXKTIPGTGWEGXWQTPXIXNWCQRXSKGRLPXKXMXSXRGXFGQ

SEQ ID NO: 204804 - protein, 99 aa, Triticum aestivum
  unsure (1)..(99): unsure at all Xaa locations
  Clone ID: PAT_TA_99222.pep
GARIPGGFLRTMXXTGXTXAATAXAPPATCRCPPRPPRGRCGAPAPSPPAPPAPPPSPPPAAPAPCAPPSPHAHTSALSPKIQLASTVVLSLSLCLCAS

SEQ ID NO: 204805 - protein, 71 aa, Triticum aestivum
  unsure (1)..(71): unsure at all Xaa locations
  Clone ID: PAT_TA_99223.pep
DCIWPALFFHDFFNFWLAWTNFCSHPGHDLRSCVHHWDVCYXMAGWHWSTNLGGKRXXRLALAVPSKSSGV

SEQ ID NO: 204806 - protein, 71 aa, Triticum aestivum
  Clone ID: PAT_TA_99224.pep
MTSGPSNISPCHPSNYIDQLLGSSDRAVEQPAPELPNISSRAMTIPMASGVPRRRGSGTTSRNTSSPTGDS

SEQ ID NO: 204807 - protein, 140 aa, Triticum aestivum
  unsure (1)..(140): unsure at all Xaa locations
  Clone ID: PAT_TA_99225.pep
LLGVRXXPPXINFLXWGGSKDXKXQTLFERIFALSYLNWXDXXIIWNPXRGPKEEGERASVHLRXAAERPPRSGRHHRGGALPRGPREEARGYHLCAALEPGGSGEGFPTDSRGGGEERXQRDMXTXXSGXPSSGGGKSA

SEQ ID NO: 204808 - protein, 132 aa, Triticum aestivum
  unsure (1)..(132): unsure at all Xaa locations
  Clone ID: PAT_TA_99226.pep
MANPRVFFDMTVGGAPAGRIVMELYKDAVPRTVENFRALCTGEKGVGKSGKPLHYKGSAFHRVIPDFMCQGGDFTRGNGTGGESIYXEKFADEKFVQKHXTKPGILSMXNAGPNNKXSXFFICNVPLQINKL

SEQ ID NO: 204809 - protein, 135 aa, Triticum aestivum
  Clone ID: PAT_TA_99227.pep
MRSLLNPSSFQRVTTRAFTTTARIMGVQKTIIQEGNGPSPQKGDKVTMEYTGWLKTQSGDKGKQFDSTTGRGPFQTPIGVGRVIKGWDEGVVQMKLGEKAKLDISSDFAYGDQEFPGLIPPHSDLIFEVELKKIN

SEQ ID NO: 204810 - protein, 157 aa, Triticum aestivum
  unsure (1)..(157): unsure at all Xaa locations
  Clone ID: PAT_TA_99228.pep
YMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAKSKVFYLKMKGDYHRYLAXEFKASAERKXEATENTLVANKSPRTSLAD

SEQ ID NO: 204811 - protein, 136 aa, Triticum aestivum
  unsure (1)..(136): unsure at all Xaa locations
  Clone ID: PAT_TA_99229.pep
MQIFVKTLTGKTITLEVESGDTIDNVKAKIQDKEGIPPDQQRLIFAGKQLEDGRTLSDYNIQKESTLHLVLRLRGGAKKRKKKTYTTPKKIKHKRKKVKMATLKYYKVDGDGKIKRLRRECPAPKCGAGIFXXWHS

SEQ ID NO: 204812 - protein, 121 aa, Triticum aestivum
  unsure (1)..(121): unsure at all Xaa locations
  Clone ID: PAT_TA_99230.pep
MRECISIHIGQAGIQVGNACWELYCLEHGIQPDGQMPGDKTVGGGDDAFNTFFSETGAGKHVPRAVFVXLEPTVIDEVRTGAYRQLFXPEXLXKWERRXEPTTXARGHYXIXKGXLVXLCP

SEQ ID NO: 204813 - protein, 141 aa, Triticum aestivum
  unsure (1)..(141): unsure at all Xaa locations
  Clone ID: PAT_TA_99231.pep
SFQKDAPFQASHASFKRGARVADDDEEDEEKTPADDLGAARATPFGRRSRAGSSVTDMSSNASIIYGKSARQDRFGNEGFWCGAFCMQLPGLSXRXATMQQQXSMXLSEXKXPGEAXAGLNNLXGSGVVSKGASMGEGSAK

SEQ ID NO: 204814 - protein, 157 aa, Triticum aestivum
  Clone ID: PAT_TA_99232.pep
FPPRFPFGPFLYYANSTSEVRTVTTTSPSLSWPPTSPVCGNTSRRSAAAVFVRSGDQLKPGCPSSTLASSSSVSAIASRVTIAAAPSRPLSPQPRRRALDPKTAGDPQYDYGVDDSSLLPEATRRWSPGARRPSSTMTTTTREVPNTTCSPLTTTRS

SEQ ID NO: 204815 - protein, 147 aa, Triticum aestivum
  unsure (1)..(147): unsure at all Xaa locations
  Clone ID: PAT_TA_99233.pep
EEVQKQSKRWRRLGIAPASWLKSTPAVNGFMGTSSTRSSSTSQDSPGTKLKVQVEPSGSLKISGERALNGGRQWCHFLKRFDLPGACDAAAIKVQLDKGVLYVQVPRSTGRQAKEDALAXKRGRWAPSGSXGHTGGVXGPXXTXRGW

SEQ ID NO: 204816 - protein, 106 aa, Triticum aestivum
  unsure (1)..(106): unsure at all Xaa locations
  Clone ID: PAT_TA_99234.pep
MAAGAWAALRSVVKPCIAGSLIGLTVSDRYFTVAAVRGASMHPTFEGRTGEYALVERLCLERYXLLRGDVVTFVTPVKQQRKXXKRLFGLPGDWINXPGERNSGKR

SEQ ID NO: 204817 - protein, 128 aa, Triticum aestivum
  Clone ID: PAT_TA_99235.pep
MRFSTILPAASLLALSTAAPVDNLSTRAACSSYTIINTRGTGEIQGESSGFRTMNRNIQSAVSGGKIYNTVYAAGFSQNSAAGTADIVNKVQSTLRTNPDECFILEGYSQGAGERGMACLKLNGELCW

SEQ ID NO: 204818 - protein, 144 aa, Triticum aestivum
  unsure (1)..(144): unsure at all Xaa locations
  Clone ID: PAT_TA_99236.pep
QSPFPQQQQHQQLXVQQXIPVVQAXSFCKQLNPCKLFLQXQQCSPVAMPQRLARSQMLQQXSSCHVMQQQCCQASCRXSPKQSRYEAIRAIIYSIILQEQQXVQXSIQSQKQQPQQXGQCVPTQQESQKQLGNNSTTTXGQGTF

SEQ ID NO: 204819 - protein, 183 aa, Triticum aestivum
  unsure (1)..(183): unsure at all Xaa locations
  Clone ID: PAT_TA_99237.pep
QLPPFSQXQSPFSQQQXIVLQQQPPFLQQQQPSLPQQPPFSQXQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVXQPQQQSQQQLGXQPQXQQLEQXTXLKHTSA

SEQ ID NO: 204820 - protein, 36 aa, Triticum aestivum
  unsure (1)..(36): unsure at all Xaa locations
  Clone ID: PAT_TA_99238.pep
YALXXSXVCVXPIGPIDYTSWLLHFWGSIISLNDPG

SEQ ID NO: 204821 - protein, 69 aa, Triticum aestivum
  unsure (1)..(69): unsure at all Xaa locations
  Clone ID: PAT_TA_99239.pep
MRPLFQLVQGQGIIXPQQPXAQLEVIRSLVLGTLPTMCNVFVPPECSXTKAPFAXIVADIGGXKMQALC

SEQ ID NO: 204822 - protein, 133 aa, Triticum aestivum
  Clone ID: PAT_TA_99240.pep
SVEPSAAAPPSALSFLLRSKMKFIAAYLLAYLSGNASPSAEDLTSILESVGCEIDNEKMELMLSQVKGKDITELLAAGREKFAAVPSGGGGVAVSAAAPAAGGAAAPAAESKKEEKVVEKEESDDDMGFSLFD

SEQ ID NO: 204823 - protein, 187 aa, Triticum aestivum
  unsure (1)..(187): unsure at all Xaa locations
  Clone ID: PAT_TA_99241.pep
PSLLAMRAPCPIPYLLPIPISPPSFPCRRHTSMPGRAPDPLCLLLSSPARPVTGSPDLVARSPLLSPDVAPSPGAGPAAKLCPAPDRLLPRARLTRTGMXTSGSMXXLRLXFSKSXSSSPXRHLGSWSAXWSLLTRXSTXXGXXWLXLVPXAKSGRRPQXSXXLLALXPFESXVLKPXXKXXXVREK

SEQ ID NO: 204824 - protein, 136 aa, Triticum aestivum
  unsure (1)..(136): unsure at all Xaa locations
  Clone ID: PAT_TA_99242.pep
MARTKQTARKSTGGKAPRKQLATKAARKSAPATGGVKKPHRFRPGTVALREIRKYQXKSTELLIRKLPFQRLVREIAQDFKTDLRFQSSAVSALQEAAESYLVGLFEDTNLCAIHAKRVTIMPRXQVARRIRGEXA

SEQ ID NO: 204825 - protein, 83 aa, Triticum aestivum
  unsure (1)..(83): unsure at all Xaa locations
  Clone ID: PAT_TA_99243.pep
EXRSSKLKRRCSKITKLGLVQTNPKTVGSKTLCWXSKKLNGSXKNAKSXPWLQLFPRVVATLGAAGSSSCGEVFVAFGMEGHL

SEQ ID NO: 204826 - protein, 73 aa, Triticum aestivum
  unsure (1)..(73): unsure at all Xaa locations
  Clone ID: PAT_TA_99244.pep
CIFLYPVLFMGHHGLVVQPLAHSRSRRKLAELXMMXYFRAXLLGKXYTGIKWXFRXNPKQTYGVTXXXNLXXV

SEQ ID NO: 204827 - protein, 65 aa, Triticum aestivum
  unsure (1)..(65): unsure at all Xaa locations
  Clone ID: PAT_TA_99245.pep
TXTXVXPHAFXXIXXTXSXDFLAGARSTASSTSTGAGLGLSTTGXDTDTPXREEEEEEDGDVEAG

SEQ ID NO: 204828 - protein, 86 aa, Triticum aestivum
  unsure (1)..(86): unsure at all Xaa locations
  Clone ID: PAT_TA_99246.pep
MQKKGRXEGFXNGXLALVLMSVXKNNTXVXINXRNNKXLLXXVXAFDRQXNMGLXNVRXXXTXGXKXXKXKKKGLXMXKGQTCSSG

SEQ ID NO: 204829 - protein, 124 aa, Triticum aestivum
  unsure (1)..(124): unsure at all Xaa locations
  Clone ID: PAT_TA_99247.pep
MARLNSKAVVAAVVLAAVVLMMAXGREASAALSCGQVDSKLAPCVAYVTGRASSISKECCSGVQGLNGMARSSSDRKIACRCLKSLATSIKSINMGKVSXGVPGKCGVSVPFPXSMSTNCDTVN

SEQ ID NO: 204830 - protein, 141 aa, Triticum aestivum
  Clone ID: PAT_TA_99248.pep
MASRGGTGADRRRRVDTVAVAVASPFSSLERSCNLHMSSAMSGPQGWADLPEDLLHSIVTLLGSFTNLLAFAATCPAWRAAFSSYPSKSTLAPPLLLQPHVPVCSPRPCPFSNSLVRTRACYVSDLANEDTYMCCQDSSTS

SEQ ID NO: 204831 - protein, 61 aa, Triticum aestivum
  Clone ID: PAT_TA_99249.pep
AEENRMVFLGTFIGLFALELHSLQFKKLSETKRKSHYHPFESVYTADVGGEHGRAELLNNA

SEQ ID NO: 204832 - protein, 113 aa, Triticum aestivum
  unsure (1)..(113): unsure at all Xaa locations
  Clone ID: PAT_TA_99250.pep
AEPWRPPPRAGAAGGRAGEASSAVTGQSSGSRPRRRQREPPASEDDSASAKPVSTSGGGGQDLTDAXAKRFKANKSSDENGSXRKDAEADSRNASXAXFDQNPXPPKQDFIQC

SEQ ID NO: 204833 - protein, 171 aa, Triticum aestivum
  unsure (1)..(171): unsure at all Xaa locations
  Clone ID: PAT_TA_99251.pep
FLSSPRKDLNGHGHLKSIPSPPALPVIGHLHLLKKPLHRSLSALAARYGGGRDGVGLLSLRFGARPVLLVSSAAIAEECFTVHDVALADRPGLASRRLLTXSAPSIALSNYGPLWRNLRLIVTVHALSAQRLSLTSAVRATEVRAMVKAALRGAPAPTPVNVKEEGLRRGQ

SEQ ID NO: 204834 - protein, 61 aa, Triticum aestivum
  Clone ID: PAT_TA_99252.pep
IRKFCIIMMEVLLSLFPRYYYFLPFQIISQVLPSTKKHHYMMWYGGQAVVVPAERCVAAPM

SEQ ID NO: 204835 - protein, 139 aa, Triticum aestivum
  unsure (1)..(139): unsure at all Xaa locations
  Clone ID: PAT_TA_99253.pep
QNPAPLGSVNQIXXNSXLLVLLXAGHCPHRXXMSXPPDLQLERSTSNPXEPSCGRFVPHTVLMDLERCTVPYSQISPCNFCAHRVGVFSKASLASEHPAPSRYLPMFPIPKLILSLGPEDSSHPKINRLNPLIALLCLS

SEQ ID NO: 204836 - protein, 136 aa, Triticum aestivum
  unsure (1)..(136): unsure at all Xaa locations
  Clone ID: PAT_TA_99254.pep
FKAGAQIFSEGGLDYLGNPNLVHAQSILAIWAVQVVLMGFIEGYRVGGGPLGEGLDIIYPGGAFDPLGLADDPDTAAELKVKELKNGRLAMFSMFGFFVQGIVTGKGPVENLFXHVAEPVNNNAWXXFATNFAPGS

SEQ ID NO: 204837 - protein, 153 aa, Triticum aestivum
  unsure (1)..(153): unsure at all Xaa locations
  Clone ID: PAT_TA_99255.pep
SLNPTANGAARGRPEHSLAGVPAPPLDAVRRNPAPSSAHSPVPRASSRPCRPLGARELPRPVVLGAQAVQASPLPRAGVCCVYCKFQSKGQGSSWTPFIMCTSKLLGCRPSHADSPTYIAAFLWSAVGVQLLVXRLSGSVVQRXPQGRXFLGX

SEQ ID NO: 204838 - protein, 111 aa, Triticum aestivum
  Clone ID: PAT_TA_99256.pep
MDPNGSYPNKVRSSESEANISPLHDAPRGRAIMSILSDFFPPNSTPSDSTWVWNTPPTIDAPHVVTMPSIKDSSIMPYQTSVSLSSLPPQLPNAKFTPSTRVNTLTSQAQP

SEQ ID NO: 204839 - protein, 132 aa, Triticum aestivum
  unsure (1)..(132): unsure at all Xaa locations
  Clone ID: PAT_TA_99257.pep
MVHQDEGSSSSVTSSPLHNFSNMPLHPHPGANGAGAGATPPWMLRELRSDERGLCLIHLLLNCAAAASAGRLDAANAALEHIATLAAPDGDAMQRVXAGFAEALAXRASVXWPXLWRAXXLXRPGXXXXAKV

SEQ ID NO: 204840 - protein, 117 aa, Triticum aestivum
  Clone ID: PAT_TA_99258.pep
GTCSSYGSSVPLTSCMAHSAPGLSSPLCRANPSPRLLISLYLVGTLWRVSGLGRRKQVSIFQLWCGYGSFIASWKDRSPTALLSMGQAAQHEREWRHSLPATGKLHARVIFQKKKKK

SEQ ID NO: 204841 - protein, 77 aa, Triticum aestivum
  Clone ID: PAT_TA_99259.pep
GSRSCIESIAKDLEACHPARRTHLEAHALHGSIGSLAASPPLCFAGEALALPWMLDSAIPHLQYGLWKCICTWGASC

SEQ ID NO: 204842 - protein, 139 aa, Triticum aestivum
  Clone ID: PAT_TA_99260.pep
TQNRASFIHSLTKIRDGRSTIQENAHTRPAYKGRQSLKRNIQAAVIGIRSKSVRRRRPADMAVYCISLAPSRDTSANDTKARAEAGAAPVAAPPVSGAGAGADEGAMKSCAHADARAEAATAATSSTATRGAMNSQPRE

SEQ ID NO: 204843 - protein, 135 aa, Triticum aestivum
  Clone ID: PAT_TA_99261.pep
FPYRSMAVADAVLPSPPPPPVRIVVVMLLLLRFARVLRVAAGALTYVCSSVACVSSRAAAALLVAHRAWGTRSGPFLFLQALMYGGLKVCVLSVLASFSLAVLMCASSAWHTRLQVRTGSTSEYNKVSCELTNSL

SEQ ID NO: 204844 - protein, 144 aa, Triticum aestivum
  unsure (1)..(144): unsure at all Xaa locations
  Clone ID: PAT_TA_99262.pep
MTPAAPGEIVSRYLLPAASGEDLLMVKRFVDPARGGTRRFEVFRLEKQLGRTSWRFHKMEGQVLFVGRSCSKAFDTGRSGNPGYIYFLDDVYGXRPMSVLQQNEYPCTDMGXWSCSPGRRGNQTAAAWAATLRQRPIGTLSTRL

SEQ ID NO: 204845 - protein, 103 aa, Triticum aestivum
  Clone ID: PAT_TA_99263.pep
CGPWEHFFSSLQYVHIPTWFTKSTAASVTVNVTFPDKKTRNAHATLATVLRKTTVAKSLSDISVCSSWDLLLRARHGSLQAPTWALVGGLQLLQLLLRVRHTG

SEQ ID NO: 204846 - protein, 173 aa, Triticum aestivum
  unsure (1)..(173): unsure at all Xaa locations
  Clone ID: PAT_TA_99264.pep
EELNAVFACLPLAALVGCEGSNKNKKKKILCVHGGLSPELESPDQIRQIKRPLADVPEHGLVCDLLWSDPAADGDDWGWGDPRRCTSFTFGADVVEEFCERHGLAMVCRAHEXKDGGYDQGFAXGKLVTVFSAPNYCGKCGNDGAVMTVAGXLACSFRVFNLRILAILLRVLS

SEQ ID NO: 204847 - protein, 57 aa, Triticum aestivum
  Clone ID: PAT_TA_99265.pep
GLSPFQMHVDNSCAHERSVAQPHGWVITETSTKYTLYFCTRQTHDSSLLSSVQFHAR

SEQ ID NO: 204848 - protein, 58 aa, Triticum aestivum
  Clone ID: PAT_TA_99266.pep
YIVPHAAFNWIDLLALHPSSVGPLSLIYIWTFSSLYDHRPYDYIEAAWLYIKKKKKKK

SEQ ID NO: 204849 - protein, 123 aa, Triticum aestivum
  unsure (1)..(123): unsure at all Xaa locations
  Clone ID: PAT_TA_99267.pep
MAAAKADAKAEPNGGGGGGGGGSFTEERLSEKLNKLSSSAASIQTLSNWCIFHRKRARRVVDTWQRQFNNATTDKKVSFLYLSNDILQNSKRKGGEFVNEFWRILPGLLKDFYXKWGTRWEKW

SEQ ID NO: 204850 - protein, 157 aa, Triticum aestivum
  unsure (1)..(157): unsure at all Xaa locations
  Clone ID: PAT_TA_99268.pep
MAAATMALSSPAMAGTPVKASRAAPFVEGRITMRKTAGKPKVAASSSPWYGSDRVLYLGPLSGDPPSYLTGEFPGDYGWDTAGLSADPETFAKNRELEVIHCRWAMLGALGCVFPEVLXRNGVXKFGEGVWVKGGSXFSSEXGGLXYLGKPKLGARA

SEQ ID NO: 204851 - protein, 99 aa, Triticum aestivum
  unsure (1)..(99): unsure at all Xaa locations
  Clone ID: PAT_TA_99269.pep
LGDCATLSSFVPPFLPPAPCATSPWRLPVPLFHEGRRCDKDERMSTGGWEDESIWSKAGTSQPPMYSSPSPSTSRAGARWXGAHLQVMTTGDVLSSNGS

SEQ ID NO: 204852 - protein, 93 aa, Triticum aestivum
  Clone ID: PAT_TA_99270.pep
RLPLHMLVLGRRRDRLFLTSPRLRLAASRSSGFVNGLDRCSLIALSRRHEGSFSTTTHGKPWKLHVLVLHGGQQLPRWKQVPELVKMYIASFG

SEQ ID NO: 204853 - protein, 62 aa, Triticum aestivum
  Clone ID: PAT_TA_99271.pep
MKTFLVFALLALAAASAVAQISQQQQAPPFSQQQQPPFSQQQQPPFSQQQQSPFSQQQRHPP

SEQ ID NO: 204854 - protein, 141 aa, Triticum aestivum
  unsure (1)..(141): unsure at all Xaa locations
  Clone ID: PAT_TA_99272.pep
SCQSINQISNTRKKQEMMETFLLHHKKAKAGSMAGSGDPALGSTQLPCYGWPSVAHPDVLVHPFCLSDVKVHPFFLSDVKVWFRQKSLSSERSSRQTEKQPIQPKSPSPSSPSSPGEPTIFKKGEXHRIPRXQPIXTTXKP

SEQ ID NO: 204855 - protein, 142 aa, Triticum aestivum
  unsure (1)..(142): unsure at all Xaa locations
  Clone ID: PAT_TA_99273.pep
GALDKGREIHTYIEEKSVTTDVWLESALVDMYAKCGCTDTASQIFSTMQHKRTLTWNAMIGGLASNGQGKEAVEHFEQMLKLRDPKPDAITLKVVLGACAHVGMVDEGLHYFYLMLSLGICPXDLKHYGCVVXDLLSRAGGC

SEQ ID NO: 204856 - protein, 147 aa, Triticum aestivum
  unsure (1)..(147): unsure at all Xaa locations
  Clone ID: PAT_TA_99274.pep
AEATREENVYMAKLAEQAERYEEMVEFMEKVAKTADVGELTVEERNLLSVAYKNVIGARRASWRIISSIEQKEESRGNXAYVASIKEYRTRIETELXKICDGILKLLDSHLVPSATAAKSKXVFYLKMKGDYHKYLXGVQRGVLRRX

SEQ ID NO: 204857 - protein, 102 aa, Triticum aestivum
  unsure (1)..(102): unsure at all Xaa locations
  Clone ID: PAT_TA_99275.pep
RFSSFNHFLTSGAELSRADLAKHLHIHPYILKIKAINPSPADSCSFLAPGSGWAHRPASRATAQDMSLPTPVISATTRASKRHCAGGREKRSCMRERETXXG

SEQ ID NO: 204858 - protein, 159 aa, Triticum aestivum
  unsure (1)..(159): unsure at all Xaa locations
  Clone ID: PAT_TA_99276.pep
MDAGKLKKVAGKKFGGPRKKSVTRSVKAGLQFPVGRIGRFLKKGRYAQRVGSGAPVYLAAVLEYLAAEVLELAGNAAKDNKKSRIVPRHLLLAIRXDQELGRLLSGVTIAHGGVIPNINPVLLPKKXXRERLRKAGXARQXRPXKGNQSPPKKSQRRNV

SEQ ID NO: 204859 - protein, 70 aa, Triticum aestivum
  Clone ID: PAT_TA_99277.pep
GQKAVKNSAFPRSYYRCTHHTCNVKKQVQRLAKDTSIVVTTYEGVHNHPCEKLMEALNPILRQLQFLSQL

SEQ ID NO: 204860 - protein, 88 aa, Triticum aestivum
  Clone ID: PAT_TA_99278.pep
VWTYRDLRPSRLRGSLVHVHVGSPRLCPRCSGAVEDESRAKQHGGCRVALAPDHRLTKVRRISSRKLQGDGECYAVQERCCLPVSYIL

SEQ ID NO: 204861 - protein, 141 aa, Triticum aestivum
  unsure (1)..(141): unsure at all Xaa locations
  Clone ID: PAT_TA_99279.pep
QPQQPQQPFPQSQQPQQPFPQPQQPQQSFPQQQQPLIQPYLQQQMNPCKNYLLQQCNPVSLVSSLVSMILPRSDCQVMQXQQCCQQLAQXIPRQLQCAAIHSVVHSIVMQQEQQQXIQXLRALFQLVQGQXIIQTQQTSSI

SEQ ID NO: 204862 - protein, 74 aa, Triticum aestivum
  unsure (1)..(74): unsure at all Xaa locations
  Clone ID: PAT_TA_99280.pep
SCHRLLFCCVLTMWRRSLMNYVCFPLNLLLRWDAPVKKVCNMESETFFKKKKKKLXGGAGYPIXPXSESXXRAP

SEQ ID NO: 204863 - protein, 153 aa, Triticum aestivum
  Clone ID: PAT_TA_99281.pep
SPGLLLPDRSPFLPPSTCFRSSSFSSRSTATRHVTSGIRGPAIFLLGDRLSQAPLSNEASKTGGGDGVADRSSCQGRQRRAHRQRGKAKMRSKTSLELWRPAVTHIQRQVDDLRAQVGRIALHPVLAAPPDPIPEGDAVVRPGVQFEPRRSRN

SEQ ID NO: 204864 - protein, 99 aa, Triticum aestivum
  Clone ID: PAT_TA_99282.pep
PVACGWRHLVSPEPAVLLALHQRWGGACKVSWCLRRCRPMAGVAACRELAQCFIAGLFPWRRCEKGGREKRPTSFGSNDYASLNQTAPQAVDLSERSTG

SEQ ID NO: 204865 - protein, 78 aa, Triticum aestivum
  Clone ID: PAT_TA_99283.pep
PSPGDVLVFKYNPKMHNVVIVNKDEEFFCRAGAVGDDTYTSGYDKLELSSQGPMYAISSKPGDCEGGMKLEVHITTHR

SEQ ID NO: 204866 - protein, 78 aa, Triticum aestivum
  unsure (1)..(78): unsure at all Xaa locations
  Clone ID: PAT_TA_99284.pep
HXXLNLFLLFFSLPPPLSPXPXNXSPEEEGXISHFFAPITFXQEXRRGMSLNXSESQAVIHEVIAERXRFXXSSWEVP

SEQ ID NO: 204867 - protein, 97 aa, Triticum aestivum
  unsure (1)..(97): unsure at all Xaa locations
  Clone ID: PAT_TA_99285.pep
MATTLVRRVESWVRDQGARLPPWVPPIAVPRWPWPPPWAPAWPGDRRRQRERMFREEFERRRXKLRELCRAVRVDTIAELQELLCAMVLAECVYKVP

SEQ ID NO: 204868 - protein, 131 aa, Triticum aestivum
  Clone ID: PAT_TA_99286.pep
HEPPYIPRTTVCAVMEFQPATANAAAKHWVLPRAAVVKHRAGVGGDAVVLREERRLRCLDGGAAMQYNPRMSRRRKLQRSIHGAALAGDEASTQHPWRCSLATKLRRSIDEASTLHRWCFNAASMVLLTGE

SEQ ID NO: 204869 - protein, 159 aa, Triticum aestivum
  unsure (1)..(159): unsure at all Xaa locations
  Clone ID: PAT_TA_99287.pep
VSLLLCKKEIWVVGTSKKKKKRGGPGTQIRPISEVVLRRAHWAVVLQTSWTGGKNPWALPKLKSALCKHIPPFSAKLAVNXRKEGPRQPEXAPSPNKXAPSPGNXPKWGNXAPGKRAAIKXXAGVLGGFTPQSVEPATXLPKRXXXRPGSLFAFSFPFL

SEQ ID NO: 204870 - protein, 155 aa, Triticum aestivum
  unsure (1)..(155): unsure at all Xaa locations
  Clone ID: PAT_TA_99288.pep
VSFPPSLSSVGFGXKSSPVPWPCSAPPPSPXLRSRSRYFGWPRLTNARTKVHPGAQGRKARGPRQVAHPGXSQVHPRGGAGKKAPEGVKVRPETGXATGNNGARERTSXGAXPDKSSKGPNGSMFQSPNXVXPGRGGGPSPNARLPPXNKXNGPL

SEQ ID NO: 204871 - protein, 56 aa, Triticum aestivum
  unsure (1)..(56): unsure at all Xaa locations
  Clone ID: PAT_TA_99289.pep
PPPISPINLLRXKRXQGXSRPPPARCTIFVXTLTGKTITLEVESLXHHLXRQGKDP

SEQ ID NO: 204872 - protein, 134 aa, Triticum aestivum
  unsure (1)..(134): unsure at all Xaa locations
  Clone ID: PAT_TA_99290.pep
XRRARPPRSCRKGRRPWARWSPRRGRPRPGAGSILAGLTSAPFPPRPRPPRQAPPPVKKERKENYPTRLNYLQAKAKGRPSDIYGGLCFLFEPLAPFGWGGWRFANQWVFLRPGKPGKXALVIRVGTEXIVLRV

SEQ ID NO: 204873 - protein, 145 aa, Triticum aestivum
  unsure (1)..(145): unsure at all Xaa locations
  Clone ID: PAT_TA_99291.pep
KLDXRPAXPRTXXPRAXGNRDXGAAAGPAPPTXLPXLLQKSXQRWSXLQPSSXIPSPSXPIXIPCPLRXPKTASNXASGPLRASXDDWVRRARPXLNXGXXQRRESSKQXSGXATWXGGKXLKGXXKKAILXIVMXKXLEXWPVX

SEQ ID NO: 204874 - protein, 136 aa, Triticum aestivum
  unsure (1)..(136): unsure at all Xaa locations
  Clone ID: PAT_TA_99292.pep
MKTLFILTILAMATTIATANMQVDPSGQVQWPQQQPFRQPQQPFPQSQQPQQPFPQPQQPQQSFPQQQQPLIQPYLQQQMNPCKNYLLQQCNPXVSLVSSLVSMILPRSDCQVMQQQCCQQXLAQIPXQAPSVAIQ

SEQ ID NO: 204875 - protein, 77 aa, Triticum aestivum
  Clone ID: PAT_TA_99293.pep
LKCSTDPCIGRSKSTVSRLKGWIVEQHSTPSFSRGMAVLRACWDVCSARVLLLMMHLASFARRGTYIRIYCIYSVRS

SEQ ID NO: 204876 - protein, 98 aa, Triticum aestivum
  unsure (1)..(98): unsure at all Xaa locations
  Clone ID: PAT_TA_99294.pep
DSSIRFDQRRRRSPRRRGGNGDGXQWXRXSXPSXTKVXSVITXXGXNIVXDSSXVQIXPPXSSXTSPXRGXTXXRRXXHXLALXLXIIRGXTIXXXPC

SEQ ID NO: 204877 - protein, 62 aa, Triticum aestivum
  Clone ID: PAT_TA_99295.pep
LCHLSIRKFTCFFLTRNQQELKQGQKCMTELKLFFEHSTDASAHIYAHKLTLINAHMHTLPL

SEQ ID NO: 204878 - protein, 132 aa, Triticum aestivum
  unsure (1)..(132): unsure at all Xaa locations
  Clone ID: PAT_TA_99296.pep
KSKILWEFCNYNMCCQHYTNPFGRLPMHTRKEIKKVLQIQHALPTLYKPCPPPPAPPAHTVFESSQRQTIRHHLCHLTVLAMEIPGASSRCSMAMSSTSLLKRSCGIAQVAKRVPLRPXESRRRDCLGYYGT

SEQ ID NO: 204879 - protein, 87 aa, Triticum aestivum
  Clone ID: PAT_TA_99297.pep
LGLRGMGTVGKLSADLMRRLVGSRYAATKHPGVVANANIKVAKEAWEQRENVGVKMVHNFNPTAKLVLGAIIVVAAVKSVLAESTKP

SEQ ID NO: 204880 - protein, 67 aa, Triticum aestivum
  Clone ID: PAT_TA_99298.pep
ATAAKLLDPFEGVKILLLRSPRRGGNHRHRHHLSSLACEEASTSSPSPRPSTISITIPVIHLVPLIV

SEQ ID NO: 204881 - protein, 99 aa, Triticum aestivum
  Clone ID: PAT_TA_99299.pep
LAQGSFDQRRVLSYTGFSNAHFLSGYVLRSCLVICIYFGHFAYPDSVWMSEYMSKPNFAHSLFACIPSSLIYSVSLPFFPEALPLPFPSKATSLCHCLP

SEQ ID NO: 204882 - protein, 149 aa, Triticum aestivum
  Clone ID: PAT_TA_99300.pep
KEINFRPSLPRYLCSAAAATSHPRSSGSVVHATGGRAPSETRFSAKSIRVGASPLGAQRRRERQGGPAVYAAIVLPRRVASKTRTRRLSSPCCLRHRLIWLKLEHPWPAQIINHHVRCHLSVKLQERSHMAETFAGTSGAGHICASWMG

SEQ ID NO: 204883 - protein, 126 aa, Triticum aestivum
  unsure (1)..(126): unsure at all Xaa locations
  Clone ID: PAT_TA_99301.pep
XICSCQSSPVPGRLVQRPIVLHLLXCPTNRCSFAFTLSKHPHGAVGGRXRPRTXMTRLIASXCSXFMXRIPRWAPHEVDAGGDVVLAPRSGRRSGRPAPAGPAAAGGDGAAPPLRHGARPQNPGGR

SEQ ID NO: 204884 - protein, 137 aa, Triticum aestivum
  unsure (1)..(137): unsure at all Xaa locations
  Clone ID: PAT_TA_99302.pep
LMVRVGNGDALRHRFLLEGTIKDLEVGALRWRWTSLGHGGTTSSILTKGGRDPLPDDSGLTEVEVTSLPMSSMLYPPCLSSSLLGALLPRLRRLDSESSPSPTSWAWTAAVLLARFSPNLGGRPLSTMRCEGXFFQP

SEQ ID NO: 204885 - protein, 132 aa, Triticum aestivum
  unsure (1)..(132): unsure at all Xaa locations
  Clone ID: PAT_TA_99303.pep
LLGFSPLINVRTGRGFIQAPPSEFSFFRYEEMIGDPAAHVRXLAQFVGRPFLXEEEEAGAVEAIVRLCSFEHMTGLDVARHGKTELVVSMAENSWFFRRGQVGDWENYLSRETAGRIDAITEARFKGSGLRV

SEQ ID NO: 204886 - protein, 106 aa, Triticum aestivum
  unsure (1)..(106): unsure at all Xaa locations
  Clone ID: PAT_TA_99304.pep
CXXXQEFPRQNPLXGVPPLXPISVSTRSNPAIGSFNLLXLRQGKWSFQKDEDMELVFSTGFQPDNRIHCGGCNTVTAVLRGGFCLFFLSAIMLLVSYEVGLCIYGK

SEQ ID NO: 204887 - protein, 165 aa, Triticum aestivum
  unsure (1)..(165): unsure at all Xaa locations
  Clone ID: PAT_TA_99305.pep
PPPENCLQKLACAIGTPDVPTRYVVRGHQDQQLATTAVAPVPVINLGLLSKQDGGAADEAAKLRSAIDSWGLFLISNHGVDAAVMDGMMAACREFFRQPLEEKQRQSNLIGDDQYEGYGNYXGYGNEQXSXRDQTLDWXDRLYLKGGAXRTSRALPSGQXHPQSX

SEQ ID NO: 204888 - protein, 169 aa, Triticum aestivum
  unsure (1)..(169): unsure at all Xaa locations
  Clone ID: PAT_TA_99306.pep
PVEGVRPPIRPLRSIRQPSPRLLGEGRAKRLAAFFASTGVLKDYQAAMADKXGLXTLFAPKDDAFLAKGAPDVDKMPRADLVALLRYHALPGYNPRPSLKLVKASARPFRTLASTAGGKYNVSVVARGDDVSLDTGLRKSRVAETVLDDTPVCVLTVXRLLIFAQRGGR

SEQ ID NO: 204889 - protein, 158 aa, Triticum aestivum
  unsure (1)..(158): unsure at all Xaa locations
  Clone ID: PAT_TA_99307.pep
VRPPPXTXGHGGRGERTVSVLCGLDAVTGGGGRAQEKAAELEASEGGGQVQEEMRGIRASCQVLDPLRRAGCRVRARGALPPPLELPRRPGLRGHGGRVDAWRRQGQHTPSTGLLTGTTCSGPDYDEAVGTRKAGNXKARDSVLGAKKKRALVSLDAN

SEQ ID NO: 204890 - protein, 72 aa, Triticum aestivum
  unsure (1)..(72): unsure at all Xaa locations
  Clone ID: PAT_TA_99308.pep
IGPGNLXNCWKLALIVSGAPDATQVINEVEEVXKKEYPDAYVRIIGFDNMRQVQCVSFIAFKPPGCEESGKA

SEQ ID NO: 204891 - protein, 94 aa, Triticum aestivum
  unsure (1)..(94): unsure at all Xaa locations
  Clone ID: PAT_TA_99309.pep
LVEHGQRHHAPCKRAPRRXGWPRAANQQSXMSIPGGGTNPIXGLPTGGXPXGGRRQGKCPWEQGGAVGMGKXVXAVLXPSMAXPAMVRAWPTGG

SEQ ID NO: 204892 - protein, 123 aa, Triticum aestivum
  unsure (1)..(123): unsure at all Xaa locations
  Clone ID: PAT_TA_99310.pep
LXNPAXXPXGKXILAIXAXKVVAKWFPSRGYXISGGPLGEIXDPXXXXGSXLDPLGLADDPEAFXELKVKXIKNGRXPMXSMFGFFVQAXVTGKGPLENLAGHITDPVNNNAWXFAPNFXPGK

SEQ ID NO: 204893 - protein, 77 aa, Triticum aestivum
  unsure (1)..(77): unsure at all Xaa locations
  Clone ID: PAT_TA_99311.pep
APPRVXFFFFFFFFFFFFLXQSLLMDAHDVHIYIPRRDGSHRRDVYKRWIERTRPLQQDVXHQESKLHDGLLNRDFY

SEQ ID NO: 204894 - protein, 115 aa, Triticum aestivum
  unsure (1)..(115): unsure at all Xaa locations
  Clone ID: PAT_TA_99312.pep
MLVYQDKLSGDELLSDSFPYRELENGVLWEVDGHWVVQGAVDVDIGANPSAEGGXDDEGVDDQAVKVVDIVDTFRLQEQPAFDKKQFISHMKRYIXNLSAXAXKGNDLHAFXKEC

SEQ ID NO: 204895 - protein, 175 aa, Triticum aestivum
  unsure (1)..(175): unsure at all Xaa locations
  Clone ID: PAT_TA_99313.pep
XGXASXPXPGLVXPXAGDENTGSKQAKGENRAMPPIXNDVRRSRFITPSXPWRRWCSRLPQPHLCPLTSSPLGGCPPEGQHVXLPRLRGRGCEYVCHASSLADPHETSXFAEDRRTSPVAPSWPLASRSPTRRRPRHRAAVGAVLGLASGVAPGTLLPGGSSDEDERGGSSSRCR

SEQ ID NO: 204896 - protein, 88 aa, Triticum aestivum
  unsure (1)..(88): unsure at all Xaa locations
  Clone ID: PAT_TA_99314.pep
NLGFPCPIKGGGPVLRTPRXVPRXPRPXXELEFVXXGGXNXTALYIERSXXVKXKLSYXFSSKLXARVSFYCXAGKYQDSSGXGERKN

SEQ ID NO: 204897 - protein, 120 aa, Triticum aestivum
  unsure (1)..(120): unsure at all Xaa locations
  Clone ID: PAT_TA_99315.pep
MAAPRGAALVLAMVLAAMLVAPPATVHAISCSTVYSTLMPCLQYVQQGGSPARGCCTGIQNLLAEANNSPDRRTICGCLKNVANGXSGGPYITRAAALPSKCNXXLPYKISPXVDCNSXH

SEQ ID NO: 204898 - protein, 108 aa, Triticum aestivum
  unsure (1)..(108): unsure at all Xaa locations
  Clone ID: PAT_TA_99316.pep
PRGGAPRVGPPPLVWLPHPPPRGGGGFPFPGAFPRFPPLRKNGRWLLGGVYEPPPSVLSSGPPPWLPDNXNASRLENLYWXLXLLVAXNFGYFLTCAKLYXXXNIIGK

SEQ ID NO: 204899 - protein, 80 aa, Triticum aestivum
  unsure (1)..(80): unsure at all Xaa locations
  Clone ID: PAT_TA_99317.pep
SXRXMGVRAPIFVRHGCQSSNFRWXWXPIFFSXQLKQDQHPTXPRNHRTAVFVVSDWESTPXLSAGXXDPGPNKKRGXHC

SEQ ID NO: 204900 - protein, 74 aa, Triticum aestivum
  unsure (1)..(74): unsure at all Xaa locations
  Clone ID: PAT_TA_99318.pep
VRPPPFXIFFFFFFFFFFFFFFFFFFFFFFFFFXGTSSGTYSFKFQICSSSTARYARPSNKEQDQARRQSRGKD

SEQ ID NO: 204901 - protein, 170 aa, Triticum aestivum
  unsure (1)..(170): unsure at all Xaa locations
  Clone ID: PAT_TA_99319.pep
XXHKFIFXQPLFPRRFXTGAXFRPXXNAXFCLXPFSAALVXKXXGNXXPWXXAILLXXXQXPPXIXXFXQLQPXSSVXKXSQSXDPYFELLRKMXXCPXMFXAGQAXPSXRGPPIQPLXQXSIXARGXWEDXXXIFLPKPXXGAMAXXGXXXLGNKXRXPFGGRXXTTLG

SEQ ID NO: 204902 - protein, 94 aa, Triticum aestivum
  Clone ID: PAT_TA_99320.pep
RASILFRKAEHASSYLAKKKKNCKFNCIPLSSFRKPRCLVHMIMGSARCSTYWHTKASLDSCYSWMMPLWSDLELWTPSLKLETCSFCLDFVMC

SEQ ID NO: 204903 - protein, 77 aa, Triticum aestivum
  unsure (1)..(77): unsure at all Xaa locations
  Clone ID: PAT_TA_99321.pep
IPNXPSVVEVFXSRIAHKFDLIYAKRAFVHXWYVGEGMEEGEFSXEAREDLAALEKDYEEVGAEFDEGEDGDEGDEY

SEQ ID NO: 204904 - protein, 66 aa, Triticum aestivum
  unsure (1)..(66): unsure at all Xaa locations
  Clone ID: PAT_TA_99322.pep
MKPVVRRRYHEVIMLNXCSGLXRLPPPXSPLLVXHCRKAPCXPREEAATEISKRGSKWXLQKGGGR

SEQ ID NO: 204905 - protein, 112 aa, Triticum aestivum
  unsure (1)..(112): unsure at all Xaa locations
  Clone ID: PAT_TA_99323.pep
ANDRVYDRHRGTKIPTVDPXPXGSXNVGXXSNTPREKRRXFSXKAXGXXPLLXAGSVHXPXRGAIXAAXXXFSAGXXLTFXXDXXAPLADVKXLXGLDVXGXXPPXLXXKAS

SEQ ID NO: 204906 - protein, 179 aa, Triticum aestivum
  unsure (1)..(179): unsure at all Xaa locations
  Clone ID: PAT_TA_99324.pep
MAPTVMASTATSVAPFQGLKSTAGLPVSRRSSSAGLSSVSNGGRIRCMQVWPIEGIKKFETLSYLPPLSTEALLKQVDYLIRSKWVPCLEXFSKVGFVFREHNXSSPGYYDGRYWTMWKAAYVRGGTDATQVXNEXXREVKKEXPXDAYVXVIGFRTGAKLRLIRFKGQPGLPKEWERA

SEQ ID NO: 204907 - protein, 74 aa, Triticum aestivum
  unsure (1)..(74): unsure at all Xaa locations
  Clone ID: PAT_TA_99325.pep
GGGNLVRPPPFFFFXSKFWFNIDLITCFVTKMQTALPISQFSTGTFGXSVANXGGTFXTASTTAFYRKLKLHAT

SEQ ID NO: 204908 - protein, 147 aa, Triticum aestivum
  unsure (1)..(147): unsure at all Xaa locations
  Clone ID: PAT_TA_99326.pep
MSPQTETKACVGFQAGVKDYKLTYYTPEYETKDTDILASFRXTPQPGVPPEEAGAAVAAESSXGTWTTVWTDGLTILDRYKGRCDQXDPVXGEXNQWICYXXYPLDXXKRVPXTNMFXSSVGNVFGFKXPYARRLGGSNHTPPYLIQ

SEQ ID NO: 204909 - protein, 84 aa, Triticum aestivum
  unsure (1)..(84): unsure at all Xaa locations
  Clone ID: PAT_TA_99327.pep
MSPQTETKAGVGFQAGVKDYKLTYYTPEYXTKDTDILAAFRXSPQXGVPPEXAGAAIAAESSTGTWTTVWXDGLTSLDRYXGRC

SEQ ID NO: 204910 - protein, 105 aa, Triticum aestivum
  unsure (1)..(105): unsure at all Xaa locations
  Clone ID: PAT_TA_99328.pep
XXAPRXSASLXSPSSHRAARXPARPKXXTHHGPHIKCHCGFVXSDXAXGFPSPFIFLVCSXEYVYXHVHVPTWLEKACSYXNAIGGYVXAHAHXXFIQSVDYVFG

SEQ ID NO: 204911 - protein, 146 aa, Triticum aestivum
  unsure (1)..(146): unsure at all Xaa locations
  Clone ID: PAT_TA_99329.pep
MSPQTETKAGVXFQAGVKDYKLTYYTPEYETKDTDILAAFRVSPQPGVPPEEAGAAVAAESSTGTWTTVWTDGLTSLDRYKGRCYHIXPVAGEDNQWXCYVPYPLDLFXGGFPLLTXFTFHLXGNLFWVQTPYAPTVGGFYRPPCI

SEQ ID NO: 204912 - protein, 127 aa, Triticum aestivum
  unsure (1)..(127): unsure at all Xaa locations
  Clone ID: PAT_TA_99330.pep
HVFQSKGVETQPDVGDDGSDAAPLGRRNRPRGGGGVNSWGSRTVVQVAXEEAESSRWPGXGASRMQGSGTVEVVPSTADLAGAPGSMELNPCRPEAVAIPHLICCRLRVTARWLMGXAXSRGXPYXI

SEQ ID NO: 204913 - protein, 166 aa, Triticum aestivum
  unsure (1)..(166): unsure at all Xaa locations
  Clone ID: PAT_TA_99331.pep
MSPQTETKAGVGFQAGVKDYKLTYXTPEYETKDTDILAAFRVSPXPGVPPEEAGAAVAAESSTGTWTTVWTDGLTSLDRYKGRCYHIEPVAGEDNQWICYVXAYPXDLFEXEGSVTXHVYXQXVGNAXFGFKXPXXLLXXGRXSXNXPPYGSKLFTALGVPSLEKV

SEQ ID NO: 204914 - protein, 94 aa, Triticum aestivum
  unsure (1)..(94): unsure at all Xaa locations
  Clone ID: PAT_TA_99332.pep
VELQRLGIPVRSPATRPRLAAPPPDRSLCEPAWRVDGAPRWLXVPXWXXKAXVGEXATVVLDGQKVXPARATQLGFSYRYPYVRDAXKAIAKQL

SEQ ID NO: 204915 - protein, 67 aa, Triticum aestivum
  unsure (1)..(67): unsure at all Xaa locations
  Clone ID: PAT_TA_99333.pep
RPXSASXAAPXPEGXXPRPRACTSRGTSNRPPSLPRHSRDXXVHXRYICSSFSPXXLNSXPLPXALI

SEQ ID NO: 204916 - protein, 160 aa, Triticum aestivum
  unsure (1)..(160): unsure at all Xaa locations
  Clone ID: PAT_TA_99334.pep
KRHPTQLTQRHHYRQLTRKQKRMNETDGQRPRRKAKLSTNRYIQLAGPVPSAPAPCXRQHVSIFLSVTQVHYGRSHHDPNSSDGGSLRSNGRPAGPGAMPSSSAVDGGTGTAGGRFLRKTGRRRGRRRRKVDEVPXAEGKXXSTPPKGEXAGGWKRRXXX

SEQ ID NO: 204917 - protein, 86 aa, Triticum aestivum
  unsure (1)..(86): unsure at all Xaa locations
  Clone ID: PAT_TA_99335.pep
PPPLARCWPAXVAVRPTPEXXPRXLEEEXARVQXEIGAXRFRRGRYAEXGRVFIRXCVAPEXDDFLTXDAYGLIXVXHPRGTPSKL

SEQ ID NO: 204918 - protein, 90 aa, Triticum aestivum
  unsure (1)..(90): unsure at all Xaa locations
  Clone ID: PAT_TA_99336.pep
HWAKFYKYSNHFLSGCFRVIFFVLETSANENHFARVAICQSVSKYIFSYSFHVTNQSISTCNSIKVYSHSFPQKKKKKNSRGGPVPXSPY

SEQ ID NO: 204919 - protein, 102 aa, Triticum aestivum
  unsure (1)..(102): unsure at all Xaa locations
  Clone ID: PAT_TA_99337.pep
PGDGPVXFXXPKMPVEKXXXYXHLFVQEQDNVKRVQLXADPYLSXQAALGDANQDAMKTGSFYGGKGAQQGTLPVPAGCTDQTAKNFDPTARSDDGSCLYTF

SEQ ID NO: 204920 - protein, 142 aa, Triticum aestivum
  unsure (1)..(142): unsure at all Xaa locations
  Clone ID: PAT_TA_99338.pep
DTKPKPILVRLYVRVVSPRSGMDSDLEAFSHYPADGSFAALPGRTAAKTNYLNERFLSYXSSITIAVRSSXGKTNLSHDGLNPAHVPYXWVNNPTLTEFCFGMIGRADIEGSKSDVAMNAWPATSQVIPGVNFSGLASKCGD

SEQ ID NO: 204921 - protein, 214 aa, Triticum aestivum
  unsure (1)..(214): unsure at all Xaa locations
  Clone ID: PAT_TA_99339.pep
IRTIGRIGYRGPPRASTVASKVDQAAPRWLLPSPPPASTPTNFLGKKLKKQVTSAVNYHGKSSKANRFTVMAAENIDEKRNTDKWKGLAYDISDDQQDITRGKGIVDSLFQAPTGDGTHEAVLSSYEVRQARDSRKYDFDNTMGGFYIAPAFMDKLVVHLSKNFMTLPNIKXPLILGIWGXKGQGKSXQCEACLXQRWGSNQSRLSAGELEKWR

SEQ ID NO: 204922 - protein, 153 aa, Triticum aestivum
  Clone ID: PAT_TA_99340.pep
TSHYRANWVPGPPLGRSPPPRSPRRRPPPLSPLNPPPATPDLSFAPKAADRADKLRLVAAISVGCPRRPSMETLPPLRPNSSSARATQPAPRSVEPSSSTIMQWQQQRWNHGPETLTHGASSPWICRTRTRTTHATNKQHQCPVFSMGFCWQC

SEQ ID NO: 204923 - protein, 116 aa, Triticum aestivum
  unsure (1)..(116): unsure at all Xaa locations
  Clone ID: PAT_TA_99341.pep
VLRFSWLATRPISFFNICEDFXLASPLIIDLVIIAEXMSRIQWKAVSSDGTCXPTEYKSFHSVLSVLSYMLKAPLTPPGTPVVNALAKQRAALTNIFRACVGLEPESDMTLEHKLF

SEQ ID NO: 204924 - protein, 91 aa, Triticum aestivum
  unsure (1)..(91): unsure at all Xaa locations
  Clone ID: PAT_TA_99342.pep
LASDPSGXFALRTVDDXPMRPLDPKRLYLYSKEDEIISHLDIEGYIAESQQRGYETRQELFDGTNHVGHMREHPEKYWKAIQEAWQWSNDE

SEQ ID NO: 204925 - protein, 186 aa, Triticum aestivum
  unsure (1)..(186): unsure at all Xaa locations
  Clone ID: PAT_TA_99343.pep
MSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEEGSVTNMFTSIVGNVFGFKALRALRLEDLRIPPTXSKTFQGPPQGIQSXRDKLDKVRPXLMGMYNKPKLGXXQKILS

SEQ ID NO: 204926 - protein, 62 aa, Triticum aestivum
  unsure (1)..(62): unsure at all Xaa locations
  Clone ID: PAT_TA_99344.pep
TATSRAKWVPGPPSSFFFFFFFFFFFFFFFFFFFFFFFKXKXQGQDQKLGKKPDWYLRKIAQ

SEQ ID NO: 204927 - protein, 51 aa, Triticum aestivum
  unsure (1)..(51): unsure at all Xaa locations
  Clone ID: PAT_TA_99345.pep
GEGTGPPLEFFFFFFFFFFFFFFFFFXXNGKPTFFIGXRLFEFFFFFFFWI

SEQ ID NO: 204928 - protein, 100 aa, Triticum aestivum
  unsure (1)..(100): unsure at all Xaa locations
  Clone ID: PAT_TA_99346.pep
RATIGRGYRAPLRSSAAPVARWXRGPSSSGQPPAAAPLSTPPPPPRASTRVSAATPPLPSSASPRSPSLPPPRPPARTAPAAVTPARGRMTREPTITTWG

SEQ ID NO: 204929 - protein, 184 aa, Triticum aestivum
  unsure (1)..(184): unsure at all Xaa locations
  Clone ID: PAT_TA_99347.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKGGSQIFSEGGLDYXGNPSLVHAQSILRHLGLQVVLXGALEGYXLXXGPLGXI

SEQ ID NO: 204930 - protein, 156 aa, Triticum aestivum
  unsure (1)..(156): unsure at all Xaa locations
  Clone ID: PAT_TA_99348.pep
GEXGTGPPLEFFFFFFFFFFFFFFFFLADRLYKYIMCMCIYIATDCIHIRACFLEPCWYMNXDIHIFLGTNKKDKWRRKTQSNVRVDKTAMALYMWPVVSELFRPCRTPPXPGGFXGDEADALHLAHVGRIPMMRDVRVKXTPFLNLLPTSXWIXL

SEQ ID NO: 204931 - protein, 36 aa, Triticum aestivum
  unsure (1)..(36): unsure at all Xaa locations
  Clone ID: PAT_TA_99349.pep
GELGTGPPLEFFFFFFFFFFFFFFFFFFFFFFNLXA

SEQ ID NO: 204932 - protein, 165 aa, Triticum aestivum
  unsure (1)..(165): unsure at all Xaa locations
  Clone ID: PAT_TA_99350.pep
MSPQTETKAGVGFQAGVKDYKLTYYTPEYETKDTDILAAFRVSPQPGVPPEEAGAAVAAESSTGTWTTVWTDGLTXSLDRYKGRCYHIEPVAGEDNQWICYVAYPLDLFEEGSVTNKFTSIXGNXFGFKALRAPSLGGXTXPPTNQKXSKGXPKGSKXEKKXXTN

SEQ ID NO: 204933 - protein, 183 aa, Triticum aestivum
  unsure (1)..(183): unsure at all Xaa locations
  Clone ID: PAT_TA_99351.pep
IRATRGRNGYRAPPRVFFFFFFFFFFFFFFFFFFFFFFFFXQXEXKXXIEPKKDLXKXPGRXVSLXXREPTXRXGXXTNSXEATASXTSEXVLPXRXXXRGGXKKENNSRXSXXKPXLXPQXDSPMSNXVGKTSGQEKPTRLXXKWEEXKXAXNLXNRNFXXPIXXKKXNWMGRXXGGKXKGG

SEQ ID NO: 204934 - protein, 98 aa, Triticum aestivum
  unsure (1)..(98): unsure at all Xaa locations
  Clone ID: PAT_TA_99352.pep
GDAARCLSYTLHTGFQLSGPNYKGLSNIISPLAAIISIFPRMSPPLHQFYQQSAVNNVTKCEQSNWKGNAAPKKTDILTPDPSKSLVYLPGSALIKXA

SEQ ID NO: 204935 - protein, 116 aa, Triticum aestivum
  unsure (1)..(116): unsure at all Xaa locations
  Clone ID: PAT_TA_99353.pep
XIRHSVXNTXRXTASKTTKSRDEXIGPRNKLAXPTXXYETXIIQSKHGVWGGXSPLELKWGXLVNXXXLMAPWGSSERXXXWGXQTSWGGXAXPPGXLXXLXNXIXGXPKDGGGQG

SEQ ID NO: 204936 - protein, 129 aa, Triticum aestivum
  unsure (1)..(129): unsure at all Xaa locations
  Clone ID: PAT_TA_99354.pep
MRECISIHIGQAGIQVGNACWELYCLEHGIQPDGQMPGDKTVGGGDDAFNTFFSETGAGKHVPRAVFVDLEPTVIDEXEDWALTGKLFQPEEAYQWQGRDAXXNFARGIQLGKGWVDLVAWPSRKFQLL

SEQ ID NO: 204937 - protein, 179 aa, Triticum aestivum
  unsure (1)..(179): unsure at all Xaa locations
  Clone ID: PAT_TA_99355.pep
XLGXXQRAXFPWXKXLXIPXVGGXFXFXVVGAFPXXGGRXXGPRSHLLFLAGRPXLXPXRRALTNRRASSVDVAAKHKLKNHSSMAGSLVVSDRPCVRAYFSNLTIXALRYETIYPTVHRSVXFFLSQPNVQYFGGPPGTKEXETTXFPCCKKKKKKKKKKKKKKKKKLEGGPGTQFAL

SEQ ID NO: 204938 - protein, 119 aa, Triticum aestivum
  unsure (1)..(119): unsure at all Xaa locations
  Clone ID: PAT_TA_99356.pep
VYEPVGRGYRAPPRDHQSXKESAEMDSEPSLLYQHYPNMVYDQQFDDEQFSPISFPPDGEQQFNMSYNKAVRGRLDDLVEMTTCMVEPSISYVVDSCNLSNDSATNHVPVMDNGALANG

SEQ ID NO: 204939 - protein, 127 aa, Triticum aestivum
  unsure (1)..(127): unsure at all Xaa locations
  Clone ID: PAT_TA_99357.pep
YEPLEGEGTGPPLKSYREGLIFHXETKACVGFQAGVKDYKLTYYTPEYETKDTDILAAFRVSPQPGVPPEEAGAAVAAESSTGTWTTVWXTMDLPSLDRYXGRCYHIEPVAGEDKPXWICYVAYPIP

SEQ ID NO: 204940 - protein, 86 aa, Triticum aestivum
  unsure (1)..(86): unsure at all Xaa locations
  Clone ID: PAT_TA_99358.pep
APSPPMWIIQSKKNTLLSYRLHMHKQVLQLHEWRLGEKNMSTVFGTMKXGCWKLVMPPTAXXAGFRVIKDGXIXNVACXXPWXTXF

SEQ ID NO: 204941 - protein, 86 aa, Triticum aestivum
  unsure (1)..(86): unsure at all Xaa locations
  Clone ID: PAT_TA_99359.pep
NCSXXGXRTQAXKXGRXLXETAPIIXXXGGWLGFSQEVLIQSXPXKXSLRXSMAXRXXEVVDEFXGGRDGXXXXGVLXDXAPFGXG

SEQ ID NO: 204942 - protein, 137 aa, Triticum aestivum
  unsure (1)..(137): unsure at all Xaa locations
  Clone ID: PAT_TA_99360.pep
RAWVPGPPLSRVIGRDPSPQTETKAGVGFQAGVKDYKLTYYTPEYETKDTDILAAFRVSPQPGVPPEEAGAAVAAESSTGTWTTVWTDGLTSLDRYKGRCYHIEPVAGEDNQWICYVAYPLDLFEXEGSVXNMVYQW

SEQ ID NO: 204943 - protein, 79 aa, Triticum aestivum
  unsure (1)..(79): unsure at all Xaa locations
  Clone ID: PAT_TA_99361.pep
KNCCQRVXTLQLQAKFXVCKNLCDWXSXTLINHFCIPKGTPXKKXNGXXPKKRTNQTIFPXQLKKQGNCSXALSSRXXW

SEQ ID NO: 204944 - protein, 79 aa, Triticum aestivum
  unsure (1)..(79): unsure at all Xaa locations
  Clone ID: PAT_TA_99362.pep
EPQIPLGTTDCPGTWXLWKLALLFXGCTDATQVITEVEEVKKEYPDAYVRIIGFDNMRQVQCVSFIAFKPPGCEESGKA

SEQ ID NO: 204945 - protein, 94 aa, Triticum aestivum
  unsure (1)..(94): unsure at all Xaa locations
  Clone ID: PAT_TA_99363.pep
SXPGLXXPPXXGAPPQEPGAXWXRXXFPXXSXGPGXPXTPTXGGFGLFQPGQVXGLQHPVLTXAXYYTYIFXLNKLLVRTYVRNAASKCNGHVR

SEQ ID NO: 204946 - protein, 92 aa, Triticum aestivum
  unsure (1)..(92): unsure at all Xaa locations
  Clone ID: PAT_TA_99364.pep
KMRXGGXFXASKSXRXSSMALXLASXSXXIAGTMAXQXICXYNXXGRGXGGQWYGRGGERDSGGAWLGWPGRDTPLHGAGGGPVPNSPYSES

SEQ ID NO: 204947 - protein, 125 aa, Triticum aestivum
  unsure (1)..(125): unsure at all Xaa locations
  Clone ID: PAT_TA_99365.pep
QXGXGXYXXGCXXGRPPSFGGRAFARXSXXRACSFIFPXTQRXXSPPPTTEQRAQRSQPACVRASPPPACPSVRXIYDRVVSFLAIIMHESFKFASWVDQFVVSSWSCKTVDDLCDATDPVNLLL

SEQ ID NO: 204948 - protein, 68 aa, Triticum aestivum
  unsure (1)..(68): unsure at all Xaa locations
  Clone ID: PAT_TA_99366.pep
XYEPLXGELGTGPPLEFFFFFFFLMHGNSXNXDEKIMLMDTSXMSDAQKQFYKNKQDEIIARCQNTXG

SEQ ID NO: 204949 - protein, 169 aa, Triticum aestivum
  unsure (1)..(169): unsure at all Xaa locations
  Clone ID: PAT_TA_99367.pep
SLYGELGTGPPLGLSAKNYGRACYECLRGGLDFTKDDENVNSQPFMRWRDRFVFCAEAIYKSQAETGEIKGHYLNXTAGTCEEMIKRAVFARELGVPIVMHDYLTGGFTAXTTXAHYCXDNGLLLHIHGAMHAVIDKTEKSWYAFPVYXAKXISXCPGGXNYIHSRVVG

SEQ ID NO: 204950 - protein, 66 aa, Triticum aestivum
  unsure (1)..(66): unsure at all Xaa locations
  Clone ID: PAT_TA_99368.pep
WYLDCGXPMXGGXRTPTRXINXVEGVKKXYPDAYVRIIGFDNXRQXVQCVSFIAFKPPGCXESGKA

SEQ ID NO: 204951 - protein, 119 aa, Triticum aestivum
  unsure (1)..(119): unsure at all Xaa locations
  Clone ID: PAT_TA_99369.pep
YSHYRANWVPGPPSSFFFFFFFFFFFFFFFFFXGXGXGDEFPDXTXXEERHEPRXNCLTXRXRRRGNPVXPKKYXVLXWQXRLXLIISKPXGSIISSXSSHILXMKXQMTNVLSVXQXQ

SEQ ID NO: 204952 - protein, 85 aa, Triticum aestivum
  unsure (1)..(85): unsure at all Xaa locations
  Clone ID: PAT_TA_99370.pep
PVVGLECLFRTLTRAXTITLEVESFLXPLXNCEGEXPKTREXIPPDQQRXIFXGKQLXEDGRTLADYNIQKESTLHLVLRLRGGQ

SEQ ID NO: 204953 - protein, 51 aa, Triticum aestivum
  unsure (1)..(51): unsure at all Xaa locations
  Clone ID: PAT_TA_99371.pep
NWVPGPPFFFSTHSRCXDRTLTLTSTXVTNXGFIIHLWPHASEFIHNPENS

SEQ ID NO: 204954 - protein, 55 aa, Triticum aestivum
  unsure (1)..(55): unsure at all Xaa locations
  Clone ID: PAT_TA_99372.pep
FLFALQXFQEQWEMMSSXFFLCRFRSIGSGXSXVGRRSTATLAPIEYCLGYNLPR

SEQ ID NO: 204955 - protein, 58 aa, Triticum aestivum
  Clone ID: PAT_TA_99373.pep
GELGTGPPLEFFFFFFFFFFFFFFFFFFFFFNKHITGALGILYTKYTPPPDEIVNKKM

SEQ ID NO: 204956 - protein, 98 aa, Triticum aestivum
  unsure (1)..(98): unsure at all Xaa locations
  Clone ID: PAT_TA_99374.pep
IGYRAPPSRVPSHRPTWHAXLQAAATLMPXNXXGRASSARPSSHVARAFGVDAGARITCSLQSDIREVASIFXDXANMVXFAXSTXALLVSGXXRWGA

SEQ ID NO: 204957 - protein, 87 aa, Triticum aestivum
  unsure (1)..(87): unsure at all Xaa locations
  Clone ID: PAT_TA_99375.pep
GELGTGPPLEERAELLEGLVVSNKDATVPXCRKKILLLWGHNDNIXNIQLAKTMXEQLGGEDNACKXHRQRAGTSRTLEKLFNQTTD

SEQ ID NO: 204958 - protein, 82 aa, Triticum aestivum
  unsure (1)..(82): unsure at all Xaa locations
  Clone ID: PAT_TA_99376.pep
ELGTGPPLEFFFFFFSNIPQVHTTQQVVNQXPXXKHSXRQTTDSPAWADHRIVVXEGKLNVHQVANSAAXVFXTXXTVLXLV

SEQ ID NO: 204959 - protein, 149 aa, Triticum aestivum
  unsure (1)..(149): unsure at all Xaa locations
  Clone ID: PAT_TA_99377.pep
MSPQTETKAXXGXQAGVKDYKLTYYTPXYETKDTDILAAFRVSPQPGVPXVXAXAAVAXESSXGTXTTVWTDGLTXLDRYKGRCYHIEPVAGEDNQWICYXVAYPLXLFEEGSVTNMFTSIXVGNVFGFXSPTXLXVWEDLLIPPNXIK

SEQ ID NO: 204960 - protein, 74 aa, Triticum aestivum
  unsure (1)..(74): unsure at all Xaa locations
  Clone ID: PAT_TA_99378.pep
LMIDWEFLQLXGFXXGVFPLFDCCXSSSQIFWAVRXFCICCXFHRGQLKVFLTHXRXQXPFWGFTXHVHXYLLN

SEQ ID NO: 204961 - protein, 80 aa, Triticum aestivum
  unsure (1)..(80): unsure at all Xaa locations
  Clone ID: PAT_TA_99379.pep
NPLIGRIGYRAPPSVRITAPPASPLAPPPPPHRVSXIXTXPYRXXSSPLXPTLPSPAASXIPXDCXPGGSCXGRQXRLXE

SEQ ID NO: 204962 - protein, 125 aa, Triticum aestivum
  unsure (1)..(125): unsure at all Xaa locations
  Clone ID: PAT_TA_99380.pep
THYRANWVPGPPSSFFFFFFFFFFFFFFFFFFFFCWATXEKXDDNGVVXKXGNKXVLHVXFIXNXLXPIYSXXAXSLNPXLLKGPXPSIKLAPFXRXRXTPFIPSFXNXXPPSFXXKPXXXXAIR

SEQ ID NO: 204963 - protein, 147 aa, Triticum aestivum
  unsure (1)..(147): unsure at all Xaa locations
  Clone ID: PAT_TA_99381.pep
FKSYREGLXSPQTETKAGVGFXAGXKDYXLTYYTPEYETKDTDILAAFRVSPQPGVPPEEAGXVVXAESSXGTWTSVWTDGLTSLDRYKGRXYHSEPVAGEDNQWICYVAYPLDLFEXEGSVTNMFTSSVRNVFGFKXPTPLRLGGI

SEQ ID NO: 204964 - protein, 62 aa, Triticum aestivum
  unsure (1)..(62): unsure at all Xaa locations
  Clone ID: PAT_TA_99382.pep
IGYRAPPRVFFFFFLEQLNHFHSYCLPLSKHSTXIEFXSCHQAKFQRSDGRSAGPPAKKTSP

SEQ ID NO: 204965 - protein, 152 aa, Triticum aestivum
  unsure (1)..(152): unsure at all Xaa locations
  Clone ID: PAT_TA_99383.pep
MSPQTETKAGVGFQAGVKDYKLTYYTPEYETKDTDILAAFRVSPQPGVPPEEAGAAVAAESSTGTWTTVWTDGLTSLDRYKGRCYHXEPVXGEXDNQWICYVXXPLXLFEEGSXVTNMXTSIVGXVFWFSKALTCYWDSTNSYPNSNFSKGR

SEQ ID NO: 204966 - protein, 83 aa, Triticum aestivum
  unsure (1)..(83): unsure at all Xaa locations
  Clone ID: PAT_TA_99384.pep
YTHYRANWVPGPPSSFFFFFFFFFFFFFFFFFFFXQPGKGFHCNSSTDQPFIALTAVIPSEYQILTDTGSAPKKRLTQRYLTC

SEQ ID NO: 204967 - protein, 114 aa, Triticum aestivum
  unsure (1)..(114): unsure at all Xaa locations
  Clone ID: PAT_TA_99385.pep
FVGMGNLAESIACGVAASGVLSASAXRTTVHRHPERCAAFASLGATILASNAQVVEDSDVIVISIKPQIVKKVLVELKPLLSEEKLLVSITAAIKNERFTGWPVYSGFTELLKL

SEQ ID NO: 204968 - protein, 102 aa, Triticum aestivum
  unsure (1)..(102): unsure at all Xaa locations
  Clone ID: PAT_TA_99386.pep
XXDCCNQHWXLAEQHHCRIXKEACIEFMAPRNVLQACYGNRLFQAFGGKLSFGHGGVTGHGVPWRLVWYVERSNYHMWNLVMQTAIFNPLLGLPMTYYTVIL

SEQ ID NO: 204969 - protein, 71 aa, Triticum aestivum
  unsure (1)..(71): unsure at all Xaa locations
  Clone ID: PAT_TA_99387.pep
GELGTGPPLEFFFFFFFFFFFFXFFFFFFFFFFFGKLTNILVTNQILLHVIGRIVKKALVLFTHCSMHPKP

SEQ ID NO: 204970 - protein, 100 aa, Triticum aestivum
  Clone ID: PAT_TA_99388.pep
TDECSSTHVGCKNLPGSFAALLLAQEALVSISWRVAIWCKIELREHQPSKNVYFYLFFLSVYGENKRDIQYEFFYFNEKKKKKKKTRGGARYPIRPIVSV

SEQ ID NO: 204971 - protein, 83 aa, Triticum aestivum
  unsure (1)..(83): unsure at all Xaa locations
  Clone ID: PAT_TA_99389.pep
SMCALLFGIQRSMYIHINHVSLXRSHNAXTAKIRGKXLIPTLASAGXWPNAVIGQYGCYWYKXKGXKXXGFQGXRXGXXRXQL

SEQ ID NO: 204972 - protein, 96 aa, Triticum aestivum
  unsure (1)..(96): unsure at all Xaa locations
  Clone ID: PAT_TA_99390.pep
KLCXCXEVSVKXWXXSSREHHXIXLXYLRMPAXWTXWKLPMFGCTDATQVINEVEEVKKEYPDAYVRIIGFDNMRQVQCVXFIAFKPPGCEESGKA

SEQ ID NO: 204973 - protein, 106 aa, Triticum aestivum
  unsure (1)..(106): unsure at all Xaa locations
  Clone ID: PAT_TA_99391.pep
PLXGNEXSLPFVFGISXDENHIPXYLICPISQDVLNDPHIAGGRAFTYEGDFIRXWFSTGSDTSPMTNLPLEHDELIPNIALRSAIQDWLEQQEVAAGLLTAAASR

SEQ ID NO: 204974 - protein, 107 aa, Triticum aestivum
  unsure (1)..(107): unsure at all Xaa locations
  Clone ID: PAT_TA_99392.pep
GELGTGPPLEFFFFFFFFFFFFFFFFFFFFXXKXSKKLCSXIHFKXXRKXXIKQVGVSXGFRNXQATXKXDXRRXALSRQXRXGXGXGPXARXQGQXPVTXLRRACS

SEQ ID NO: 204975 - protein, 78 aa, Triticum aestivum
  unsure (1)..(78): unsure at all Xaa locations
  Clone ID: PAT_TA_99393.pep
TPTIGRGYRAPPRVFFFFFFFFFFFFFFFFFFFFLXXAXFFIDGYXPXGNKLRTKSKHRNSSFNRKSAWFITKSPKNT

SEQ ID NO: 204976 - protein, 146 aa, Triticum aestivum
  unsure (1)..(146): unsure at all Xaa locations
  Clone ID: PAT_TA_99394.pep
GRXGYRAPXRVFFFFFFFFFFFFFFFFFFXPKVRXXLXTXTTLXAVVLPINFXYSITFILQQMLSKQKKEWKAALXGRKNTXMILQLHXFLPFLATTRIIXXYXEAKIXVXXXTYPPXXXTDYXEGMXXHTMPAXDXXGAANXGLL

SEQ ID NO: 204977 - protein, 38 aa, Triticum aestivum
  Clone ID: PAT_TA_99395.pep
THRAWVPGPPSSFFFFFFFFFFFFFFFFFFFFFFKKKN

SEQ ID NO: 204978 - protein, 156 aa, Triticum aestivum
  unsure (1)..(156): unsure at all Xaa locations
  Clone ID: PAT_TA_99396.pep
TDHLPTPTPTPTQRQVIHKANLHANYSIFPVKQSRLPSRGQTCRINPEALNTRMVGAARQLEPPIADRPALSVNDHSLADGSILCVIKRTAALAAEKXPVEALLXTTAPAGSPNIXIXDXFHVRLLXRXGLRGXELXGVLLXXNVGPGSGXYSXST

SEQ ID NO: 204979 - protein, 68 aa, Triticum aestivum
  unsure (1)..(68): unsure at all Xaa locations
  Clone ID: PAT_TA_99397.pep
TLTIGRIGYRAPPRVFFFFFFFTXFLQPNWQHCPLISAARHGPAKMNGYRKSIHVKQNQTIPIPILAS

SEQ ID NO: 204980 - protein, 58 aa, Triticum aestivum
  unsure (1)..(58): unsure at all Xaa locations
  Clone ID: PAT_TA_99398.pep
XXVVDFSTQXLSFSPNFIHXQQTCFPKSPSXYVCLFXSXSIHQLXANSXPVGFFLGIE

SEQ ID NO: 204981 - protein, 162 aa, Triticum aestivum
  unsure (1)..(162): unsure at all Xaa locations
  Clone ID: PAT_TA_99399.pep
MSPQTETKAGVGFQAGVKDYKLTYYTPXEYETKDTDILAAFRVSPQPGVPPEEAGAAVAAESSTGTWTTVWTDGLTSLDRYKGRCYHIEPVAGEDNQWICYVAYPLDXFERGFXLLTCLLPLXCNVXGFQXPYXLLRLEDLXXSPXTYSKTFXGPPXXVSKV

SEQ ID NO: 204982 - protein, 141 aa, Triticum aestivum
  unsure (1)..(141): unsure at all Xaa locations
  Clone ID: PAT_TA_99400.pep
PPQCSECASHFKPKQQPQAVLGIXFSTVFAGAMGPISYSIIXEASSVRLRALSTGVGRGAYYVAEIPMIYLASQMLNTTGWNMAGKCGYVWGSTALVCWVAAYFGLPEFKHRSYRELDILFNRKVPARQFKKTVIDVRDNE

SEQ ID NO: 204983 - protein, 59 aa, Triticum aestivum
  unsure (1)..(59): unsure at all Xaa locations
  Clone ID: PAT_TA_99401.pep
LSQPAXXXANXXAMKXGSXYGGKGAQQGTLPXPAGCTDXXAKNFDPTXRSDDGSCLYXF

SEQ ID NO: 204984 - protein, 134 aa, Triticum aestivum
  unsure (1)..(134): unsure at all Xaa locations
  Clone ID: PAT_TA_99402.pep
RLTIGRIGYRAPPRVFFFFFFFFFFFSSKTKCNLRACNVQFDPGGNLKEVIIVVAXHNVXIGRGCYXALFHQVALLKNIAPTDEHTLNYIPFGTGRLXSNQSAHKXTRTDFLEXXTSXNQXRTLXXXPXIRXRR

SEQ ID NO: 204985 - protein, 48 aa, Triticum aestivum
  Clone ID: PAT_TA_99403.pep
EHYRANWVPGPPSSFFFFFFFFFFFFFFFFFFFFFGKMWNFVARSLFT

SEQ ID NO: 204986 - protein, 177 aa, Triticum aestivum
  unsure (1)..(177): unsure at all Xaa locations
  Clone ID: PAT_TA_99404.pep
RXCXFWRXCVPXIRVLHRLRVLVRPAGLDLLPGLAGRAVVHSGVGLTLVGRRGWESQSGADQIWRLRPQRVLWRGGYSVQWRGGGSLLAARQWVAGRWSSGHVRRRGCHGPMLHGDAGSRSTSNNLFIGCVCMFNLAKAMLCSEPTMVTPVGATNLLEKKKKKTRGGARYPIRPIVX

SEQ ID NO: 204987 - protein, 91 aa, Triticum aestivum
  unsure (1)..(91): unsure at all Xaa locations
  Clone ID: PAT_TA_99405.pep
PNXQSQRQLXTMFFXNNXNRKXGQQPQQXQQVQQGXFLQPXQIAXLXVXTSIXXRTXPTXCXVNXPLYSSXXSXXFXVGTGVGAYCEKMYI

SEQ ID NO: 204988 - protein, 82 aa, Triticum aestivum
  unsure (1)..(82): unsure at all Xaa locations
  Clone ID: PAT_TA_99406.pep
PKHRNVLAGGTCGCGTACKCXXGCGXCNMYPEVEAAGATLLVSATATHKASXGGMEMAAENGGCGCTQCKCGTSCGCSCCXX

SEQ ID NO: 204989 - protein, 102 aa, Triticum aestivum
  unsure (1)..(102): unsure at all Xaa locations
  Clone ID: PAT_TA_99407.pep
DINIYXKLSLTCTMKLFGMGRGLHSXVCRAXIGHEVCXIMFLSEXIFASVRALSCTTCHTAFFLAXLARXILRIPRXMLRTYPSTRGSGTTXXRNXRRAXXH

SEQ ID NO: 204990 - protein, 84 aa, Triticum aestivum
  unsure (1)..(84): unsure at all Xaa locations
  Clone ID: PAT_TA_99408.pep
XVGXXSRXXKGIPLGTXDGRYWTMWKLPMLGXXDATQXXNEVEEVKKEYPDAYVXXIXFDNMRQVQCVSXIAFKPPGCEESGKA

SEQ ID NO: 204991 - protein, 115 aa, Triticum aestivum
  unsure (1)..(115): unsure at all Xaa locations
  Clone ID: PAT_TA_99409.pep
PPEPXXAHAGPPPAXPXAAPPRTPPPPWPSAPPPGWPSAPRRPSXTPRPWCRRGAGRAGRRPVGHGRRAGGRRGGRRARAACRTCTRRRIPPSVALARSLRGGGGPVPNSPYSGY

SEQ ID NO: 204992 - protein, 50 aa, Triticum aestivum
  unsure (1)..(50): unsure at all Xaa locations
  Clone ID: PAT_TA_99410.pep
REPKPPAPXPEYGPVPKPEPKPQPHPXYHPVPPTPXYXGGGGGGGYHGHH

SEQ ID NO: 204993 - protein, 57 aa, Triticum aestivum
  unsure (1)..(57): unsure at all Xaa locations
  Clone ID: PAT_TA_99411.pep
RPGNGPGAGLLARAWSRTXGVLPNINPVLLXPKKTAEKEPKSPKKAAKSPKKADKKA

SEQ ID NO: 204994 - protein, 70 aa, Triticum aestivum
  unsure (1)..(70): unsure at all Xaa locations
  Clone ID: PAT_TA_99412.pep
PPPDPQQIVGSLPMFGCTPTQHQXIXEVEEVKKEYPDAYVXIXXFDNMRQVQCVSFIAFKPPGCEESGKA

SEQ ID NO: 204995 - protein, 103 aa, Triticum aestivum
  unsure (1)..(103): unsure at all Xaa locations
  Clone ID: PAT_TA_99413.pep
PQXAVGKLXSPSXXRVARSPAXPKQLXXHGPHXKCXCGFXNSDIALGFPXPFIFXXCSXXYXYVHVHXPTWLXKXCXYXNXIXGYXXAHAHXIFLXXXDYXLG

SEQ ID NO: 204996 - protein, 74 aa, Triticum aestivum
  unsure (1)..(74): unsure at all Xaa locations
  Clone ID: PAT_TA_99414.pep
RIPWVDCPVTGTXWXPPYXFGCTDATQVINEXEEVKKEYPDAYVRIIXFDNMRQVQCXSFIAFKPPGCEESGKA

SEQ ID NO: 204997 - protein, 39 aa, Triticum aestivum
  Clone ID: PAT_TA_99415.pep
TGPPLEFFFFFFFFFFFFFFFFFFFFFFFFTQFKSQPQD

SEQ ID NO: 204998 - protein, 79 aa, Triticum aestivum
  unsure (1)..(79): unsure at all Xaa locations
  Clone ID: PAT_TA_99416.pep
IFREHNASPGYSDGRYWTMWKLPMXGXTDATQVINEVEEVKKEYPDAYVRIIGFDNMRQVQCVSXIAFKPPXCEESGKA

SEQ ID NO: 204999 - protein, 82 aa, Triticum aestivum
  unsure (1)..(82): unsure at all Xaa locations
  Clone ID: PAT_TA_99417.pep
MLRRHNREGRRCGAIPPGRTSLSRRSPKRSAXWWFLDXVXMSKSEXLDSMNKSREHGFLSFRNTAKSFNAWIDKMKVLKXVP

SEQ ID NO: 205000 - protein, 41 aa, Triticum aestivum
  unsure (1)..(41): unsure at all Xaa locations
  Clone ID: PAT_TA_99418.pep
GELGTGPPPEFFFFFFFFFFFFFFFFFFFFFFFFLXKLQYN

SEQ ID NO: 205001 - protein, 162 aa, Triticum aestivum
  unsure (1)..(162): unsure at all Xaa locations
  Clone ID: PAT_TA_99419.pep
MSPQTETKAGVGFQAGVKDYKLTYYTPEYETKDTDILAAFRVSPQPGVPPEEAGAAVAAESSTGTWTTVWTDGLTXLDRYKGRCYHIEPVAGEDNQWICYVAYPLDLFEEGSVTNMFTSIVRNVFGFKXALRALRXEDLRIXPPTYSKTFXGPASRVSNVEK

SEQ ID NO: 205002 - protein, 36 aa, Triticum aestivum
  unsure (1)..(36): unsure at all Xaa locations
  Clone ID: PAT_TA_99420.pep
ATIGRIGYRAPPAXFFFFFFFFFFFFFFFFFFFFFF

SEQ ID NO: 205003 - protein, 111 aa, Triticum aestivum
  unsure (1)..(111): unsure at all Xaa locations
  Clone ID: PAT_TA_99421.pep
XXFSPXDXXXGGYXNXNFXXDXKPXGLXXQLTTXXYSFXVWLYXXIXRWYSNXLGFXXXVYDIXFPXQIKXPLXCSKKKKKKKKKKKKKKKKKKKKKNSRGGPVPNSPYSG

SEQ ID NO: 205004 - protein, 84 aa, Triticum aestivum
  unsure (1)..(84): unsure at all Xaa locations
  Clone ID: PAT_TA_99422.pep
RXQEGPCAXSPNXTNVXEVXSXRIDXKFDXMYAKRAFVHWXVGEGMEEXEFSEAREDLAALXKDYEEVGXEFDEGEDGDEGDEY

SEQ ID NO: 205005 - protein, 118 aa, Triticum aestivum
  unsure (1)..(118): unsure at all Xaa locations
  Clone ID: PAT_TA_99423.pep
QKKEKNTIRPRHLLPPDASCPHAAPCLSPSRVAFXSGQRCARLPLAPPALILGLMLAGDPLSTTXPCARPRSSSASCSXGNFSRRRILXCPTLGSSGLGVCXAXQGXGXRHPXGARLR

SEQ ID NO: 205006 - protein, 163 aa, Triticum aestivum
  unsure (1)..(163): unsure at all Xaa locations
  Clone ID: PAT_TA_99424.pep
GTXDSCLKPXPKESEREXVWTNXPLPAAPXDHEXXWSXHGXRFVRXPEGTRSRIXXMSLGALQRXQVEVVVEPRGVAGGGADRGGHGAARQEAAARPPARPTAVVVGDVDLAGRRRVVAGVRRVVHGDARQRLRALGAQVLVLVVRRDLGTSLEGGPGTQFAL

SEQ ID NO: 205007 - protein, 103 aa, Triticum aestivum
  unsure (1)..(103): unsure at all Xaa locations
  Clone ID: PAT_TA_99425.pep
EXLIQXNLPIGRPDTPGYXDTPGXTXPXVSXNLRIKKXKNTGARLGXXDDTLGTRSAEKQXQPNTXPYFAGFASTXLXKRTXCPKPSQXSRRMGLXXAXLXGL

SEQ ID NO: 205008 - protein, 126 aa, Triticum aestivum
  unsure (1)..(126): unsure at all Xaa locations
  Clone ID: PAT_TA_99426.pep
GGXHXWAYASSXPXSLGDDSVXQXGXGTXGHPWGNAPGAAXNRVAXEACVQARNEGRDXAREGNEIXRAACKWSPELAAACEXWKAXXLEFEPXDXIDXVXXTKDKGINKAKKKKKKTRGGARYPI

SEQ ID NO: 205009 - protein, 115 aa, Triticum aestivum
  unsure (1)..(115): unsure at all Xaa locations
  Clone ID: PAT_TA_99427.pep
MSPHPQLPREVAPTPVKXCYGETXPIEXGSTPRXSRWAQEQVTKTVLQGMKSPVRLXDITALSALRKDAHPSVYSGDFSPAQRGNPAGSADCSHWCLPGLPDTWNQXFYTLLFYQ

SEQ ID NO: 205010 - protein, 67 aa, Triticum aestivum
  unsure (1)..(67): unsure at all Xaa locations
  Clone ID: PAT_TA_99428.pep
LLPALAXKLXXXYXKRAXXXHWYVGEGMEEGEFSXEAREDXAALEKDYEEVGAEFDEGEDGXEGDEY

SEQ ID NO: 205011 - protein, 116 aa, Triticum aestivum
  unsure (1)..(116): unsure at all Xaa locations
  Clone ID: PAT_TA_99429.pep
FFXQEXXXLPGGXTXSVXRGIHXWHXPALTEICGGTIPVLQXGGGTLGXXWGNAPGAXAXRVALEAXVXAXNEGRDLXREGXEXIRXACKWXPELAAACEVWKXIKFEFEXVDXXD

SEQ ID NO: 205012 - protein, 178 aa, Triticum aestivum
  unsure (1)..(178): unsure at all Xaa locations
  Clone ID: PAT_TA_99430.pep
TXHYRAXWVPGPPFFFFFFFFFFFFFFFFFFFFFFFFFFFFLNKNHDTYXPKGVXXXXSXCSTEXXKQPFSLXXKSKXFWXPPIYXXXLXXFPXXXXRXKVRXXXCSNGXGYTXKGXNHGXXDPKPFXHVQPLLXXVXGKPPREAXXXGRXHXXNHANGQAXXPEXSXPPDPXXRELP

SEQ ID NO: 205013 - protein, 77 aa, Triticum aestivum
  unsure (1)..(77): unsure at all Xaa locations
  Clone ID: PAT_TA_99431.pep
TNAFPGYFDGRYXWTMWKLPMFGCTXDATQVINEVEEVKKEYPDAYVRIIGFDNMRQVQCVSFIAFKPPGCEESGKA

SEQ ID NO: 205014 - protein, 80 aa, Triticum aestivum
  unsure (1)..(80): unsure at all Xaa locations
  Clone ID: PAT_TA_99432.pep
DSLXGEXGTGPPPSTHLICCGSLTRRRRQHIDLHHLASSFLCTVVDNTGTASGLPPFCPPLHVVRFEAAPHHKHLTLCSI

SEQ ID NO: 205015 - protein, 161 aa, Triticum aestivum
  unsure (1)..(161): unsure at all Xaa locations
  Clone ID: PAT_TA_99433.pep
XHYRAXWVPGPPSSFFFFFFFFFFFFFFFFFFFFFFLXEPLXINXEINXSXSPNAXQXTXXLSXEFKXPLAXSNKSXKKXXKDDGXXXTXIRXNLGAVATXGSVXGLXVGGNGXCGLGGALNAGEVGXAEEXXHVHXXLGDAXXRSTSERXXXRXTSPXAG

SEQ ID NO: 205016 - protein, 80 aa, Triticum aestivum
  unsure (1)..(80): unsure at all Xaa locations
  Clone ID: PAT_TA_99434.pep
RALXGRXGYRAPPRVFFFFFFFFFFFFFFXTSKYXQLPFCTSXIXIVXTXXKGDCQRFXXLXTXGNSYLXHXRKXLCNXX

SEQ ID NO: 205017 - protein, 119 aa, Triticum aestivum
  unsure (1)..(119): unsure at all Xaa locations
  Clone ID: PAT_TA_99435.pep
RDLKPXLXXYRIXXGXDEGLXVVXPDGGGFXVTATXXKLXRXDRKDLLPAXFFRGLKLAXFCHXYPXKXFXYXXFFKKXXLXLKKKKKKKKKKKKKKKKKKKKKTRGGARYPXRPIVSR

SEQ ID NO: 205018 - protein, 84 aa, Triticum aestivum
  Clone ID: PAT_TA_99436.pep
MGTGPPLEFFFFFFFFFFFFFFFFFFFFFFFFQNQKDPLLLFPGKSHPPGKKAKTTTGKKDPFPGKVNSGKIGAPTPRSPALNV

SEQ ID NO: 205019 - protein, 91 aa, Triticum aestivum
  unsure (1)..(91): unsure at all Xaa locations
  Clone ID: PAT_TA_99437.pep
HXVLNMIAXPFFILXXVTNXGLQHHQQGRSRXVAXTPTRARACXLPPGXKASGGVHVGGMAPVYXSLQXLREGSXVDXXQVLQXGAXCXTS

SEQ ID NO: 205020 - protein, 63 aa, Triticum aestivum
  unsure (1)..(63): unsure at all Xaa locations
  Clone ID: PAT_TA_99438.pep
GRGYRAPPRVFFFFFFFFFFFFFFFFFFFFFFFXXXSFEIKRXXMSKRCNKVKSKDQTRRIRL

SEQ ID NO: 205021 - protein, 82 aa, Triticum aestivum
  unsure (1)..(82): unsure at all Xaa locations
  Clone ID: PAT_TA_99439.pep
IACRCXQEXLPXSIKSINMGKVSGVPGKCGVSVPFPISLSTNLRHSQLVQYNPFLRACMDALVWNLMTLMECSYDTDELLKK

SEQ ID NO: 205022 - protein, 139 aa, Triticum aestivum
  unsure (1)..(139): unsure at all Xaa locations
  Clone ID: PAT_TA_99440.pep
YTHYRAWVPGPPSSFFFFFFFFFXFFFFFXFFFFFFFFFFWPHSGTWLINCAQLAGPPRSIKINTQSSYTIHDVVMHISSDGRTRTAKIYLPGNLAKAQAFLTGSAKVLNWPLPGHKKPENGKGEAAVLLHLEARGGGL

SEQ ID NO: 205023 - protein, 86 aa, Triticum aestivum
  Clone ID: PAT_TA_99441.pep
HWNVNKHNRSESYNVVYTKHDSLPLSTTSTTHSLARTNQPIAFFRLISCPRFLNAALTVASYLCFHRGYHESFCLHSSRVFRHGLM

SEQ ID NO: 205024 - protein, 71 aa, Triticum aestivum
  Clone ID: PAT_TA_99442.pep
YRAPPRVFFFFFFRATITILQTYQGTSHWKNNATNGFFPMAKLTIFELARHLNKNYMIHNFPSCTCYPEHK

SEQ ID NO: 205025 - protein, 133 aa, Triticum aestivum
  unsure (1)..(133): unsure at all Xaa locations
  Clone ID: PAT_TA_99443.pep
MANPRVFFDMTVGGAPAGRIVMELYKDAVPRTVENFRALCTGEKGXVGKSGKPTALQGEARFNRVDSPNFNFAGGANFNQRGRQGRRIPILTGKVSPDESVPKKQQQSPGDSSPMGKRRANNKGPQFSFQPFP

SEQ ID NO: 205026 - protein, 80 aa, Triticum aestivum
  unsure (1)..(80): unsure at all Xaa locations
  Clone ID: PAT_TA_99444.pep
SSFFFFFFFFFFFFFFFFFFFFXVKLXNCSWXXXSLRTFLGHSYNQTNKMHNIQRVFRFLEQEMASFIPTNVCPLKKPSY

SEQ ID NO: 205027 - protein, 99 aa, Triticum aestivum
  unsure (1)..(99): unsure at all Xaa locations
  Clone ID: PAT_TA_99445.pep
LAXVXGPLXSXFCXAXSLALLDGRRXXFGXLTXGGGACXTQLFLVLLHIGLKEVKCLMAPVCXNLWGRQYFCSALCMVVSRLSNVGVSNYQMLSVSKTF

SEQ ID NO: 205028 - protein, 121 aa, Triticum aestivum
  unsure (1)..(121): unsure at all Xaa locations
  Clone ID: PAT_TA_99446.pep
MPSSQALALVSLSLALLLCCTSPLLAHAQTPATDPAADVCAALATDEACHNVPKALRLKLIXIPNILVSNVXGVCLXLFAKXVPGLQPERNLFXVVKGFASGVILSNRXIEVLPGILLKTS

SEQ ID NO: 205029 - protein, 30 aa, Triticum aestivum
  unsure (1)..(30): unsure at all Xaa locations
  Clone ID: PAT_TA_99447.pep
LAXSRVSVXRTTFXXLRXQXFXSXNSXXFT

SEQ ID NO: 205030 - protein, 151 aa, Triticum aestivum
  unsure (1)..(151): unsure at all Xaa locations
  Clone ID: PAT_TA_99448.pep
XVLEXPPPNSGXAWKSPXWRKCPGLXXLNXXLLPPIVXPTSXSEILPATRXPADRNRRPAELXAWAGNAGSTAGSPPTPRTPTAQEPRRRRRRKRRAMKEFSGGFHGGDARNRGVSGRDPDWMGQGGREGGREEGEKGRNWWVLVLGEPPA

SEQ ID NO: 205031 - protein, 84 aa, Triticum aestivum
  unsure (1)..(84): unsure at all Xaa locations
  Clone ID: PAT_TA_99449.pep
RQPXDVXPFRXPVWPXLGLPVSPGVRXXLLPGLPVIXPGGVPHCYFCCIPTGTGFSTGSRGXDRAPILLIAAPNLTITTRTMPD

SEQ ID NO: 205032 - protein, 134 aa, Triticum aestivum
  unsure (1)..(134): unsure at all Xaa locations
  Clone ID: PAT_TA_99450.pep
MIALGDIYKVVEAMAPLYFALGLGYGSVRWWRFFTAEQCGAINTLVVCFSMPFFTFDFVVRADPYAMNYRVIAADAVAKLLAVLAAAVWARCAKAKAGAYSWXITGFSLGXYNNXLVVXVPLLGRQFIGGGLYF

SEQ ID NO: 205033 - protein, 89 aa, Triticum aestivum
  unsure (1)..(89): unsure at all Xaa locations
  Clone ID: PAT_TA_99451.pep
MKFIAAYLLAYLSGNASPSAEDLTSILESVGCEIDNEKMELMLSQVKGKDITELLAAGREKFAAVPSGGGGVAVSXAAPAGWVGAAAPC

SEQ ID NO: 205034 - protein, 111 aa, Triticum aestivum
  unsure (1)..(111): unsure at all Xaa locations
  Clone ID: PAT_TA_99452.pep
VFFFFFFFFFFKXXHCSIDFTDXKIXRQXKNTLLRAEAHPYIHPXYXDITXQWSXXPSWGTWXSSWATWAPWGXXRRXSXGAXTXLMLGITPXXGEGXPXXXTLPTSCFVP

SEQ ID NO: 205035 - protein, 146 aa, Triticum aestivum
  unsure (1)..(146): unsure at all Xaa locations
  Clone ID: PAT_TA_99453.pep
VLDFDLLPKSRRLAANPPSPPPPPPMRSAPPRSKPFXSLTPPAAASMGDCAVENGHAHPKEEDAPEVPVEPAEGAAEPXVVAGGQRKQKRDTXGSRPFXPXCXGXSXGPNXAPPGAASPGSATSDXXSGGSWRLPAGGRPVRRLDI

SEQ ID NO: 205036 - protein, 152 aa, Triticum aestivum
  unsure (1)..(152): unsure at all Xaa locations
  Clone ID: PAT_TA_99454.pep
ARRPSNFNVLQFSVITISLAVWMPCRAWRRHHPRRSSRPTTPTPPSRKRYTSPPCPCPSTSTLTPPQSPPRPPPRRPTPPSLLAGLSRGWELGFASNGLPRRXRNGSPGEXRCXFAVWKXGAXSGPRXXGGRGKTXKGGFRXLGPQNXNGGA

SEQ ID NO: 205037 - protein, 102 aa, Triticum aestivum
  unsure (1)..(102): unsure at all Xaa locations
  Clone ID: PAT_TA_99455.pep
VPNAXFXITVDIXPVTNXADCXSXXQXQFCXTXRXVSFLSSRNXXXHKNRKQXTTFFSLGVHEVSGXXLLPPXRVPXXAXLPXLPNSMVPXFLXXHWLXXPG

SEQ ID NO: 205038 - protein, 129 aa, Triticum aestivum
  unsure (1)..(129): unsure at all Xaa locations
  Clone ID: PAT_TA_99456.pep
FLXILXAVPAIXAQQTEAGAEXPELVLDGIPLGRELRDGAGQGRRRQSLEHHQRLAMAALCPWHHLCLHHCYRCCFSHLRNHGDKPTHTRAHSPALYCHLSGSMHLEELAANQLMMMMMLVRVGGARSG

SEQ ID NO: 205039 - protein, 97 aa, Triticum aestivum
  unsure (1)..(97): unsure at all Xaa locations
  Clone ID: PAT_TA_99457.pep
GSSLSLLPPLHIFPPKAKMSVAVCRGPAVPAFETPAWLRPAKPHKPEVVVADDRPAXVDIWNAIXAGVDNKVGAAKKPYVNPRVXTXINQKXLXLHR

SEQ ID NO: 205040 - protein, 87 aa, Triticum aestivum
  unsure (1)..(87): unsure at all Xaa locations
  Clone ID: PAT_TA_99458.pep
RSLVPRTPRRRPPAAPRSSPGPASQPAPASELSVHRQAIXPSSLEAGNGGAQAQVPARPLRPPPPAARRQHAPPPDXLPRGGAPVPN

SEQ ID NO: 205041 - protein, 118 aa, Triticum aestivum
  unsure (1)..(118): unsure at all Xaa locations
  Clone ID: PAT_TA_99459.pep
MGKIXIGINGFGRIGRLVARVALQSDDVELVAVNDPFITTEYMTYMFKYDTVHGHWKHSDIKLKDDKTLLFGXKPXNVFGVXNPEGIPXGEGXAXXTCGSXTGVLNEKXKGXXHFEGX

SEQ ID NO: 205042 - protein, 88 aa, Triticum aestivum
  unsure (1)..(88): unsure at all Xaa locations
  Clone ID: PAT_TA_99460.pep
KASPSSWESSKTIQSLTSSEVGTVSDQATCCWFLQSXYKHLIVLHTVLDRILKQREDEEETGGGEDRKKDFGGETRRRSGGGGGGDGA

SEQ ID NO: 205043 - protein, 93 aa, Triticum aestivum
  unsure (1)..(93): unsure at all Xaa locations
  Clone ID: PAT_TA_99461.pep
ASPISAGEKVTXTHTXPPHFARVPAMAXPXSPSPRGDKLLDSXXLLXGGGXXRGALRRPSLRGTARLLXXGRSXGDAGXXXASXREDXXXEXV

SEQ ID NO: 205044 - protein, 127 aa, Triticum aestivum
  Clone ID: PAT_TA_99462.pep
HLGEMRAHAPHAPRVPIRPASLSDDQLAGVDCVHIAVEAQKFGDAHCKFGLEAHDLTCVACRRTITLFQVHRRPRVCPRRGRSHQQLPGEKCQHESGGHLEHGAGRHCRRGRMLLVGALGLGRELET

SEQ ID NO: 205045 - protein, 132 aa, Triticum aestivum
  unsure (1)..(132): unsure at all Xaa locations
  Clone ID: PAT_TA_99463.pep
MAASFTTSWRCAFLALLALFVSGAYGQLXPTFYASTCPNLTXIVRDAMVTALNPAXAANAXWGASLLKLHFHDCFVEGMRTGFGPPGTTCLLMGSTPAFFGEKERLRETSTPFRGFEVIDTXXGXLEQACPG

SEQ ID NO: 205046 - protein, 98 aa, Triticum aestivum
  Clone ID: PAT_TA_99464.pep
SHFPQAQSSPLPSPLPHPLLPPPAGHSTESNPGTASPASRFDFALRRRNRASRIRSQFFQLFLPHHSIADSSAEKGSGLSKTLPASCSVITLIPEFCP

SEQ ID NO: 205047 - protein, 119 aa, Triticum aestivum
  unsure (1)..(119): unsure at all Xaa locations
  Clone ID: PAT_TA_99465.pep
RRRXAPAXXXTXRRLWXTGEEGRRGVGEGLVXPQQVLRPGRXVRPPDRRHRRLRIPSFQDQETGCSSQELAGLRGPGRGRAGDKKAGRELGRFRPAGVKGKGGGSGRMEQLWGSRREWK

SEQ ID NO: 205048 - protein, 102 aa, Triticum aestivum
  unsure (1)..(102): unsure at all Xaa locations
  Clone ID: PAT_TA_99466.pep
LLXXXWRGAXXXKPGAAXSPXXGGXXXRPGXRPRRRRMASXXIXKXAGXHGPDRAFGVLVRGWGSRGWKWRSRWVVEMEVEAXPPPXVXIYXAASCRIXHEA

SEQ ID NO: 205049 - protein, 85 aa, Triticum aestivum
  unsure (1)..(85): unsure at all Xaa locations
  Clone ID: PAT_TA_99467.pep
AXRVFFFFFFFFFFFFFFFFFFFXXKNXXXVLGGTNXLXXTFLGXHSYNQTTXKMXXIXRVFRXXFLEXQEMXAIFIXEKMLSAX

SEQ ID NO: 205050 - protein, 137 aa, Triticum aestivum
  unsure (1)..(137): unsure at all Xaa locations
  Clone ID: PAT_TA_99468.pep
IFCTXIPWEDVAFPLIVDCGAGGIGIRHPRQRRWVQGDVEAEFPDTGNLXFIMDSKVLSFXFSFPFAFPFSLSIVATIGLCSLVVTFGEKPGETRPCGEERWRRPSPSSLLLSVRLGNAASLVAVHPALRRRAEKGA

SEQ ID NO: 205051 - protein, 136 aa, Triticum aestivum
  unsure (1)..(136): unsure at all Xaa locations
  Clone ID: PAT_TA_99469.pep
AHSSQELQLPXSTIXTLDPTPRSNAGPVLLXXXVCLIPCRVGXLCLRXXXHARPXAXXGDHXRVXRVSVLREGDXHPGHVEPEQRXSPGAXRXLPKXRSPLXVVVQDCNQQHVVRXKTRNKVHRQRXRERAXGVNW

SEQ ID NO: 205052 - protein, 139 aa, Triticum aestivum
  unsure (1)..(139): unsure at all Xaa locations
  Clone ID: PAT_TA_99470.pep
AQLNPTEEEEEEEEEXEEEXXEXEDDRVMLPGRFLGQXKARSPTGAPTTPXTPMPAATTRPSTMVAPRVPSXTSPRVTTXVASRSXARVVSSTASRTSAMAVPTTHSRISTTXAQPAXSRXLTTANPHAXPSXKRSSTG

SEQ ID NO: 205053 - protein, 109 aa, Triticum aestivum
  unsure (1)..(109): unsure at all Xaa locations
  Clone ID: PAT_TA_99471.pep
MVKAVAVLTGSEGVKGTIFFTQEGDGPTTVTGSVTGLKEGLHGFHVHALGDTTNGCMSTGPHFNPAGHVHGAPKDEIRHAGDLGNVTTGADGVANINXTDCHIPFTGQN

SEQ ID NO: 205054 - protein, 63 aa, Triticum aestivum
  unsure (1)..(63): unsure at all Xaa locations
  Clone ID: PAT_TA_99472.pep
LEVGCWLVXXSHLRTTGGWQGRGLGGTTRAAHHPSGSSWARHRPCGCRPSLLAPWMMPERRFN

SEQ ID NO: 205055 - protein, 105 aa, Triticum aestivum
  unsure (1)..(105): unsure at all Xaa locations
  Clone ID: PAT_TA_99473.pep
AXSLPHSARKAPPPPPSMCRPCFPSAPRADSKPRPXPXSASXHVRRXHPRGLHPAXGXRRGGQXXGSQEAXAASXXSINAXXRPNXXLGGPAEKTRAKXRTFEGD

SEQ ID NO: 205056 - protein, 133 aa, Triticum aestivum
  unsure (1)..(133): unsure at all Xaa locations
  Clone ID: PAT_TA_99474.pep
CXQTVKFSRXGLKFNXGAEGPKGPXKAIGAIRRLCNSPDFPLGPXAFMPFXFSAXSNPXEQPRGARWDLEPVRPWTRERRLQRRRGGHPAPWRILERGRARRERLSPPVNAAAAACVEVALAGLCALRLVLCH

SEQ ID NO: 205057 - protein, 147 aa, Triticum aestivum
  unsure (1)..(147): unsure at all Xaa locations
  Clone ID: PAT_TA_99475.pep
VAIFFFFFFCLTYLLQTSSTQTPMAAALKTAAVALCVVLALSSMAPSAMGQVDCNALCTAACSCTGTCRPCIENASCIGVCNPTSTFFPVCQLCKDTGKQTCVTECVNGLHGPNXAPPLXFWXAGPPGIXFKGSPXCFRXXKLFXKX

SEQ ID NO: 205058 - protein, 114 aa, Triticum aestivum
  unsure (1)..(114): unsure at all Xaa locations
  Clone ID: PAT_TA_99476.pep
MEIAMGAIGPLLPKLAELLVGELTMEKQVRKGIVSLVTELKLMHVVLTKVSKVPADQLDEGVKXWAXNVKELSYQMEDIVDXFKGRXGNEXEFNPEGRTYSRKDFLERFPGFLK

SEQ ID NO: 205059 - protein, 101 aa, Triticum aestivum
  unsure (1)..(101): unsure at all Xaa locations
  Clone ID: PAT_TA_99477.pep
MKSTKLAAILILQAVLVMGILSHVNADYFPKCCNNCRSFSGVDVCDDAHPQCPKGCSACRVVTPXPQKTFRCAHXKNNVHXNWXGXMXXTIFKGSRSQGLP

SEQ ID NO: 205060 - protein, 70 aa, Triticum aestivum
  unsure (1)..(70): unsure at all Xaa locations
  Clone ID: PAT_TA_99478.pep
MSKQGGKAKPLKQAKVAEKDYDENDLAYLQKKKDEQKALKELKGXAGQKGALGGXGLKKKWEKMSLPNHL

SEQ ID NO: 205061 - protein, 112 aa, Triticum aestivum
  unsure (1)..(112): unsure at all Xaa locations
  Clone ID: PAT_TA_99479.pep
EKGFTHGRERRKKRXGXRSIDGGRPWRQAGEXPAGRGXNYVGVGFFLGFFLVLLTYFTXSDAXSXSPRXTLXLRTXXVYXNPTPRAVXXXIRXHQXTXFXXKYGXXHLLXXA

SEQ ID NO: 205062 - protein, 132 aa, Triticum aestivum
  unsure (1)..(132): unsure at all Xaa locations
  Clone ID: PAT_TA_99480.pep
LCSIQISCPASFFSLVFRSPQRHPPAVASDEALLVEHGEMRPDILRRGAPLRRPLGPHILLHQLAIPIRRCSQASRRPSSRPALPVRARRAPAGTCTCTNLPAPXQRRXRPAXGAMSXGSTEIFXGTXANDR

SEQ ID NO: 205063 - protein, 79 aa, Triticum aestivum
  Clone ID: PAT_TA_99481.pep
MGVFAVTKVSEGPVRPSAATPSETLPLAWVDRYPTHRGLVESVHVYRDAVPETVDAGAEGKRKPPAAVCAAPLGRRLVQ

SEQ ID NO: 205064 - protein, 154 aa, Triticum aestivum
  unsure (1)..(154): unsure at all Xaa locations
  Clone ID: PAT_TA_99482.pep
KPSRSELRPPPAARGSSGRLPAPSSSPSLPRCRRQRHPVPAGTQPVPSSASGARERRRPPLHDGERLVRPRKAEGGLAVERERTPXGPAATEQQLQQPSQYLLWEFKLTMEGRKTXKVGCFWXXKINXXSTPXNLXSLPSPXPXSPXKFXAPXX

SEQ ID NO: 205065 - protein, 102 aa, Triticum aestivum
  Clone ID: PAT_TA_99483.pep
IKSILTSLFVVAEEGTTGMEGGPEEARRPNLDDLSPTDAGQASWQVEMALPLGFMVVQGWLGNCHGADRVTGRVMVLRRCHRRPLHLGLLVVTIRRRCHRWR

SEQ ID NO: 205066 - protein, 136 aa, Triticum aestivum
  unsure (1)..(136): unsure at all Xaa locations
  Clone ID: PAT_TA_99484.pep
MFGFGHHGHHGQNPPAHAPAAAGGNQPTFKIFCKADEGYCLSVRDGNVVLAPSNPRDEHQHWFKDMRFSSQIKDEEGNPAFAIVNKATGLAVKHSLGQSQPVKARANQPGVPPXSPXLWTGXQRPSAXAFRCNSQW

SEQ ID NO: 205067 - protein, 122 aa, Triticum aestivum
  unsure (1)..(122): unsure at all Xaa locations
  Clone ID: PAT_TA_99485.pep
MPPPLXRCTELRDRLSDRFRPWSRSAQFWVRAVDIYGSYKVCQLRTGFVKDEEEREAMWEQQHXIGAQKMYSLCSELGGLFLKAAQILGKPDLAPTGWVXKLCYNCAKRVPSTPXXICQRIF

SEQ ID NO: 205068 - protein, 106 aa, Triticum aestivum
  unsure (1)..(106): unsure at all Xaa locations
  Clone ID: PAT_TA_99486.pep
MEGKEEDVRLGANRYSEHQPIGTAAQGGGADEKDYXEAPPGPFFEXAGELTSWSFYRXAGIAEFLGXLLFLXISVLNVMGVVGKPVRVQIAGTVGIKGIXWELRXE

SEQ ID NO: 205069 - protein, 109 aa, Triticum aestivum
  unsure (1)..(109): unsure at all Xaa locations
  Clone ID: PAT_TA_99487.pep
MAAKGDGPAIGIDLGTTYSCVXVWQHDRVEIIANDQGNRTTPSYVAFTDSERLIGDPPKKPRWGWNPIKQRSFECQSVSIGPLDSTGFLTGPKKIFKLVGPSKGLLGPW

SEQ ID NO: 205070 - protein, 136 aa, Triticum aestivum
  unsure (1)..(136): unsure at all Xaa locations
  Clone ID: PAT_TA_99488.pep
MANPRVFFDMTVGGAPAGRIVMELYKDAVPRAVENFRALCIGXNGVGKXXKPLHYKXXXFXRVXPDXMCQXGDFTKXNGNGXESIYGXKFPDXKFXTKHNKPGILSXGNAXANNKGSNFSSAPFPGNWFHGKQGSG

SEQ ID NO: 205071 - protein, 114 aa, Triticum aestivum
  unsure (1)..(114): unsure at all Xaa locations
  Clone ID: PAT_TA_99489.pep
MAAKEPMRVLVTGAAGQIGYALVPMIARGVMLGADQPVILHMLDIEFAAEALKGVKMELIDAAFPLLKGXVVATTDVVEALHXGVNVAVMVGGFPKERRNXKGKDCYERKNVSI

SEQ ID NO: 205072 - protein, 76 aa, Triticum aestivum
  unsure (1)..(76): unsure at all Xaa locations
  Clone ID: PAT_TA_99490.pep
MAAKEPMRVLVTGAAGQIGYALVPMIARGVMLGADQXPVILHMLDIEFAAEALKGVKMELIDAAFPTSQGKLLQTN

SEQ ID NO: 205073 - protein, 149 aa, Triticum aestivum
  unsure (1)..(149): unsure at all Xaa locations
  Clone ID: PAT_TA_99491.pep
PXXPXKPQPGGKXXXPPLAEKXXSRRXRXXSXXGEGGPGGXXGAXEAVDQAGPFRERGLERWVYRGGVGAFRGGLRRRRRRPSWRACGGERGRRXVVGGGIPRCAKXRLARKRRPKARKRSREEVSKRKDSSLEALPMATARTAGDPRP

SEQ ID NO: 205074 - protein, 148 aa, Triticum aestivum
  unsure (1)..(148): unsure at all Xaa locations
  Clone ID: PAT_TA_99492.pep
XPLXQQKRXFXLGKQXIXKSADGLTLLXHLXDXAFXXDVXMLXRGSLXXPSXXRLPGASSLVSSTSKXXRXIXNVXXXGAGTSSVFAXLLXRPMASPPRAPHPSXRPMDXGRXXCXFXXLIXEXPRRXRGWLVXVSATXXLEQXDDCL

SEQ ID NO: 205075 - protein, 62 aa, Triticum aestivum
  unsure (1)..(62): unsure at all Xaa locations
  Clone ID: PAT_TA_99493.pep
TGGPFSHPSPPSRXRXLGCXIGGGRSFVAGLAPSLACLLPLGNRPVRLLIPREGDEKFFDRA

SEQ ID NO: 205076 - protein, 135 aa, Triticum aestivum
  unsure (1)..(135): unsure at all Xaa locations
  Clone ID: PAT_TA_99494.pep
FFPXGVQXNLXGXXGKKXKXQKXXGGDFAGXXXGTPRPPHHAXXXRRSRSSKGFRAXAGFXLAXLEAKKDDLAALMAEDLRCDASNSVKXRGDSVQLPAQQSCEEDAPGEERDGTGSPGXQRWVDXMEXRLEWRA

SEQ ID NO: 205077 - protein, 78 aa, Triticum aestivum
  unsure (1)..(78): unsure at all Xaa locations
  Clone ID: PAT_TA_99495.pep
VKLEDFTXPKPPASXXXPAXGSPRXNGASSXGVLPRCGARHGALLQXCPAPPPPSTXSRRXPNLGRXSGXSXSXXSPR

SEQ ID NO: 205078 - protein, 122 aa, Triticum aestivum
  unsure (1)..(122): unsure at all Xaa locations
  Clone ID: PAT_TA_99496.pep
RPRVXCPRAKVHHRPGPRXPGARGGARXLRAPGPSFARRKDMRGEGACLFAFPAARRRXRCYPWRPSVRMPFLELCGWMDGRITGRSFHSVSTRGASEAVKGAAGNESIDPRKEGGGMNGGL

SEQ ID NO: 205079 - protein, 135 aa, Triticum aestivum
  unsure (1)..(135): unsure at all Xaa locations
  Clone ID: PAT_TA_99497.pep
MARTKQTARXSTGGNXXXKHXXTTXTGKSAPATXGVKKPHRFRPGTVALREIRKYQEXSTGLLIRKLPFQRLVREIXQDFXTDLRFQSSRRVPGLQESPRALTSRAVPKGQTSNRPKKGSPIIPKGSKAPPFPKK

SEQ ID NO: 205080 - protein, 92 aa, Triticum aestivum
  unsure (1)..(92): unsure at all Xaa locations
  Clone ID: PAT_TA_99498.pep
QLLLILGSXSVFRXHSQFGSTVPDSVSRTEEINRPRERKSSVSGSNWNVEFKDAASAAQAAADSAEMASIAARAAAQLASRGNFYADQXTGA

SEQ ID NO: 205081 - protein, 161 aa, Triticum aestivum
  unsure (1)..(161): unsure at all Xaa locations
  Clone ID: PAT_TA_99499.pep
PHSLAPAAMGRDDELASLRENPNPLLALITPSDSPLHEASRRPQSRPXALXCSALLSAPRALLPHXXLGGKKIIRRLHEPRXFGWGXAXXPLXXXGXASNNGVXGXLPQVQXAPPRTGAPGGNQKGLRKPAKXXLRXPLLQNXGXQRXRXXKGXTKNXSKX

SEQ ID NO: 205082 - protein, 51 aa, Triticum aestivum
  unsure (1)..(51): unsure at all Xaa locations
  Clone ID: PAT_TA_99500.pep
IGIDLKLFLNPTSTTKALTYYLFLPVXHQNQLFPPQKSLRKKTEEXKPFVA

SEQ ID NO: 205083 - protein, 86 aa, Triticum aestivum
  unsure (1)..(86): unsure at all Xaa locations
  Clone ID: PAT_TA_99501.pep
PLPHPPLSVRSRLLSSLPSSSSPAVPXATSSRPLPFGSPLRSPPSAAKGDTHGESSSSGIAAYRNWARAGGGAMCAVQAGGRGHIA

SEQ ID NO: 205084 - protein, 106 aa, Triticum aestivum
  unsure (1)..(106): unsure at all Xaa locations
  Clone ID: PAT_TA_99502.pep
ENKSVSTVLIKNGTVVTATDKYDADVYIVGETVHTIGRNLDVKADKVIDAKGKYLFPGGIDCHTHMELPFMGTXSSDNFETGTLGGLYGGTTSIVDFAIQTQGKVP

SEQ ID NO: 205085 - protein, 82 aa, Triticum aestivum
  unsure (1)..(82): unsure at all Xaa locations
  Clone ID: PAT_TA_99503.pep
MAAKGDGPAIGIDLGTTYSCVGVWHXDRVEXIIANDQGXRTTPXSYVGFXDSERLIXEXAPXNKXPMKPIXXVXYXKSQALI

SEQ ID NO: 205086 - protein, 132 aa, Triticum aestivum
  unsure (1)..(132): unsure at all Xaa locations
  Clone ID: PAT_TA_99504.pep
AAASSCAKAPQTLTLAPSXLPSSRSSXSHGADQGRGAGHRHRPRHHLLVRRRVAARPGRDHRQRPGQPHHALVRRLHRLGGASSGNAAKETRSPWNPIKQPFFRIAKSLSGQEVLLDCSLPRGGYRIVPVTK

SEQ ID NO: 205087 - protein, 100 aa, Triticum aestivum
  unsure (1)..(100): unsure at all Xaa locations
  Clone ID: PAT_TA_99505.pep
RTHTYLLSLRVQASLPSPLHRKSTAFPXPPPPRRRLPPAGTPVYRAAQAFLCCHEQGGDGGSQRGETGSLXKXPPPPLASGSXILFKTGSLRGNAIXWXX

SEQ ID NO: 205088 - protein, 93 aa, Triticum aestivum
  unsure (1)..(93): unsure at all Xaa locations
  Clone ID: PAT_TA_99506.pep
SLARVPTTPTPTLTPIPGPGGRLLLLGAHADLDAQKLLGDLGCELNHADAPACYCWTSTASLRLPRLAAATSDXQLIDGXQRRRATWSSHHLP

SEQ ID NO: 205089 - protein, 135 aa, Triticum aestivum
  unsure (1)..(135): unsure at all Xaa locations
  Clone ID: PAT_TA_99507.pep
VRALKAFDNTKAGVKGLVDTGITTIPSIFHHPLPLHRLHADQEHHFTIPVIDLAAAMGATTTTTAPSERXELVAAVKAAVETVGFFQGGEPWWCPKGVMSEMLAGLQGFQEEDRGGQPLLPGLPGRETKTLTCSG

SEQ ID NO: 205090 - protein, 76 aa, Triticum aestivum
  unsure (1)..(76): unsure at all Xaa locations
  Clone ID: PAT_TA_99508.pep
MRECISIHIGQAGIQVGNACWELYCLEHGIQPDGQMPGXDKTVGGGDDAFNTFFSETGAGKHVPRAVLVDXEPTVI

SEQ ID NO: 205091 - protein, 111 aa, Triticum aestivum
  unsure (1)..(111): unsure at all Xaa locations
  Clone ID: PAT_TA_99509.pep
LQLASLCHSGHFLASTTAMATADVKNPTAALXEEAPTVETPFAAXXXRKNGGGPRPGPRPRXRGLXPXSRSRKQRGXNXXPLKRRRXRXXNKXLRPXRRAEXPKKXXGQTL

SEQ ID NO: 205092 - protein, 62 aa, Triticum aestivum
  unsure (1)..(62): unsure at all Xaa locations
  Clone ID: PAT_TA_99510.pep
XAXXSSTSTSSSSSGKYVRGEGRXXCXGSQVLGVAFATLTKEISXLIXXFKSQLXVFXLWPS

SEQ ID NO: 205093 - protein, 112 aa, Triticum aestivum
  unsure (1)..(112): unsure at all Xaa locations
  Clone ID: PAT_TA_99511.pep
RAKNINPLRWEVRLDNNRTMSKGQRFKGQGRGIPPWTKQAVSSFAGKASLEGWAETLRLTNKQSKKGSPTLQPLSWRPGVGGQCKIFRGRTLXRGKNNQLXEGGGXFRKTIR

SEQ ID NO: 205094 - protein, 81 aa, Triticum aestivum
  unsure (1)..(81): unsure at all Xaa locations
  Clone ID: PAT_TA_99512.pep
CAPDPSSRAAAPGRTGALQSSLPAANRPASPLLPTPLWRRRISSVGDLDXGXGARFRPNREIMLAKGGAXQLRLRRCLXXR

SEQ ID NO: 205095 - protein, 76 aa, Triticum aestivum
  unsure (1)..(76): unsure at all Xaa locations
  Clone ID: PAT_TA_99513.pep
IFGVGGIFTXTXLEGPAGXLLSSGXPGEXAQERAXPAAAVXTAXWRRRGRTGGGGFDLDEEXQGNEWRLLSTETLD

SEQ ID NO: 205096 - protein, 149 aa, Triticum aestivum
  unsure (1)..(149): unsure at all Xaa locations
  Clone ID: PAT_TA_99514.pep
XLPYLXLXIXXVGXLWXGNXXXRPXXIFASEEEGXSPXGVXKXGSQGVGWLILGGSPVRRPVCPARRKTRPERSLAPALGREGLAAACSVPWQISTGTMWIEGGKGPAVDELHLEELLLGHERGDVRLRPEEVVGHGNGGGGWIGWRWI

SEQ ID NO: 205097 - protein, 142 aa, Triticum aestivum
  unsure (1)..(142): unsure at all Xaa locations
  Clone ID: PAT_TA_99515.pep
MPIQQLAPKSPGRNPISSDAGPIPLAMSLPQRGWYSPPALVDDAMREIFKRVPPDDPRSLVRAAAVCTSWHGILSDADFAREYRAFHXSARPLLGFLHNTPPKRSPWGKGGKSRQLQGKGVVGLQTSVSNSRSFPATPGRPR

SEQ ID NO: 205098 - protein, 132 aa, Triticum aestivum
  unsure (1)..(132): unsure at all Xaa locations
  Clone ID: PAT_TA_99516.pep
QQSKPTPFPTQTTPSPTPSMPFHTLAAVPVVLLWLGAVLAARFPLFGATSPQPSSQCQRKCXNVDIPYPFGIVNSPRRRTRXLRHERLQPDLQRKAGIDDGWVRHKANFYERTLGGSSGVSPATKVKGPGIA

SEQ ID NO: 205099 - protein, 103 aa, Triticum aestivum
  unsure (1)..(103): unsure at all Xaa locations
  Clone ID: PAT_TA_99517.pep
MATAASASASPAALRAKTPAPGAHPKPEIQASHSRGLPPAPPRPPPPLPPAGSTPSSTSXGSAXSXTPKXTXLQVLAPEVKAAGRGQNGXGGRRGPKKSNPGF

SEQ ID NO: 205100 - protein, 125 aa, Triticum aestivum
  unsure (1)..(125): unsure at all Xaa locations
  Clone ID: PAT_TA_99518.pep
XIXEPPGEVXTSVGEGIPGIDTRRFAREVVGGLRVLKERLSFPDXRPXIGXGHFGVLLDTKXEEAPXFGIXIXVLTXPPRRSRASKTXNVRGCPWQCRWQPRRHGHRRGTGPPPPSKQGGRRXGG

SEQ ID NO: 205101 - protein, 88 aa, Triticum aestivum
  unsure (1)..(88): unsure at all Xaa locations
  Clone ID: PAT_TA_99519.pep
PGKPXRFRRRSPXILSPXTPCLEXXNFXSXLXLPGSXRIPLEQXSPPXGPASXSRTARSPAASGGAAAPIGXRLLXSGGEGRGEGAET

SEQ ID NO: 205102 - protein, 111 aa, Triticum aestivum
  unsure (1)..(111): unsure at all Xaa locations
  Clone ID: PAT_TA_99520.pep
SSHHNHDSFLEDRSFVKHGSRILITTRDQSVAAGMNRSYIHNMQEWPFQDFWTLLCASAGLDKEHDQENLREIVITIIQRCNKVPLAIKIIGGVLATKDPTXXEWQQVNEK

SEQ ID NO: 205103 - protein, 110 aa, Triticum aestivum
  unsure (1)..(110): unsure at all Xaa locations
  Clone ID: PAT_TA_99521.pep
MEGKEEDVRLGANRYSEHQPIGTXAQGGGADEKDYKEPPPAPFFXEXGELXSWSFYRAGXPEFLANFLFLXISXLNVXGVXVGKPSGSXKCXTVGIQGIXWELSAGIFFL

SEQ ID NO: 205104 - protein, 54 aa, Triticum aestivum
  unsure (1)..(54): unsure at all Xaa locations
  Clone ID: PAT_TA_99522.pep
LHXFPANGAALALEACFVFIDGDVNTEDSYHLQAPGSYGLRTEDVGGGIESHLT

SEQ ID NO: 205105 - protein, 163 aa, Triticum aestivum
  unsure (1)..(163): unsure at all Xaa locations
  Clone ID: PAT_TA_99523.pep
FPRPPPKGVTIALGTAXXXSARXLAAGGRRGCPSGXGTDIPXEPAXXTXLXRNNLEDVITPXDLXRKTFNRIRLELXXFAMAYNVVAIPLAXGXLFPLTGLQMPPWLAGACMAFSSVSVVCSSLLLRRYRKPRLTTLLQITCRVERWIAFVNTVTVSPPSPFL

SEQ ID NO: 205106 - protein, 98 aa, Triticum aestivum
  unsure (1)..(98): unsure at all Xaa locations
  Clone ID: PAT_TA_99524.pep
DPAATSRSNHCPIXPEXIPTRIPSAPRPGSDRPTDRAARPPGEHGERGXDGXGRRXRXAADHLRDXXRGVXRXAPLXXAQXRDPTXGPPRXXLMXQDS

SEQ ID NO: 205107 - protein, 144 aa, Triticum aestivum
  unsure (1)..(144): unsure at all Xaa locations
  Clone ID: PAT_TA_99525.pep
GDRGAASLVCRSWHRAESATRASVAVRNILAASPARAARRFPNAHHILLKGRPRFADFNLLPPGWAASAFRPWAAALAAAAFPALRSLSLKRIXTVNDEELELLGRFXPASFREALPPPLRTGFSSGGXPSSAPNCXRAAFALD

SEQ ID NO: 205108 - protein, 68 aa, Triticum aestivum
  unsure (1)..(68): unsure at all Xaa locations
  Clone ID: PAT_TA_99526.pep
XSTSXKXRIAXHTHIKGLGXEANGTGIRMSXGFLGQGXAKKAXGLVSTLFGKXKFAGRALLPXGPTGK

SEQ ID NO: 205109 - protein, 51 aa, Triticum aestivum
  unsure (1)..(51): unsure at all Xaa locations
  Clone ID: PAT_TA_99527.pep
PGXPXKGGCXTSRRSGRPXARERVGFACGAXEGRRGAQXXXEXGGRRKEGX

SEQ ID NO: 205110 - protein, 126 aa, Triticum aestivum
  unsure (1)..(126): unsure at all Xaa locations
  Clone ID: PAT_TA_99528.pep
XCPPXPGXGXPWKWLXLPPXXVFAXKLGFARXVXFXVPXXFWERHGFXQSXQTSLRTPSXGLRRSWXGXWPRRCALRLXQRXSFXRRSXXTAGTXXPLXLXTGSLPIERIWGRKXKAASFXRGGLG

SEQ ID NO: 205111 - protein, 118 aa, Triticum aestivum
  unsure (1)..(118): unsure at all Xaa locations
  Clone ID: PAT_TA_99529.pep
MASPLPAFVVRRATPVLVVPSAPTPQEAKPLSDIDDAAVMRFYSAGVHLYRGDVSKEGYDPAXVIXEALAKXLVPXYPLXXRPREEAGRKLXXECXSXXXPFXQAXXELXGGEFREIG

SEQ ID NO: 205112 - protein, 118 aa, Triticum aestivum
  unsure (1)..(118): unsure at all Xaa locations
  Clone ID: PAT_TA_99530.pep
RAARGSQARGQXEGHEHPSARYACKTFICTTSEAKCKGSXPXAKHPERANSVQVLPPPQSPLISGKIXTGEEEIKXXKXXSCPVXQPPIIXFPQXXXVXSPQXLGXKTXGXXXVPNXF

SEQ ID NO: 205113 - protein, 143 aa, Triticum aestivum
  unsure (1)..(143): unsure at all Xaa locations
  Clone ID: PAT_TA_99531.pep
PDXKTLSSRPLPRGCGAGAPGLDPRALLPPAPTRQRRPRPGDWIPSWASTRFWGHEPKITPQAGXKILTGVWXFYWXQXNGVFPNAKXITXAQXDXVKXNXSWEIGXXPELQLKSRLGRGALPLKFNGXFKAPLXXQAGXNLK

SEQ ID NO: 205114 - protein, 87 aa, Triticum aestivum
  Clone ID: PAT_TA_99532.pep
MALPAPRWLRREVLVGLALGQFVSLLITSTGFSSSELARRGTYARPAAGAPPFNPLSPRNAILPGPMKFWELGNNYEPGLIREIASC

SEQ ID NO: 205115 - protein, 153 aa, Triticum aestivum
  unsure (1)..(153): unsure at all Xaa locations
  Clone ID: PAT_TA_99533.pep
ALLPSPNSKSKATFTLSSMPPLYAFSLGLLLLLHIPHWCPSSAAASDTLTAGQSLAVGKQSSSQETASSRSASFKPSSRHNQVSPWTPPSSKLVPWHMVQQRFQVFTAVWGCLIGAQAQSTGPQTSNLTTAQRISRRWQSLSIAKQTXSGXFG

SEQ ID NO: 205116 - protein, 84 aa, Triticum aestivum
  Clone ID: PAT_TA_99534.pep
AGIQSIDVKSESIELNATESNVSPSDVASHISDSSPRYTFYRYPGSRVVIFIYTCPSESSIKEKMLYASTRRVAIQLGEEGIQI

SEQ ID NO: 205117 - protein, 163 aa, Triticum aestivum
  unsure (1)..(163): unsure at all Xaa locations
  Clone ID: PAT_TA_99535.pep
HVMAMNAYWYIYMRTRGSDLSKLIGEEPMKRRYKTSAEEAAWEYQGRGVEPAGPAPWRWRRQGVAGRRGTGEGGGVRQRAGGXGEETXGGVQDXGRGPXGANXRPRDQRXXPRXRXVSXKXRGXPGXKFTXRGYSPXQQGXXFLQPXWGKPXPFPXLXXPXGX

SEQ ID NO: 205118 - protein, 144 aa, Triticum aestivum
  unsure (1)..(144): unsure at all Xaa locations
  Clone ID: PAT_TA_99536.pep
XIXSPQIKEXFXKTXPPGXPDLLNSXXKFFFKRXPLDSNRGFXXPGREGGXWTATATGXLRANXLXWGSFPGANATXQXPTNERTPKKGGKGQAAAINGARGGAGSATARRGEANPAMAXSGPDPGAGGXHGWDLGRREGRGAX

SEQ ID NO: 205119 - protein, 83 aa, Triticum aestivum
  unsure (1)..(83): unsure at all Xaa locations
  Clone ID: PAT_TA_99537.pep
MEHKETGCXSREGPILCVNNCGFFXXAXTKNMXSXKXHKEMAXKQEQGKAGPPPLSTSIVNGGDAAKKLANKGVGISHLKNPF

SEQ ID NO: 205120 - protein, 126 aa, Triticum aestivum
  Clone ID: PAT_TA_99538.pep
MFKRSVTFEKRDDTDFASQAAMWGGLHEFGDMAWLPRQGKVIYRKDDRVPVSTKGNGLNDYLGFRSNPTLALITARATGGAPWRRGRHRQGAAGRPSVAVPLGLAFQRVFFQGVVGGSNPPSPGTQ

SEQ ID NO: 205121 - protein, 76 aa, Triticum aestivum
  unsure (1)..(76): unsure at all Xaa locations
  Clone ID: PAT_TA_99539.pep
AWQWLWIWVRMRFVVMXERXDQXVXLAVVXDXGIVCGSYRGSLVIRLRLPAARPNAGRSISSSGXTRREDAEGRFL

SEQ ID NO: 205122 - protein, 81 aa, Triticum aestivum
  unsure (1)..(81): unsure at all Xaa locations
  Clone ID: PAT_TA_99540.pep
GIQQRNGRKSLTTVQGLKKEFSYSKILKDLKKEFCCNGTVVQDTELGQVIQLQGDQRKNVSNFLVQXAGIVKKEHIKIHGF

SEQ ID NO: 205123 - protein, 57 aa, Triticum aestivum
  unsure (1)..(57): unsure at all Xaa locations
  Clone ID: PAT_TA_99541.pep
SSXSTGRRWCCCSPLPLPCSTPRLMTMMLLLLPLTAVCPLNMWHLTSGLPDRTNLRR

SEQ ID NO: 205124 - protein, 152 aa, Triticum aestivum
  unsure (1)..(152): unsure at all Xaa locations
  Clone ID: PAT_TA_99542.pep
RSTHTLTHPSSPMARTKQTARKSTGGKAPRKQLATKAARKSAPATGGVKKPHRFRPGTVALREIRKYQKSTELLIRKLPFQRLVREIAQDFKTDLRFQSSAVSALQEAAXAYLVGLFEDXTNLCAIQAKARHHQCPKGHPSSHARIRRGTRP

SEQ ID NO: 205125 - protein, 136 aa, Triticum aestivum
  unsure (1)..(136): unsure at all Xaa locations
  Clone ID: PAT_TA_99543.pep
MAASALPTLCTAIAPKSFVSSLPRPTPINLLRSKIVCSSVRSVKATPMEVEEEAAAGGGGGTKLSAWTSVPQQRWEGDLVVDGQLPLWLNGTYVRNGAGLWEAGDLAFDHLFDGYATLXVRVSFRQGRATXAHRAN

SEQ ID NO: 205126 - protein, 65 aa, Triticum aestivum
  unsure (1)..(65): unsure at all Xaa locations
  Clone ID: PAT_TA_99544.pep
ATRSPDQTSPRRHAVTERVGRTEVAGRKMKAKSGAAAGERRPVXSXTILLLCACXFDPRHXLHXP

SEQ ID NO: 205127 - protein, 90 aa, Triticum aestivum
  unsure (1)..(90): unsure at all Xaa locations
  Clone ID: PAT_TA_99545.pep
MSCNCGSGCSCGSXCKCGKMXPDXAKQGNAAAQVPPXXXLXGXVPEKKGGNXKVXAAGQSGRRGGTGELANCKPLQMFKLQCNSYVLPVD

SEQ ID NO: 205128 - protein, 138 aa, Triticum aestivum
  unsure (1)..(138): unsure at all Xaa locations
  Clone ID: PAT_TA_99546.pep
LPXLLPXESTRKIARXNFSGGFGFPSSLXIXPLLGGCPKFCSXLNIIYSAKTXEHEGDRXKDVVRGAKVAVPANRGRGQSPRCCRRRAAPGAQETXSGAVXAPPQNAGALDVQIANFPAXARRTGRDAQXKGGVSXAA

SEQ ID NO: 205129 - protein, 105 aa, Triticum aestivum
  unsure (1)..(105): unsure at all Xaa locations
  Clone ID: PAT_TA_99547.pep
MQIFVKTLTGKTITLEVESSDTIDNVKAKIQDKEGIPPDQXKRLIFAGKQLEDGRTLADYNIQKESXLHLVLRLRGGMXXFVKNLNGKEHHSFRVGEVPTTIRKS

SEQ ID NO: 205130 - protein, 149 aa, Triticum aestivum
  unsure (1)..(149): unsure at all Xaa locations
  Clone ID: PAT_TA_99548.pep
XNXSPQIKEPHLGENPVLPGEPGPLNXLGEXFXLXDAPLRQQTGGFPLPGREGDFDSNGDRRFQGKFLCSRAASPAQNATNQEPNERTHRQERGERTGRRNQRGARRGRERDGAEGGGGSSNGGLRARSGGRRRPWMGSREEGGEGSGA

SEQ ID NO: 205131 - protein, 62 aa, Triticum aestivum
  unsure (1)..(62): unsure at all Xaa locations
  Clone ID: PAT_TA_99549.pep
MSSVFSXDDTAXFFXFLGAAXALVFSCMXAVYGTAKIGVXVVFMGVMXRSQLXMXSILASSW

SEQ ID NO: 205132 - protein, 140 aa, Triticum aestivum
  unsure (1)..(140): unsure at all Xaa locations
  Clone ID: PAT_TA_99550.pep
FQGXXGGKHPXXVCYKXXSPPSXXXQPKKXEIFPLPILLHQNHFNNPPAHLNXRHGXWASHQPDWIGSXMEKQKKRSGRTQMQRRGGRELIVSQPRSHHGGGGGALEDGGGIGRRRGSRXAAEQIRSRGHAVPPLLGLLL

SEQ ID NO: 205133 - protein, 122 aa, Triticum aestivum
  unsure (1)..(122): unsure at all Xaa locations
  Clone ID: PAT_TA_99551.pep
PLRSFQPPPQGXEEGVHHGSCXTVRPQRYLCGAGEVGIELEADGARAAIYIAWAGAWAGGAGARRRGRTGEGGRSGRGGRELGTRRHDRGGGVECNDGCLQEGEKGDDEVGVRQRHGCPARF

SEQ ID NO: 205134 - protein, 127 aa, Triticum aestivum
  unsure (1)..(127): unsure at all Xaa locations
  Clone ID: PAT_TA_99552.pep
KPXRATGARDERGRRREEEVWRYRWPXDPRKRETTQGLGGRSXPXRXXGASAESPQGVARRGRSRPAAGAAPPAPIRTRQALEYDQRRXPXAXRRSXRGVFGAGRXGVWCLRCFFAXXNWHXQLCFP

SEQ ID NO: 205135 - protein, 123 aa, Triticum aestivum
  unsure (1)..(123): unsure at all Xaa locations
  Clone ID: PAT_TA_99553.pep
MARGLKKHLKRLNAPSHWMLDKLGXAFAPKPSSGPHKARECLPLILILXNRXTYALTYREVXSILXQRHIMVDGKVRTDKXTYPAGFMDIXIPFPRXGENYRLLYXTXGRFRLQSCQGRILSS

SEQ ID NO: 205136 - protein, 91 aa, Triticum aestivum
  unsure (1)..(91): unsure at all Xaa locations
  Clone ID: PAT_TA_99554.pep
RLAKGLPVXTTQXRSCLIPVXSATXXGXHVHPRRTPNCKRDHXNVRLAPXHQRLPLAAAASLLHRHCWLARYVKCCRGVELSGVEEWCGVC

SEQ ID NO: 205137 - protein, 82 aa, Triticum aestivum
  unsure (1)..(82): unsure at all Xaa locations
  Clone ID: PAT_TA_99555.pep
MDFPHRHXHGHGRRDDDDEDRRAPAPYGRHEPDAYGAPPPSYGRRPDDDAGDAYGRHPPAAYGAPPPAYGAPPPRLRGRPRG

SEQ ID NO: 205138 - protein, 123 aa, Triticum aestivum
  unsure (1)..(123): unsure at all Xaa locations
  Clone ID: PAT_TA_99556.pep
LQWPVEEIXSLREMXSTIKGLELNKGDLFEIKGIDTLQADVEIDFELTSIDDAGPFDPSWXLXAXKXCREADASVHGGIGPFGLVILASDNMEEHTDVHXRVYKSXXNYMILKCTXPKXXXPL

SEQ ID NO: 205139 - protein, 86 aa, Triticum aestivum
  unsure (1)..(86): unsure at all Xaa locations
  Clone ID: PAT_TA_99557.pep
MMXIFVKTLTXKTITLEVXSSXTIDNXXANIQDKVGHSSGXXRLIFXWESWRWSHPPLTTSSLHCPSLGRQFVSTPTPIRWGLDNM

SEQ ID NO: 205140 - protein, 107 aa, Triticum aestivum
  unsure (1)..(107): unsure at all Xaa locations
  Clone ID: PAT_TA_99558.pep
GEEHXRGIXAXXXVTHGXRTRTRHARVLGAVRCXRRAGGAPNSSKQLXPATASLPPTASSPPPPPTGPQRGARRASPYRRDAALPHPLRRTRAPPAAAPIAGRTHRC

SEQ ID NO: 205141 - protein, 89 aa, Triticum aestivum
  unsure (1)..(89): unsure at all Xaa locations
  Clone ID: PAT_TA_99559.pep
MPTRGLQMLLGDASPWSIAGAVAAVALLWLAAWILEWAWWTPRRLGRALRAQGLRGTRYRLFTGDXPENARLNRXARXKPMPXRTTLRP

SEQ ID NO: 205142 - protein, 146 aa, Triticum aestivum
  unsure (1)..(146): unsure at all Xaa locations
  Clone ID: PAT_TA_99560.pep
AVRRALTTHLRLRPWTISAALSVSFLPPAXRRAVSTATSSSPRVXRAARFXCCXXPPSPEQXETPAPLPSPPGXPSSLWGVSTMRLXQAGXXPXLGLLXXGYLXXLKXQPAPRAFXPXXRGNXCXDVXXXQXXYSVXLXGIXSLQF

SEQ ID NO: 205143 - protein, 101 aa, Triticum aestivum
  unsure (1)..(101): unsure at all Xaa locations
  Clone ID: PAT_TA_99561.pep
MSCCGGNCGXGSACKCGNGCGGCNMYPEAEAAGATLLVSATATHKAXSSGGMXMAAXNGGCGLHPSAXCGDQAAXCSCCXLPIIGHGAINNLLVRPSSVPG

SEQ ID NO: 205144 - protein, 89 aa, Triticum aestivum
  unsure (1)..(89): unsure at all Xaa locations
  Clone ID: PAT_TA_99562.pep
AAATYPKSLRHRRRRRHRCRRHAPPPELHRLXXPLLXGGLXXLXXPXXPLRRXGGPFSPRQXXLPXEGIXRXXPGGXXXEAQGASXGLP

SEQ ID NO: 205145 - protein, 113 aa, Triticum aestivum
  unsure (1)..(113): unsure at all Xaa locations
  Clone ID: PAT_TA_99563.pep
XGXRSPDXPRXMXPDAXWKXEASAYRXQXHPGAPWWXLWXTFXAITPKRVMAXERDRRCXRVPRLXRLDRHIXQGVLQLAVLLRVSGEDLQLQVASSCWRKKVRASLNRAVRI

SEQ ID NO: 205146 - protein, 105 aa, Triticum aestivum
  unsure (1)..(105): unsure at all Xaa locations
  Clone ID: PAT_TA_99564.pep
VALLGKKRAPAASHSREQLNLKLISTRRVGTHHSVHHITSSLQAHLPHPPHXHPXPQPPHGDIWFXPSIXIXRLRSHYASTXXPRFISRGSLSRAEXXGIISMXY

SEQ ID NO: 205147 - protein, 156 aa, Triticum aestivum
  unsure (1)..(156): unsure at all Xaa locations
  Clone ID: PAT_TA_99565.pep
RTHTQHTHAHTPTICPSNGDGGGSGERGDGGPQTRPGEAGHADGRRVQAPRDGARRGDXIPRRRALRHGRGSAGHCGGXXPPIPKDNXWXXXARELSYQYGKTPXMTSMXDXXXPRIXNRAXGLPXGKXXKVXRGKLKALLXXGIGXQGTGXXXGV

SEQ ID NO: 205148 - protein, 83 aa, Triticum aestivum
  Clone ID: PAT_TA_99566.pep
FYRLRPPQPFRRTGGSRRSSVWSPRGRPSVSAPSRRARGEEGALPLLFLVEGGRKATTERQPIVLADRSMCAHAHPPLARSER

SEQ ID NO: 205149 - protein, 137 aa, Triticum aestivum
  unsure (1)..(137): unsure at all Xaa locations
  Clone ID: PAT_TA_99567.pep
XGGSDPXTFXAAEETPLPRXAGXSXHXCKGXVGXSPGEAPPTLPVPCTTPXEPVLSSXHDGARGPRRSCRPAAGSLTRGXADVQCPHPPPYHAEALARASAWIDASGAAGRQALDNESGARPWVVCALWGVPGAGGG

SEQ ID NO: 205150 - protein, 90 aa, Triticum aestivum
  unsure (1)..(90): unsure at all Xaa locations
  Clone ID: PAT_TA_99568.pep
IYRGACPNGTWLSSLLEPPRLLPVLLLLKLQXQSWLAEPGXPNFPRGGPGSXQSXPVXLRXNXGGKXXGFGXEXLXGSXPXGPXGSTPFF

SEQ ID NO: 205151 - protein, 94 aa, Triticum aestivum
  unsure (1)..(94): unsure at all Xaa locations
  Clone ID: PAT_TA_99569.pep
XGESQPQQPXPKITGDAGPGTACLHSLGPHPTSLAAFXIQATGKSEKRLQVSGIACLGSGSGYHVCGAESRRASRGSSSSSLPSLARGGGETRK

SEQ ID NO: 205152 - protein, 138 aa, Triticum aestivum
  unsure (1)..(138): unsure at all Xaa locations
  Clone ID: PAT_TA_99570.pep
GLTHCRSSRQISCVHSESGMGNLISAGAAAGASGGKVVMADGSVRALSEPVSVAELMMDHPRHFVVDARLLQQRKGAAAGGASKVAPLPADHVLGAGGVYVLLPAXRGKVSRGGAPCSAFAVRWRRSKGQPGSAEGKL

SEQ ID NO: 205153 - protein, 141 aa, Triticum aestivum
  unsure (1)..(141): unsure at all Xaa locations
  Clone ID: PAT_TA_99571.pep
LATHICHSWRAQGRRGQHGAAAAARPSPRRRARAPFVARSATPRRAWSAGRKHNGGLHQAVGFIKGLLFGSPSQAAAAAARVLRVDACRGPVPPXXQANRAPAGKEAGAPPSAIKXQXQQSTSFKGTVNRRQLDGLXCXRX

SEQ ID NO: 205154 - protein, 136 aa, Triticum aestivum
  unsure (1)..(136): unsure at all Xaa locations
  Clone ID: PAT_TA_99572.pep
AFPAPLAASASASAGKRHSTTPRPPHPPASQPALTKTXPVPATASXSSPPTPLPRSPSARRLPSAAPAPASPCWLTLSSPVDSGVRPGAVAGGLPHQKINILNSTHSWQGFGFHPKGTTELRFSLSEKKYSVKIEI

SEQ ID NO: 205155 - protein, 58 aa, Triticum aestivum
  unsure (1)..(58): unsure at all Xaa locations
  Clone ID: PAT_TA_99573.pep
PRPVEEAVMSEXGGSXPIGXSPSSLLXPRSENPERPAGRPIRGHRWMTGAGSLPLVGR

SEQ ID NO: 205156 - protein, 118 aa, Triticum aestivum
  unsure (1)..(118): unsure at all Xaa locations
  Clone ID: PAT_TA_99574.pep
RRRRPRWRRPSPPRRPRRRRRSPRRRRPRSRRLSPSRLRRPRRRRRQPLRRRRPRSPSQQLPPSRRPRRPKSQRRQPSSRXKPKEXRWLEAKPGPPKKRKGALAPSQKGARAVPRREP

SEQ ID NO: 205157 - protein, 138 aa, Triticum aestivum
  unsure (1)..(138): unsure at all Xaa locations
  Clone ID: PAT_TA_99575.pep
MARRSGGGRSSRPAPRAAPVRNPPAPARPAPPPATTQSSGGGIMSGIGSTIAQGMAFGTGSAMAHRAVDAVMGPRTIQHETVVGEAAASMTPMDNAADDKCGNPSKXFQDCINQLRXGDIXQSCQFLTLTCLKRARWR

SEQ ID NO: 205158 - protein, 92 aa, Triticum aestivum
  unsure (1)..(92): unsure at all Xaa locations
  Clone ID: PAT_TA_99576.pep
GSIPHPNAAAHITRSSLPXNSHARAAAASKPGPLLPXSPLVKPIHTQWVTAPRATAAPPPTSRXRXLRRRSSPNXXRRXSPXRXRPRPRSSG

SEQ ID NO: 205159 - protein, 74 aa, Triticum aestivum
  unsure (1)..(74): unsure at all Xaa locations
  Clone ID: PAT_TA_99577.pep
KKASKSPPVRSGHRRGSGSRRRPXPPXPSXVXGXEAFLXKFRASVFXASXRXXAXSXAXTPSTAFICNPSXHIG

SEQ ID NO: 205160 - protein, 119 aa, Triticum aestivum
  unsure (1)..(119): unsure at all Xaa locations
  Clone ID: PAT_TA_99578.pep
AASAPERTKLNWCHHELNQWSISTLQPPGIIRGTSRTRCTSAFLCWSPVPSQDEERRSRSLPPSPPHLCYPWQMVCSKLLEAAWLRKMKHNDALRAHHYXTQGQESPWXMQXVPRKGLG

SEQ ID NO: 205161 - protein, 86 aa, Triticum aestivum
  unsure (1)..(86): unsure at all Xaa locations
  Clone ID: PAT_TA_99579.pep
YTNPHRLMLPARTPSPFDAIANRVASYSIVLCSSFXXQSSLSRKSLFFXQFLGFYVQRPCSATQLEARWXNVNRTKGFVLXTPPXX

SEQ ID NO: 205162 - protein, 128 aa, Triticum aestivum
  unsure (1)..(128): unsure at all Xaa locations
  Clone ID: PAT_TA_99580.pep
MAPKAEKKPAAEKKPVETEKKPKAEKRVPGKDGGADKKKKKAKKSVETYKIYIFKVLKQVHPDIGISSKAMSIMNSFINDIFEKAPPAKSXKLARXNKEANINSRGDSXRRWRLVLPGARQSAFSGQR

SEQ ID NO: 205163 - protein, 122 aa, Triticum aestivum
  unsure (1)..(122): unsure at all Xaa locations
  Clone ID: PAT_TA_99581.pep
MLGVFSGEVVEVPAELVAAGSRTPSPKTRASELVKRFLAGAEPAVSVELGSLGNLAYSQANQSLLLPRSFRLQKDRXSGCXXGXPWTNLXGXXQQXGSPKGXNXXLXLXEGXKKXLREKGPT

SEQ ID NO: 205164 - protein, 136 aa, Triticum aestivum
  unsure (1)..(136): unsure at all Xaa locations
  Clone ID: PAT_TA_99582.pep
MQIFVKTLTGKTITLEVESSDTIDNVKAKIQDKEGIPPDQQRLIFAGKQLEDGRTLADYNIQKESTLHLVLRLRGGXMXIFVKXLTGKTITPEVDXSDTIDNVKXKIQDKEGIPPGXTXXLSXQGKXLGGIXRTXA

SEQ ID NO: 205165 - protein, 78 aa, Triticum aestivum
  unsure (1)..(78): unsure at all Xaa locations
  Clone ID: PAT_TA_99583.pep
MGGGNAQKSKMARERNLEKLKGGKGSQLEANKKAMNIQCKICMQXTFICTTSEAKCKEHAEAKHPKSDLXQWFPXLKP

SEQ ID NO: 205166 - protein, 89 aa, Triticum aestivum
  unsure (1)..(89): unsure at all Xaa locations
  Clone ID: PAT_TA_99584.pep
MAXTEYRCFVGXLAWATDXHXFQXAFIQYXXILDXKXINXPPRLAXPVGFXFVTFGXXGVDSPPHRLTKRFVGNITVKYGKSRPGFGGV

SEQ ID NO: 205167 - protein, 132 aa, Triticum aestivum
  unsure (1)..(132): unsure at all Xaa locations
  Clone ID: PAT_TA_99585.pep
CKKXXARXKLXRNFWXILEDCIXGLAVLXARKRLQPFLHYLKLXQNWLAGDLNPHQHHLHGRRRVTSPLQMDDLRLLPCAAPPWPYYPLHRRSRDKPATVGGHXMXDPANRAVGVATNEDEQAQGTELVQQA

SEQ ID NO: 205168 - protein, 108 aa, Triticum aestivum
  unsure (1)..(108): unsure at all Xaa locations
  Clone ID: PAT_TA_99586.pep
RRRRPRWRRPSPPRRPRRRRRSPRRRRPRSRRLSPSRLRRPRRRRRQPAETEETKEPRAXXCRRAGGRGAQKNQRRPSEGKNKGGPAGNSLQLKEGGPLAAKPPPSPG

SEQ ID NO: 205169 - protein, 100 aa, Triticum aestivum
  unsure (1)..(100): unsure at all Xaa locations
  Clone ID: PAT_TA_99587.pep
MDVFIHEDYVNKRNMVKREQRKKTQLQVLQLGSPGACRPPPAHREDSLGAGAPRQCLTPXXGVLPSSAVGSPRVRLVGGKPSHRIXRRHLFDCLKPLLCR

SEQ ID NO: 205170 - protein, 115 aa, Triticum aestivum
  Clone ID: PAT_TA_99588.pep
LNHPAGPAPPRQAEQVPPPPPRPYLRRLQWPTASTPPPKPTPPPPMANGAGGPTAPKPQMYQAPHLPAARASEEARAVLPVATFAGWLAGELGNPRQVAAGRGGPFLLLPALKGP

SEQ ID NO: 205171 - protein, 97 aa, Triticum aestivum
  Clone ID: PAT_TA_99589.pep
MEGGEGSGGGGEPTKYRGVRRRPWGKFAAEIRDSSRHGVRMWLGTFDTAEEAAAAYDRSAYSMRGRRRCSTSPDRGALQRPMPRPPGFFFPGRVHVS

SEQ ID NO: 205172 - protein, 118 aa, Triticum aestivum
  Clone ID: PAT_TA_99590.pep
MAEFALGLTKTAVEGTVSLVKSAIEEEADLKEKMQNDLVFITGEFEVMQSFLQIANKERTKNEVMRTWVRQLRNLAFDVEDCVELVVHLDYKSPWWACLPRVWHTVRCNALPLTRRGR

SEQ ID NO: 205173 - protein, 113 aa, Triticum aestivum
  unsure (1)..(113): unsure at all Xaa locations
  Clone ID: PAT_TA_99591.pep
MASSGLLLFLGCLASALLAGATKVHHHEFIVQETPVKRLCEEHNIITVNGQFPGPTLEVREGDTLVVNVVNXAQYNVTIHWHGIRXQFKTGWADGPEFVTSAPIKAPXXSYXY

SEQ ID NO: 205174 - protein, 141 aa, Triticum aestivum
  unsure (1)..(141): unsure at all Xaa locations
  Clone ID: PAT_TA_99592.pep
MASFASHPRPAMAQPAAPAPPTSSLERATATESSPEDALSEDSLKSFISSLPSREGWPQPLTQYKGYWFKPGILDGVLHARWTFAPRADDVVLATQPKCGTTWLKXLAFAVATRSRPHRRAPPEQPAPSPANPQEPRAVQS

SEQ ID NO: 205175 - protein, 76 aa, Triticum aestivum
  unsure (1)..(76): unsure at all Xaa locations
  Clone ID: PAT_TA_99593.pep
QSPVPGSWRRGEXMGSFXXLAXXCVETEXPVMVXIQKLLRWXHXCDVACXGNCLLRNLLSAALNKVNEIXWEPXIH

SEQ ID NO: 205176 - protein, 55 aa, Triticum aestivum
  unsure (1)..(55): unsure at all Xaa locations
  Clone ID: PAT_TA_99594.pep
PASPLPPPPLAAGVPRPGPEPPVPPPPXPPPPLLRAHXPRPPPRRRDXXPGPRLL

SEQ ID NO: 205177 - protein, 135 aa, Triticum aestivum
  unsure (1)..(135): unsure at all Xaa locations
  Clone ID: PAT_TA_99595.pep
LPARCFVEPRLFFSCSRASPGMMKRHSSAALPPSTGGEMHEQTTGKADKSYKRPSRCSRLCSFLIIATAFSMLACHCYDYAHGGVARVEHGRASSRRSGGSPFSDPAVPPRRDNRRPEGFGRQRKRARSXAGGRK

SEQ ID NO: 205178 - protein, 100 aa, Triticum aestivum
  unsure (1)..(100): unsure at all Xaa locations
  Clone ID: PAT_TA_99596.pep
MARTKQTARKSTGGKAPRKQLATKAARKSAPATGGVKKPHRFRPGTVALREIRKYQXRSTELLIRKLPFQRLVREXAQDFKTDLRFQSSAVXGLQEGAEA

SEQ ID NO: 205179 - protein, 76 aa, Triticum aestivum
  unsure (1)..(76): unsure at all Xaa locations
  Clone ID: PAT_TA_99597.pep
QTIKRRSLXCSMDGIDQSXQSVREHVGNLCLMDRGSAXQVSDTMCSWKRSLLSSVPNNTACEVGCFTPRHRLRLGP

SEQ ID NO: 205180 - protein, 121 aa, Triticum aestivum
  unsure (1)..(121): unsure at all Xaa locations
  Clone ID: PAT_TA_99598.pep
MAGAGVTTTGSPCGACKFLRRRCAAECVFAPYFCAEDGASQFAAIHKVFGASNAAKLLQQVAPGDRSEAAATVTYEAQARLRDPVYGCVAHIFALQQQVVALXAXVXHARTQGAAGGGRRG

SEQ ID NO: 205181 - protein, 78 aa, Triticum aestivum
  unsure (1)..(78): unsure at all Xaa locations
  Clone ID: PAT_TA_99599.pep
MGQHSLIYAFVAHGTVVLXEYTXFXGNFXSIAXXCLXKLPXXNXKFTXNXDGHTFNYLVXDXFTYCXVCRLIIASRMP

SEQ ID NO: 205182 - protein, 75 aa, Triticum aestivum
  unsure (1)..(75): unsure at all Xaa locations
  Clone ID: PAT_TA_99600.pep
QXGGDVGAEVFFEPSSTQFSAISALLYIHLKSNSDERGVAPSRRPPGEGEGGGVPARSREIWEGRRESXHAVGKA

SEQ ID NO: 205183 - protein, 102 aa, Triticum aestivum
  unsure (1)..(102): unsure at all Xaa locations
  Clone ID: PAT_TA_99601.pep
ESKPRLSRPPRCKIFVKTLTGKTITLEVESSDTIDNVKAKIQDKEGIPPDQQXRLIFAGKQLEDGRTLAXYNIQKESNLXLVLXRLRGGMFKEPHRRTSSEG

SEQ ID NO: 205184 - protein, 134 aa, Triticum aestivum
  unsure (1)..(134): unsure at all Xaa locations
  Clone ID: PAT_TA_99602.pep
MGKEKTHINIVVIGHVDSGKSTTTGHLIYKLGGIDKRVIERFEKEAAEMNKRSFKYAWVLDKLKAERERGITIDIALWKXFETNKYYCTVIXDAPGXRDFIXKNMITGNSXADCAVLXIDSTTGGFXAGISKGA

SEQ ID NO: 205185 - protein, 116 aa, Triticum aestivum
  unsure (1)..(116): unsure at all Xaa locations
  Clone ID: PAT_TA_99603.pep
ATLLDLPHGHGASIHGAFLPPSLPHHHRRPAAVHLHLPDPPRRPRPVRHLHQAPWAARSSPPSLSPRSXGXDAPPRQPDLRRQXQASWWGPGAGRPGGKKFALQGVPGLKLRGQNN

SEQ ID NO: 205186 - protein, 52 aa, Triticum aestivum
  Clone ID: PAT_TA_99604.pep
MGGGNAQKSKMARERNLEKLKGGKGSQLEANKKAMNIQVRRLIPPIQSIESI

SEQ ID NO: 205187 - protein, 157 aa, Triticum aestivum
  unsure (1)..(157): unsure at all Xaa locations
  Clone ID: PAT_TA_99605.pep
VSAIALPLGCVVPSPSATSHCRLPLLLDAPLGPSQRFSNCRRSRLPFRRFHCATPEAMVQLLWARPPDEARGRLVLVVGEANQGRHVAGRCWSPEECGCEVEVGRSWGKERTCATGXTNAPRGNGXXGENTPQCGGILGXNGASLGXXFKVKRKFPG

SEQ ID NO: 205188 - protein, 101 aa, Triticum aestivum
  unsure (1)..(101): unsure at all Xaa locations
  Clone ID: PAT_TA_99606.pep
QASESLIPLAGWSPPRFHHFGHFSFGFRGIILYXNIHTXPHPXNCRRSRFGXLKIVSPXKXXKXEQKQCTYVXATKKKPAYVGFXTXXXXXPXGSKPXGVX

SEQ ID NO: 205189 - protein, 110 aa, Triticum aestivum
  unsure (1)..(110): unsure at all Xaa locations
  Clone ID: PAT_TA_99607.pep
MVAGRRRVVFFPFXFLGHFNPVLRLXGALHARGLAVTVFHTEQRVPDPADYPADYRFXSVPVEVPPELAASEDIARMGMAMNDAAEAPFRDRLAALLPDEEAEDGGRPLR

SEQ ID NO: 205190 - protein, 132 aa, Triticum aestivum
  unsure (1)..(132): unsure at all Xaa locations
  Clone ID: PAT_TA_99608.pep
FFXRSXALEGPFVPRLGXXPPXSHPSXSCXISRSRFXPYRXVGIFLGANGSASDTPRGFAGXWTANREPQXPAAGSCGGESSSELARAKWRHGGGDCWCDWSEVGWARGRRPERDATRRKWSWRICSGTQVH

SEQ ID NO: 205191 - protein, 80 aa, Triticum aestivum
  unsure (1)..(80): unsure at all Xaa locations
  Clone ID: PAT_TA_99609.pep
AGLAGNHXRXXPFGXXAXWXLPASLRPXVXALPXVNLGHXLGVXPIVAGFXSLXXXDAXSRRLRQPPLVPTXCWPSLHLT

SEQ ID NO: 205192 - protein, 71 aa, Triticum aestivum
  unsure (1)..(71): unsure at all Xaa locations
  Clone ID: PAT_TA_99610.pep
XWXIXETXXRPGXPXXRFFSPPXLSPSSVTQAAPPRPRRPPSDLPFPALVFLSLPPHDLRWETLAMGNFVP

SEQ ID NO: 205193 - protein, 114 aa, Triticum aestivum
  unsure (1)..(114): unsure at all Xaa locations
  Clone ID: PAT_TA_99611.pep
MHIFXKTLTGKTITLEVESSDTIDNVKAKIQDKEGIPPXQXRLIFAGXXLEDGRTLADYNIQKESTLHLVLRLRGGXQIFVXTLTXXTIXLGVESSXTIXNGXGKDPRTXEGSP

SEQ ID NO: 205194 - protein, 102 aa, Triticum aestivum
  unsure (1)..(102): unsure at all Xaa locations
  Clone ID: PAT_TA_99612.pep
SSSLSEQATLGRKCRVSRIAVGSHREVYXVGXLKAALAXFISTLIFVFAGQGSGMAFSKLXXXXXVTPAXLISXEIXHXFAXFVXXSVGANIXGRGNVXPXR

SEQ ID NO: 205195 - protein, 49 aa, Triticum aestivum; identical to SEQ ID NO: 147490
  Clone ID: PAT_TA_99613.pep

SEQ ID NO: 205196 - protein, 69 aa, Triticum aestivum
  unsure (1)..(69): unsure at all Xaa locations
  Clone ID: PAT_TA_99614.pep
APPRLPPXPPAYRRAAPPLAAAGVSXRAPASAAHLAAGSCFXFXXXSPXFXDXMGRSPSXXXPCXFGXV

SEQ ID NO: 205197 - protein, 51 aa, Triticum aestivum
  unsure (1)..(51): unsure at all Xaa locations
  Clone ID: PAT_TA_99615.pep
DYXVPTXXLEQVATQHAPTTPPPKNXPQEREKSPARPVLIAPVKNAGGLXS

SEQ ID NO: 205198 - protein, 129 aa, Triticum aestivum
  unsure (1)..(129): unsure at all Xaa locations
  Clone ID: PAT_TA_99616.pep
MEAXTAAKRARXXXVPAAADGAGEQAGXXXVIPGWFSXINPMWXXEXHXLKXXKXLFQXKFGXKKLWVFNPPXNGKGSXLIGXFKXNRXGTIAPNKXMFTNFXLVXLKXPKKALSXGGGXXGGFGEGPR

SEQ ID NO: 205199 - protein, 114 aa, Triticum aestivum
  unsure (1)..(114): unsure at all Xaa locations
  Clone ID: PAT_TA_99617.pep
MATETETFAFQAEINQLLSLIINTFYSNKEIFLRELISNSSDALDKIRFESLTDKSKLDAQPELFIHIIPDKATXSTLTIVDSGIGMTKSGLVKNLGNIAKSGTKGVQGRLPGA

SEQ ID NO: 205200 - protein, 129 aa, Triticum aestivum
  unsure (1)..(129): unsure at all Xaa locations
  Clone ID: PAT_TA_99618.pep
MPAKIPSHYPLDHEVNDAESGYASASSSEASLPEVVFTKAHLQFLNRQLQFLEPQDVLRWCITTLPNLYQXTTAFGLTGLAITDMLSKLDVPRPQVXVDLIFLXDTLHHFKKKTSPCGPCRQTLTPTVQ

SEQ ID NO: 205201 - protein, 148 aa, Triticum aestivum
  unsure (1)..(148): unsure at all Xaa locations
  Clone ID: PAT_TA_99619.pep
PPPXHRXLPRPTDWLPXAALRPLLHRRVGRDPATPPPSPALVPARTARTPPPRTRYCTDSAARPRPKGKPQPRXSRFLNTLAVPPPGTKHXDAYRARRGPRTSXGNNRGERXQGRQXLXVGNXQPQVSEGXYCGEXVFSKQGPXXLKC

SEQ ID NO: 205202 - protein, 144 aa, Triticum aestivum
  unsure (1)..(144): unsure at all Xaa locations
  Clone ID: PAT_TA_99620.pep
SCRCRSSPSAPAPPPTASCRRWRRPAPRTSPPADASSCGLPTPAAGGPAPSGPQASLEQEVKERADSPSPSAGASSQATKRDVRNIAIVAQVDHGKTTLVXDSMLRQSKVFRDNQVVQEXRIMDSNDLGEGKXGXLYWGKNTXI

SEQ ID NO: 205203 - protein, 141 aa, Triticum aestivum
  unsure (1)..(141): unsure at all Xaa locations
  Clone ID: PAT_TA_99621.pep
MQIFVKTLTGKTITLEVESSDTIDNVKAKIQDKEGIPPDQQXRLIFAGKQLEDGRTLADYNIQKESTLHLXVLRLRGGMQIFVKTLTGXKTITLGGXSPSDNHPTTSRAKDXRTKGGASPPGPSKRLIFAGXAARRMAATL

SEQ ID NO: 205204 - protein, 105 aa, Triticum aestivum
  unsure (1)..(105): unsure at all Xaa locations
  Clone ID: PAT_TA_99622.pep
GKGRKERWGHHRPSPPPPPPPPRPSSASRPPARRRRGRPPSCRLSPAGSPAPPSSPSTPPPPPPXGGXMPXPPRXRAPSERTSLLIKPTVIWRFSQRPLIALFLL

SEQ ID NO: 205205 - protein, 159 aa, Triticum aestivum
  unsure (1)..(159): unsure at all Xaa locations
  Clone ID: PAT_TA_99623.pep
STAGLPVSRRSNGASLGSVSNGGRIRCMQVWPIEGIKKFETLSYLPPLSTEALLKQVDYLIRSKWVPCLEFXSKVGFIFREHNASPGYYDGRYWXTMWKLPNVXGCTDATQVIKRXVEEXQEGSTPDAYVPHHPDSDNMRQRXXCVSFNGLQSRGCRRS

SEQ ID NO: 205206 - protein, 83 aa, Triticum aestivum
  Clone ID: PAT_TA_99624.pep
MAPTEYAIPRGSLILVTGANGYIGSHVVDQLLALGYKVRGTVRDKKPWLDAFFEQKYGKDKFESVAVPAIEAAGAFTNVARRG

SEQ ID NO: 205207 - protein, 67 aa, Triticum aestivum
  Clone ID: PAT_TA_99625.pep
AARCLHVIPSVSLARGIQDLAHSRRVGREHRGEGVVALIRQQRANGPGMLCRCTRPKRDYMRKRATG

SEQ ID NO: 205208 - protein, 137 aa, Triticum aestivum
  Clone ID: PAT_TA_99626.pep
MDFLKKKMKELMDDDDKKPAESQSAPSHDSYGGAPGGAGPGDRALSDSYYGHGGPPQDQGQGYPPQGYPPQGPPQGQGYPPQGQGYPPQGYPPQASKYGQGAPPQVGPPSALRSASTQCRLAGRNNGDQEQNVGSNI

SEQ ID NO: 205209 - protein, 142 aa, Triticum aestivum
  unsure (1)..(142): unsure at all Xaa locations
  Clone ID: PAT_TA_99627.pep
MAAKGDGPAIGIDLGTTYSCVGVWQHDRVEXIANDQGNRTTPSYVXFTDSERLIXXDAAKNXVGMNPXXXVFDGXRLNGXXFTDSTVQXXDLXCWPSKVFXDLVDKPMINVQFKGEGETITWGKSSGPNKNAWEGSSLEQLE

SEQ ID NO: 205210 - protein, 140 aa, Triticum aestivum
  unsure (1)..(140): unsure at all Xaa locations
  Clone ID: PAT_TA_99628.pep
DIAIITLCCITFFSAIVLDWQFGINCPMMTRCDYMFDDTIKEKVCILGCKVRQAVGLDMKYYVDRANDLAVKNNPPYFRYLNGASTFVLLPLRIVAVYGLIKRKEWRIPGILFAALHLDHASLYLFDVFNQNQQXRPILS

SEQ ID NO: 205211 - protein, 92 aa, Triticum aestivum
  unsure (1)..(92): unsure at all Xaa locations
  Clone ID: PAT_TA_99629.pep
MPSSSHLRIQTSFEPFTAETTRSHFVSSPPQKKQKMSLTQTYYIAASARSKLGKEACXADHDLRLLVGHANLXDSLMVELQERRNGQQXTWV

SEQ ID NO: 205212 - protein, 83 aa, Triticum aestivum
  unsure (1)..(83): unsure at all Xaa locations
  Clone ID: PAT_TA_99630.pep
PAASDPAPPXXXRXLDXEMXMPPPPXPPXXSTAWSSSPSRPPTKPSKGKTITAFTYTDEPGAXAXAXPXNXGPXMATAGRGGH

SEQ ID NO: 205213 - protein, 137 aa, Triticum aestivum
  unsure (1)..(137): unsure at all Xaa locations
  Clone ID: PAT_TA_99631.pep
TRETKAEXTPAGSQLNREGRRRMAPSLLVSASQILAVAGRGGRKRRLVIANSGGAGTPPKLVTFLGKGSSGKNTGGAPSLAQILCKVXXLKKCLGFKNPQRTRQAXXNLMGLXXIWKLXPTEMXLAKPXNQXSSKTX

SEQ ID NO: 205214 - protein, 123 aa, Triticum aestivum
  unsure (1)..(123): unsure at all Xaa locations
  Clone ID: PAT_TA_99632.pep
XXXTLCRXRXSXLLLRLSVGGLRXLNLPLGGCRNFGRKLAFVFXLLDPKIPGAPLXLIXPPLVGLWVWAFEVLRVVLLGTVIEELRHDYGVVGRWWFRYWLGEGLGCVGFQGARPQQKRYKGV

SEQ ID NO: 205215 - protein, 83 aa, Triticum aestivum
  unsure (1)..(83): unsure at all Xaa locations
  Clone ID: PAT_TA_99633.pep
MGQTLSXPVVEKTSEKXEDDRLLFGVSAMQGWRISMXEDXHTAELKLPXPDNDTKTQPRQGWPFSGVYDGTTXGXTXXPLFPR

SEQ ID NO: 205216 - protein, 120 aa, Triticum aestivum
  unsure (1)..(120): unsure at all Xaa locations
  Clone ID: PAT_TA_99634.pep
MCGIFGYINYLVEKDRKYILDTLINGLQRLEYRGYDSAGLAIDGDKKNEVYAVKEVGKVASLKKLVEEXNFDLNKVFDSQRRVSPXTRWGNQRSPNRRVQLASPKGPXPNWGPPFVQKWV

SEQ ID NO: 205217 - protein, 122 aa, Triticum aestivum
  unsure (1)..(122): unsure at all Xaa locations
  Clone ID: PAT_TA_99635.pep
QPRSAKPRNNPRGRXTQPSRPPLLTNPRGRKQSRDGRXRAXXRLPEAGGRGXAPLAAPSVPXRSPSSPXARRFXVSLAGRARSPXXLXXVSGQXKWEPXWGXQNXXNAPXXPPNXXPRXKXP

SEQ ID NO: 205218 - protein, 125 aa, Triticum aestivum
  unsure (1)..(125): unsure at all Xaa locations
  Clone ID: PAT_TA_99636.pep
RXPESGGPRXXSSPRRGVFFGPPVPVERRRGVGVLLXPASRRPSSGAPACRLVSDTADVKVGGEGDGDDTMAADRAPSTNNNDLLLGWDLRWSDASAGFCVAVVAAGEAIVLSAVVRTVRCWLPR

SEQ ID NO: 205219 - protein, 145 aa, Triticum aestivum
  unsure (1)..(145): unsure at all Xaa locations
  Clone ID: PAT_TA_99637.pep
GTXXFPPPPGGXLGGPEXGTRPLGIXGGESPXRVHPGGRFVRGNXAGPFXQRAAIGVXEVGRLLRDRXXRGXGSRLIIXCQLPPSADSASAMARRIWTGRRRSAKRSRLYPSKTQCLRWGAGGGXEXGLGYATARRGGGGGIGLG

SEQ ID NO: 205220 - protein, 131 aa, Triticum aestivum
  unsure (1)..(131): unsure at all Xaa locations
  Clone ID: PAT_TA_99638.pep
GGSGGASLATWTSSSGAIRALPAHFVVSRRAAIRGSLCFFTLSYAGSRVLICLSQSITFAPPPSCNAKYECRCSLWVPGDQSRRGELLFVLDWGXSPQKSKMXWFSNPVATPRMGQLLQITGFGGKKIFLD

SEQ ID NO: 205221 - protein, 95 aa, Triticum aestivum
  unsure (1)..(95): unsure at all Xaa locations
  Clone ID: PAT_TA_99639.pep
MATNGYSNGGSTKGKPIKCKAAVAWGPGEPLVMQEVEVAPPARMEVRVKVLYTSICHTXDLXFWGRRETKRQRKVPLRXLLGXRQPGSWWEKRSE

SEQ ID NO: 205222 - protein, 143 aa, Triticum aestivum
  unsure (1)..(143): unsure at all Xaa locations
  Clone ID: PAT_TA_99640.pep
DGGRSRELERLRAERDELDARIRLLESELEAGSAAPVSPGAGVGDGGCVGGGGACQARPGLADADSLPADMIYRYSRHLLLPDFGVEGXKKLSRSSILVVGAGGLGSPVXLYLTXCGVGVLGNVXGDDVELNKLHPTDPTKKA

SEQ ID NO: 205223 - protein, 123 aa, Triticum aestivum
  unsure (1)..(123): unsure at all Xaa locations
  Clone ID: PAT_TA_99641.pep
DAQIPPSPLHISPPSPTTRQKQGGXRAREGARAXISAXPPPGLRIXRSAMNXXASVSNELIARXMMILXRXSCGCXXXTECVXCXXXGVPRWAKXQXLGIFPXCNXSVSGYFXXXPFGGXNNN

SEQ ID NO: 205224 - protein, 129 aa, Triticum aestivum
  unsure (1)..(129): unsure at all Xaa locations
  Clone ID: PAT_TA_99642.pep
LAASSRSPSLLILSPHVSPHAPRIPFPFPAPLAASASASAGKRHSTTPRPPHPPASQAKPSQRLDLFLRPPRPLPPPXPLPRPSARRLPSGSPSTGLPPAGYRSPLRSGRGVPPSRVLLRNKRFGELLT

SEQ ID NO: 205225 - protein, 136 aa, Triticum aestivum
  Clone ID: PAT_TA_99643.pep
PPPAPPLFLTPQISLQWSAPPACCCCRPPCGTSPPASSPTSPPAPPPPPPSPPPPPPPRSPSPSSTAPPRSCPGRAPPRTCGSPGPAPRSAPRSPSPPPPPTPPWSSAGARARSPSPSTKPHGHSSSCSGNSTPAR

SEQ ID NO: 205226 - protein, 96 aa, Triticum aestivum
  unsure (1)..(96): unsure at all Xaa locations
  Clone ID: PAT_TA_99644.pep
MPTPPAAGRSLVLHCCCCLILLVLLPACHAFPLCTDHRAPLPLNGTLAFCGNAGAGASCCDAAADKALRXKLQAANVSDAACAAVLKSLLCAKCNP

SEQ ID NO: 205227 - protein, 106 aa, Triticum aestivum
  unsure (1)..(106): unsure at all Xaa locations
  Clone ID: PAT_TA_99645.pep
MGKEKTHINIVVIGHVDSGKSTTTGHLIYKLGGIDKRVIERFEKEAAEMNKRSFKYAWVLDKLKAERERGITIDIALWESFETNKYXCSVNLMAPGHPWTSIKEHD

SEQ ID NO: 205228 - protein, 146 aa, Triticum aestivum
  unsure (1)..(146): unsure at all Xaa locations
  Clone ID: PAT_TA_99646.pep
MGLKTAVFLSVPAAVAPLPTTLRRHHLYSSSRGSRAAASRISAAVMATAVQPAVVVGGGRVGQALLSMGPPAGGDLLLRRGEALPPAAPAGPILVCTRNDDLDXVLDANPKSRWADLVFFQKGDAGPRGWRSKGLGRGQTSAPLIS

SEQ ID NO: 205229 - protein, 146 aa, Triticum aestivum
  unsure (1)..(146): unsure at all Xaa locations
  Clone ID: PAT_TA_99647.pep
QSRNEAPPPPTPLLTNLSPLPSPWFVRPSRTPRPPRPAPPPHRCRGGWICPGSRLRAPRACRSAPPPPSGGPARCADPXTXAXSTAXGAGTSWSPRPSAGSKQAXSSTPPRNQARLRGQTERVGAACKANNPXPKXTAPGXGTKAT

SEQ ID NO: 205230 - protein, 113 aa, Triticum aestivum
  unsure (1)..(113): unsure at all Xaa locations
  Clone ID: PAT_TA_99648.pep
MATPAIALLDQSLPFGGGGSDRLSKEIFSILESNFLFGAQALEPAGACSAGRVRVLSIDGGADGGALAAXALVRLXRRVQELLGNPEGRVAGLLRRCXPGPGAXGXLPGRPVP

SEQ ID NO: 205231 - protein, 149 aa, Triticum aestivum
  unsure (1)..(149): unsure at all Xaa locations
  Clone ID: PAT_TA_99649.pep
XTIGGNSKXFPGXPVQISLXPRSNPSCXIXSAAXTAISPCXAQLSSRISKCXFDRRRLTRPVAARSGTVAPRPLGRVAFRPNPKDTPEIDPRPGRIAASAKSVWSGGRPGAVEDRSVRAMRARAGSSAALGSPQLRIYEGGHGGDGLAA

SEQ ID NO: 205232 - protein, 113 aa, Triticum aestivum
  unsure (1)..(113): unsure at all Xaa locations
  Clone ID: PAT_TA_99650.pep
PALRPYFRFHFHFSTSDAIIPWPHLHSRSLPAHHAFLALTPCHRHRRLCCRELLLHNKLDIKHATLHPSSSTHEKAMPPATPPLXDSKPSPSFRPTIPANVTKGWVVRKQAKN

SEQ ID NO: 205233 - protein, 126 aa, Triticum aestivum
  unsure (1)..(126): unsure at all Xaa locations
  Clone ID: PAT_TA_99651.pep
MARLNSKAVAAAVVLAAVVLMMAGREASAALSCGQVDSKLAPCVAYVTGRASSISKECCSGVQGLNGLARSSPDRKIACXCLKXSLANSIKSINNGQRSPACPGSSGSSVPFPINNSNNLQQMTSS

SEQ ID NO: 205234 - protein, 95 aa, Triticum aestivum
  unsure (1)..(95): unsure at all Xaa locations
  Clone ID: PAT_TA_99652.pep
MQRGRSWFGCVPMSTAALPVERDFDLPAVKPSWXSSASDGGFAXGSIDLGXMEVRQVTNFAKVWSXXRKGGQDGLGGNFFKPXACPGRSNALGTI

SEQ ID NO: 205235 - protein, 143 aa, Triticum aestivum
  unsure (1)..(143): unsure at all Xaa locations
  Clone ID: PAT_TA_99653.pep
AASFLRPLLPPKPFLSTPKPQVPITXIXDVRCTAAPKPTTFTPKPAQQERNQDEEQEPTPDEADANPHRIPDDETPPSATATTSFSVXPARCPSVISTXXDASARTALTQXEPPNFEXIGWEAAPXNLXLGKGKGVGPDSGLG

SEQ ID NO: 205236 - protein, 148 aa, Triticum aestivum
  unsure (1)..(148): unsure at all Xaa locations
  Clone ID: PAT_TA_99654.pep
PRXAAARTIVASPTGSXKDNWGRXRPRSGLILDPXPCCAWLLPXPRRTLPEPARPPPWRREATARNPASRQHRSRCWRRSCCGRRWSSGGADGSKGARARLGMRLWWSQDSRRSSLDGNERINHWGAHVAMMPLLSIASSAGLKGDFA

SEQ ID NO: 205237 - protein, 122 aa, Triticum aestivum
  unsure (1)..(122): unsure at all Xaa locations
  Clone ID: PAT_TA_99655.pep
XRXPHGEERGXPVPLAGXCSXATKSGSEVRAXPGGADSAEAAEVLGRDAEKDLVQRVRGQVTGAGDGWARPRGRHRESADGGQAIAGDEKDGGESGRRTGRGFRPLDSKEEGYRLPTELNQT

SEQ ID NO: 205238 - protein, 79 aa, Triticum aestivum
  unsure (1)..(79): unsure at all Xaa locations
  Clone ID: PAT_TA_99656.pep
GPXLSFGPPGGFQRGRFXALVIPSTSLGTGLWCRLASWSDAAARGTARRAREGTSLVGVSGDPCLFSLLLSRFILCLFP

SEQ ID NO: 205239 - protein, 118 aa, Triticum aestivum
  unsure (1)..(118): unsure at all Xaa locations
  Clone ID: PAT_TA_99657.pep
MLDKLWDDVVAGPRPETGLDKLRRAAATQPLAINTXAGEAIKQSPSMPTTPTTPVTPSSSTPPXRXQRVXGSFSTPGSXXGHQKPRRQXSFDRPAXPNSPQPFYDWXLQTTNQGNQPA

SEQ ID NO: 205240 - protein, 143 aa, Triticum aestivum
  unsure (1)..(143): unsure at all Xaa locations
  Clone ID: PAT_TA_99658.pep
TGAVIQSLFFTCHTPPSIVILYPTPQSRHLCSAAMXTLLRRSGNLARLSRPCLNAATRAPRTLRTRSTDTTMYIYPSNGCGDFATGPPXEPKEXKDDEXAXEGXGSLXSPEVQNLSGKRXEGXSLKLAKTLPPRGRXKDXGFK

SEQ ID NO: 205241 - protein, 140 aa, Triticum aestivum
  unsure (1)..(140): unsure at all Xaa locations
  Clone ID: PAT_TA_99659.pep
WXXIXXMDGFKDFTLDRVNFTAAELRPFVDRLHRNAQKYVLILDPGIRIDATYGTFVRGMQXDIFLKRNGTNFLGNVXWPGDVYFPDFNATRTPASSGARGRSPLLPAGNPPERGWWDSNNNDPNFPNPGPIETRSETPP

SEQ ID NO: 205242 - protein, 98 aa, Triticum aestivum
  unsure (1)..(98): unsure at all Xaa locations
  Clone ID: PAT_TA_99660.pep
SPPITTTAVSSSPSPGQRAXGGGQAGAARGRKRNAQGEALQLAGPATGLGRRRRGTDGRGVQVAPAWLGGGADVGWTGWGEARSLKDHGEKRIGGEMC

SEQ ID NO: 205243 - protein, 133 aa, Triticum aestivum
  unsure (1)..(133): unsure at all Xaa locations
  Clone ID: PAT_TA_99661.pep
PNSRSPAILPVRRRRRHRPAAPALPSPPRSSPRSSPRAAACRSARTRMRWSKGKRRCFGAAKRHHPPSLRPPPXLCSSLPGKNFSLPLXPFALXXPTGVRXSMXGXGDSMASGXXCSXPXXXRGFLENXQREF

SEQ ID NO: 205244 - protein, 94 aa, Triticum aestivum
  unsure (1)..(94): unsure at all Xaa locations
  Clone ID: PAT_TA_99662.pep
VVLGHCQGRDVXEEHCGGXLSMLXTLLQNYGKTHLEVXKEXYVQGSLVGTLPAQTTWDIKDPSXVKSKXRFENKXMXKPIAXXFGRTYRXQGVR

SEQ ID NO: 205245 - protein, 126 aa, Triticum aestivum
  unsure (1)..(126): unsure at all Xaa locations
  Clone ID: PAT_TA_99663.pep
LAPNNQQPHYXTIKMVSFHINEPHPSAGAYMYSGRGGAGNXMRIKPTEVTPGPTASGPXSRTXLPPPPKXXLSTPPARGGAGNMKXRLXRGIFKLRRGNSNKXXLPWANQTXXXVLPKXXFAGRFP

SEQ ID NO: 205246 - protein, 128 aa, Triticum aestivum
  unsure (1)..(128): unsure at all Xaa locations
  Clone ID: PAT_TA_99664.pep
RNGGKGLRNSLAWIVIFQSSPKIRIRFTSLSKWETPSVVVIFSLHGTVKLLEDDGXLYMQVAWIKSXWQYEDFIWGLFMAKYIFPGADXSTPLYWYIKQLETAGFEIHNVDTVGVHYSXTLERWYENW

SEQ ID NO: 205247 - protein, 144 aa, Triticum aestivum
  unsure (1)..(144): unsure at all Xaa locations
  Clone ID: PAT_TA_99665.pep
NVLNLLESGXLCLFXFSFESLVIIRALFXLCSIFDFRLIKSFLNYDVPDTPHQVERRSWYALSISSSVNFSISTFGTNCSVGGGGCGAEPPPSLRRRLSSRDLRHKALERRRWRWILAMAWVKWLCTCGLSRGLVEWNGGRGRA

SEQ ID NO: 205248 - protein, 112 aa, Triticum aestivum
  unsure (1)..(112): unsure at all Xaa locations
  Clone ID: PAT_TA_99666.pep
PIPQPPWPSPPARVPPXHHPESPQPPPSVRPQRPPPPTXSKLAWPPPQARTPPPPPSXPPWLPPAARAPPPPTSHGRRGPCPKPLLPQRSPVGRSDRSPRNPSKRRRGLAIP

SEQ ID NO: 205249 - protein, 121 aa, Triticum aestivum
  unsure (1)..(121): unsure at all Xaa locations
  Clone ID: PAT_TA_99667.pep
MNGFNGTTDAGGMYVKALYDYQADDRTSLSFRTGDIIQVITXLESGWWDGVIHGVRGWFPSNYCAVVQAPPRTLKRQETASMPDDRPRLSGKAALNDNLMEPLSGWNNQYWPPPRQSIAGN

SEQ ID NO: 205250 - protein, 67 aa, Triticum aestivum
  unsure (1)..(67): unsure at all Xaa locations
  Clone ID: PAT_TA_99668.pep
LRXXQTLRPXXPPAXGPPPSWGPPRRPPASPPRAPPPSARPXGFGHQRWPXPSWMQENARSGLRLAS

SEQ ID NO: 205251 - protein, 119 aa, Triticum aestivum
  unsure (1)..(119): unsure at all Xaa locations
  Clone ID: PAT_TA_99669.pep
MEVLLGITGKDFTLIAASKAAMRGATILKASDDKTRSXLNTHTLMAFSGEAGDTVQFAEYIXANXQLYSMRNNMGGVNRCNCQRSRGETWSGAWLKEPIVQTFAPWGVITNTDLPDQNL

SEQ ID NO: 205252 - protein, 98 aa, Triticum aestivum
  Clone ID: PAT_TA_99670.pep
MSHGVAARKRFGGVGFALGCGCKDPKAVAVAAAAVAASSPRSGTEASTANTATSRTASKDAPVGVHVQRARSTLPSASSSFLVGRTPTKVRVASPKLR

SEQ ID NO: 205253 - protein, 147 aa, Triticum aestivum
  unsure (1)..(147): unsure at all Xaa locations
  Clone ID: PAT_TA_99671.pep
MAAHSVAAAHATIAARAGAAPSSPAAAPAERLGFRLSSLAGRALRSPLPARRGSPAAAASPSSRRSGSQRVRASAAVETVEAAATGXLLDKSVNAXRFLAIDAVEKGVSGQPGLPMGCAPKGHILYEXVMRYKPKNPYWFKRERLLL

SEQ ID NO: 205254 - protein, 72 aa, Triticum aestivum
  unsure (1)..(72): unsure at all Xaa locations
  Clone ID: PAT_TA_99672.pep
AKPSPRSLSGKTLAPFLLPRPTPPPRQAAIKPRHRHGQRLRLLLLIXTDDSYXRXWIMXTDNPGRSTXXACR

SEQ ID NO: 205255 - protein, 130 aa, Triticum aestivum
  unsure (1)..(130): unsure at all Xaa locations
  Clone ID: PAT_TA_99673.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDXTHEAVLSSYEYVSQGLKKXDFHNTMGXFXIAPAFKGK

SEQ ID NO: 205256 - protein, 128 aa, Triticum aestivum
  unsure (1)..(128): unsure at all Xaa locations
  Clone ID: PAT_TA_99674.pep
MARLNSKAVVAAVVLAAVVLMMAGREASAALSCGQVDSKLAPCVAYVTGRASSISKECCSGVQGLNGMARSKXDRXIACRCLKSLATSIKXSINMGKVSGRARASCGRQCCPSPIXMSNQGEQLVKLS

SEQ ID NO: 205257 - protein, 51 aa, Triticum aestivum
  unsure (1)..(51): unsure at all Xaa locations
  Clone ID: PAT_TA_99675.pep
LXSPPAFSPVRLGQDGPEILLFPVACXWAVGLLGRAVLRLVXTSKWEPYSR

SEQ ID NO: 205258 - protein, 90 aa, Triticum aestivum
  unsure (1)..(90): unsure at all Xaa locations
  Clone ID: PAT_TA_99676.pep
HVEKPXEGIRVVPXSXEXCFIXXRILERPSGEDHXXLPXXXGGGCGRRIAGEGGERAXAPGGXEXRRRDRSRRGRRRALGLWIWSAIATP

SEQ ID NO: 205259 - protein, 62 aa, Triticum aestivum
  unsure (1)..(62): unsure at all Xaa locations
  Clone ID: PAT_TA_99677.pep
GXAPQXFXXRTPHXARSXXKKSSMLRMPTLMLFFMYQSRSSXXXFFLXXCSXTAYHWAXGGX

SEQ ID NO: 205260 - protein, 138 aa, Triticum aestivum
  unsure (1)..(138): unsure at all Xaa locations
  Clone ID: PAT_TA_99678.pep
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKXQDKEGIPPDXQRLIFAGKQLEDGRNLSDYNNQ

SEQ ID NO: 205261 - protein, 87 aa, Triticum aestivum
  unsure (1)..(87): unsure at all Xaa locations
  Clone ID: PAT_TA_99679.pep
XTXXIKQSSRRXXSXYXXSTPXVXGIELXXERXIEYRQAGDHXRRRRLXRPRDEQQKQEPGDETQXRRGXAMPGGRXXXIGXXRXGA

SEQ ID NO: 205262 - protein, 67 aa, Triticum aestivum
  unsure (1)..(67): unsure at all Xaa locations
  Clone ID: PAT_TA_99680.pep
MGDAWSXXSWNXMETPEXSXSXLHTXXXLCTRXTSTIFSGEAPPSPLARCPWRRPAVARWWWWRWKS

SEQ ID NO: 205263 - protein, 112 aa, Triticum aestivum
  unsure (1)..(112): unsure at all Xaa locations
  Clone ID: PAT_TA_99681.pep
FSGGQGIIKDXRHXRXFVRHGEASPXQRVPRRLHXRGAGRWCSSHXSPSPSSAASXTGCXIXGLXAGRRXPXXXXXVASSTGRPPSXQSRRSILAFXXFXXXKGSRXXRXPG

SEQ ID NO: 205264 - protein, 106 aa, Triticum aestivum
  unsure (1)..(106): unsure at all Xaa locations
  Clone ID: PAT_TA_99682.pep
MAAKGDGPAIGIDLGTTYSVRXGVWQHDKVXXIANDQGNRTTPSYVAFTDSERLIGDXAKXQSGEXNPXNXXFXAKXHIGRXFTDXTVQSDIXLWPFKVVAGPXDK

SEQ ID NO: 205265 - protein, 126 aa, Triticum aestivum
  unsure (1)..(126): unsure at all Xaa locations
  Clone ID: PAT_TA_99683.pep
MARLNSKAVVAAVVLAAVVLMMAGREASAALSCGQVDSKLAPCVAYVTGRASSISKECCSGVQGLNGIGPQAARTRKDNRCXCPQRAXPTNXXKSIKQWGKVLRAVPRKVXASSXPFPINMFNNWE

SEQ ID NO: 205266 - protein, 103 aa, Triticum aestivum
  unsure (1)..(103): unsure at all Xaa locations
  Clone ID: PAT_TA_99684.pep
MAAAFSSTVGAPASTPTNFLGKKLKKQVTSAVNYHGKSSKANRFTVMAAENIDEKRNTDKWKGLAYDISDDQQDIXTKGKGIVDSLFXAPNGANXNHEGXLNS

SEQ ID NO: 205267 - protein, 97 aa, Triticum aestivum
  unsure (1)..(97): unsure at all Xaa locations
  Clone ID: PAT_TA_99685.pep
MAPTVMASSATSVAPFQGLKSTAGLPVSRRSNGASLGSVSNGGRIRCMQVWPIEGIKKFETLSYLPPLXTEALLKQVDYLIXAPNWVACLEFXKGWV

SEQ ID NO: 205268 - protein, 90 aa, Triticum aestivum
  unsure (1)..(90): unsure at all Xaa locations
  Clone ID: PAT_TA_99686.pep
MSLIAGEEFQHILRVLNTNVDGKQKIMFALTSIKGXVGRRFSNIVCXKXDIDMNKEGWXXFPPDEDGPPDRVAQPRANLRVPGPGFLKIR

SEQ ID NO: 205269 - protein, 64 aa, Triticum aestivum
  unsure (1)..(64): unsure at all Xaa locations
  Clone ID: PAT_TA_99687.pep
APQQDGIGLGRXEVTLXLDKFLLWLLHFPWXKNSLDRGLRQIYGRYIRINVLFSVQQVAWMLGK

SEQ ID NO: 205270 - protein, 120 aa, Triticum aestivum
  unsure (1)..(120): unsure at all Xaa locations
  Clone ID: PAT_TA_99688.pep
AAANWCYATVXAPRARSSTIVASLGTPAPSXSSSFRPKLIRNTPVQAXPVAPALMDAAVERLKTGFDKFKTEVYXNEXPDFFEPLKXGQAPKXMVRGAPNPRCVSPRVTPGARGASPIIV

SEQ ID NO: 205271 - protein, 107 aa, Triticum aestivum
  unsure (1)..(107): unsure at all Xaa locations
  Clone ID: PAT_TA_99689.pep
MAPAVMASSATTVAPFQGLKSTAGLPVSRRSSGSLGRVSNGGRIRCMQVWPIEGIKKFETLSYLPPLSTEALLKQVDYLIRSKWVPCXLRFSKVGFRLPVSTTSSPG

SEQ ID NO: 205272 - protein, 76 aa, Triticum aestivum
  unsure (1)..(76): unsure at all Xaa locations
  Clone ID: PAT_TA_99690.pep
TRLEXKCAXCPXXXGEAPXPXGGGEWLERRGXNGGRPXRRAYXTSPPPPSTRRCPPLHAPRRRCARLPSRRDFVRA

SEQ ID NO: 205273 - protein, 72 aa, Triticum aestivum
  unsure (1)..(72): unsure at all Xaa locations
  Clone ID: PAT_TA_99691.pep
ASCRIRHEGERELVSSFFFFFFNIIVVQQHXTLYXSXSYLSXITACPXKPXHIPLXIPCXAXAXRXGXFFFX

SEQ ID NO: 205274 - protein, 74 aa, Triticum aestivum
  unsure (1)..(74): unsure at all Xaa locations
  Clone ID: PAT_TA_99692.pep
KQXCNGLARXFXSCKRFSLKXQKKGPWEKKFNRASMHPANTEGKTKGTKRIQRAHKNRKKLVRQFXLAXLHSMX

SEQ ID NO: 205275 - protein, 132 aa, Triticum aestivum
  unsure (1)..(132): unsure at all Xaa locations
  Clone ID: PAT_TA_99693.pep
RTHLLCQSLXXXTXVELMXSXXHATIYTDRFPPAELHRRPVDYQAQNLGLRLHLLLASSRCTKTTRCMHDQPKIFFRFFPFLNFVSRVPAMAKPQGVGVGQALGGRDIISGXXXXKGQRGSKDHPXGQXPIA

SEQ ID NO: 205276 - protein, 61 aa, Triticum aestivum
  unsure (1)..(61): unsure at all Xaa locations
  Clone ID: PAT_TA_99694.pep
GFGPXPXXFKTXPQLGKXGXXXXGGETPPXLFXXIXCGEGRXXQNAKFQAAREDLASLPYG

SEQ ID NO: 205277 - protein, 120 aa, Triticum aestivum
  unsure (1)..(120): unsure at all Xaa locations
  Clone ID: PAT_TA_99695.pep
MAPIKVGINGFGRIGRIVFRNAVEHPDIEVVAVNDPFIETTYAAYMLKYDSSHGIFKGDIDVDGKDLVVNGKKVRFYTXRDPANIXWXQTGADYIVXVRVVFNQHRKGRLTAGGPKGPSS

SEQ ID NO: 205278 - protein, 68 aa, Triticum aestivum
  unsure (1)..(68): unsure at all Xaa locations
  Clone ID: PAT_TA_99696.pep
MANPRVFFDMTVGGXPGXRIVMELLQXXPXPRTVEKFPXAPATGEXRAFGXXXXKPTGTXKGAXFXSN

SEQ ID NO: 205279 - protein, 120 aa, Triticum aestivum
  unsure (1)..(120): unsure at all Xaa locations
  Clone ID: PAT_TA_99697.pep
MAPTVMASSATSVAPFQGLKSTAGLPVSRRSSSAGLGSVSNGGRIRCMQVWPIEGIKKFETLSYLPPLSTEALLKQVXYLIRSKWVPCLEFXSKVGFVFREHNSSPGYYDGPITWTMCEA

SEQ ID NO: 205280 - protein, 150 aa, Triticum aestivum
  unsure (1)..(150): unsure at all Xaa locations
  Clone ID: PAT_TA_99698.pep
PLKDKEXMTMLSPASTHLLRSGSAPAAPLLPRRASLXLSCVAGXAAXRSRRRSGRLEVVRAATAEVXEAAGAPAXTXRILILYFKGGGHHGRRRAVPXXHPCSXRGWNGXSLNLGGCFIRTNGIRXXXLCLTXRRQTXSKAXLGGPPXKP

SEQ ID NO: 205281 - protein, 94 aa, Triticum aestivum
  unsure (1)..(94): unsure at all Xaa locations
  Clone ID: PAT_TA_99699.pep
RLCELAEAKVQLEVRNQELLEESTYAKGLASXAAGVELRALSEEVTKLVKQERRKLAKPIWESSEENSDNERSKANNPGASEKGATNVRTEQQG

SEQ ID NO: 205282 - protein, 99 aa, Triticum aestivum
  Clone ID: PAT_TA_99700.pep
PHRYRPGTVALREIRKYQKSTELLIRKLPFQRLVREIAQDFKTDLRFQSHAVLALQEAAEAYLVGLFEDTNLCAIHAKRVTIMPKDIQLRPPHPVGERA

SEQ ID NO: 205283 - protein, 122 aa, Triticum aestivum
  unsure (1)..(122): unsure at all Xaa locations
  Clone ID: PAT_TA_99701.pep
MAAAARRALLLLLAAAAVALLAAPPAAAARPCGRAQTLLISFSSFSRPNPDPADPSPLTTTVVTVLRVRRLRPAXLPRPRPEPPPRSAAPPRPLPRRWHPRAENAALSERAKGKSSVGRGPA

SEQ ID NO: 205284 - protein, 69 aa, Triticum aestivum
  Clone ID: PAT_TA_99702.pep
ENTTSTKRRREADRVMGKPGTKYLPQKAKDKVKKAPSASSKKKKVVTKTKPTTSKKKQTLLSKKKPKNK

SEQ ID NO: 205285 - protein, 126 aa, Triticum aestivum
  unsure (1)..(126): unsure at all Xaa locations
  Clone ID: PAT_TA_99703.pep
PPSPPWPXPPPLRPAPPPPPPRPPXPRPSPRRPPRSSSMCASCPPTTXPPPSTRPRRRPXRRPPTASGAWXTXSPPSPSQRPPSSPPXAPXPXKSPSAPAHRPSSNSAGGALWGERALRVGDKSGA

SEQ ID NO: 205286 - protein, 108 aa, Triticum aestivum
  unsure (1)..(108): unsure at all Xaa locations
  Clone ID: PAT_TA_99704.pep
MAPTVMASSATSVAPFQGLKSTAGLPVSRRSNGAXLGSVSNGGRIRCMXVWPIEGIKKFETLSYLXPPLSXDALLKQVDYLIRSKWVPCLXVHQGWVHXSRXHNASPG

SEQ ID NO: 205287 - protein, 101 aa, Triticum aestivum
  Clone ID: PAT_TA_99705.pep
FLRWQRCFSLITQIHSRQIVLYNIMCMCIYIAIGSIHIRACFLESCREHGHTHILILGTNKKDKWKRKTQSNVRVDKTAMALYMWPVVSELFRPCRTPRSP

SEQ ID NO: 205288 - protein, 55 aa, Triticum aestivum
  unsure (1)..(55): unsure at all Xaa locations
  Clone ID: PAT_TA_99706.pep
MAPTVMASSATSVAPFQGLKSTAGLPVSRRSNGASLGXSVSNGVKGSGACXVWPI

SEQ ID NO: 205289 - protein, 46 aa, Triticum aestivum
  unsure (1)..(46): unsure at all Xaa locations
  Clone ID: PAT_TA_99707.pep
XFFXFFFFFFFFFFFFFFFFFFFFFFFFFFFFFFANKLCSDFSFHS

SEQ ID NO: 205290 - protein, 120 aa, Triticum aestivum
  unsure (1)..(120): unsure at all Xaa locations
  Clone ID: PAT_TA_99708.pep
MSEEKHHHLFHHKEGEDFQPAADGGVDTYGYSTETVVTATGNDGEYERITKEEKHHKHKEHLGEMGAAAAGAFALYEKHEAKXDPXHXHKHKIXEEVAAAATVGAXAAFVFHXAPRXRKQ

SEQ ID NO: 205291 - protein, 82 aa, Triticum aestivum
  unsure (1)..(82): unsure at all Xaa locations
  Clone ID: PAT_TA_99709.pep
LLLQHSLEFVNVQIFPHHTNLGTYGGLERRVPAARRAKXXSVRRXIXSEAGKKKGRQNNRSHLAYNVIATDCDISMTLVIFA

SEQ ID NO: 205292 - protein, 125 aa, Triticum aestivum
  unsure (1)..(125): unsure at all Xaa locations
  Clone ID: PAT_TA_99710.pep
ASCRIRHEASPSSVNTVHTQHLDHRQSTTCLLRERKLPPPPSPRARLVPTRRPRXLSSSPVARNFGIGQDVXAQAATLSRFVKWARVRSVLPAARKKXSWNPXVLKGSPPXPIXPXFXQKTPXNR

SEQ ID NO: 205293 - protein, 139 aa, Triticum aestivum
  unsure (1)..(139): unsure at all Xaa locations
  Clone ID: PAT_TA_99711.pep
GKVVEVSTSKTGKHGHAKCHFVAIDIFNGKKLEDIVPSSHNCDXPHVDRQDYQLIDXITDDXXVXPPKXEKXXTTKGXLKASQLMMFCLGXXKTGFADGKXLILSVMSAMGXEKQICAXXGIRGKLTTVRGCPTATLGT

SEQ ID NO: 205294 - protein, 96 aa, Triticum aestivum
  unsure (1)..(96): unsure at all Xaa locations
  Clone ID: PAT_TA_99712.pep
MLAVFRRSGGGCRRKLVAAGSRTPSPXTRASELVKRFLXGGRAGRGPWELGLLGKLAXSXAKXSLLLPRVLPLQKDXXFCLFQGXPGTXXGRXSQQ

SEQ ID NO: 205295 - protein, 107 aa, Triticum aestivum
  unsure (1)..(107): unsure at all Xaa locations
  Clone ID: PAT_TA_99713.pep
MKGTKLAAILILQAVLVMGLLSHVNADFFPKCCNNCRSFSGVDVCDDAHPKCPQGCSACRVVSTKPPKCGAARDMKSTVDGQPGXWGPCKESNWIRVQWPGNYFPAK

SEQ ID NO: 205296 - protein, 131 aa, Triticum aestivum
  unsure (1)..(131): unsure at all Xaa locations
  Clone ID: PAT_TA_99714.pep
MASSMITSPIVAPXSLPSLSRRGSSFAVLCSGGKKIKVDKPLGLGGGLTVDIDANGRKVGKXGVYQFVDKYGAKRXTXKTQXKXPGGMGLXSWXTGXTXGXKXTGXLIWGLQPXPGSXGGGVXLLKQRSPR

SEQ ID NO: 205297 - protein, 71 aa, Triticum aestivum
  unsure (1)..(71): unsure at all Xaa locations
  Clone ID: PAT_TA_99715.pep
KASRSSGKEDLPNVKTKCIXTRFVQNDSQTPTRKLDPIXLKTXKTVRWINXQXNNRAXXKRXVXLNGPXXP

SEQ ID NO: 205298 - protein, 88 aa, Triticum aestivum
  unsure (1)..(88): unsure at all Xaa locations
  Clone ID: PAT_TA_99716.pep
MGRVIRAQRKGAGSVFKSHTHHRKGPARFRSLDFGERNGYLKGVVTDVIHDPGRGAPLAKVTFRHPFRYKXXKELFVAAEGYVHRPIS

SEQ ID NO: 205299 - protein, 67 aa, Triticum aestivum
  unsure (1)..(67): unsure at all Xaa locations
  Clone ID: PAT_TA_99717.pep
MLVYQDKLSGDELLSDSFPYRELENGVLWEVDGHWVVQGAVDVDIGANPSAEXGGGDDEGCPMNQGR

SEQ ID NO: 205300 - protein, 119 aa, Triticum aestivum
  unsure (1)..(119): unsure at all Xaa locations
  Clone ID: PAT_TA_99718.pep
AHTLHINQTTFNSYPPNQTHQTTTIKMRFSTIATAVIAAGVANAQVDSIISRVTSAVGGVPSDIGSVVSSITSEHLAPGFCXQLTKXNARPXGXXNLXXXFQSKKRXPPLXSRTXESXG

SEQ ID NO: 205301 - protein, 104 aa, Triticum aestivum
  unsure (1)..(104): unsure at all Xaa locations
  Clone ID: PAT_TA_99719.pep
WGRAHNTVNLIFPLNLSALMASTTLFRLATRSIRPASFVRASSYAPRSSLPVRSSFAIANNFSTSAKLRSGHEGKRPTKEFSARYEKGNXXCRXXMFSXFQAXP

SEQ ID NO: 205302 - protein, 84 aa, Triticum aestivum
  Clone ID: PAT_TA_99720.pep
FDKETVKNELKAKKYKSKELELAIRQALDPSLNEENIKTTKRKGRTIKKEDDKREVGKKRLSMEIDLEETKRCKSIENESDDDY

SEQ ID NO: 205303 - protein, 92 aa, Triticum aestivum
  unsure (1)..(92): unsure at all Xaa locations
  Clone ID: PAT_TA_99721.pep
MVLQNDIDLLNPPAELEKLKHKKKRLVQSPNSFFMDVKXAKGCFNITTVFKPTXQNRWWXLPXGCQXGCSCKPNXXGKGKXXTKGXPPGKGE

SEQ ID NO: 205304 - protein, 84 aa, Triticum aestivum
  unsure (1)..(84): unsure at all Xaa locations
  Clone ID: PAT_TA_99722.pep
XAXLLKANSKFTTSSLINKSSSQTRAYADVTDGRQGALEEAITSILTNQNNEFEVSKELAFVTSTVKTEEDFAQAMRLASRVGG

SEQ ID NO: 205305 - protein, 97 aa, Triticum aestivum
  unsure (1)..(97): unsure at all Xaa locations
  Clone ID: PAT_TA_99723.pep
MKGTKLAAILILXSVLVMGLLSHVNADFFPXKCSNNCRSFSGVDVCDDAHPKCPQGLLXRXRVGVQRSPKCWRCAGXMXSNXXTGTWXGEPXKXSWR

SEQ ID NO: 205306 - protein, 84 aa, Triticum aestivum
  unsure (1)..(84): unsure at all Xaa locations
  Clone ID: PAT_TA_99724.pep
VKHVVDXHFQXXPYKSXRHPCETFETFXKEKILVHTESLCLNATSWLNFCPIPERGICFFRKPLRTYHWNRSQYVFLLKPQPSF

SEQ ID NO: 205307 - protein, 110 aa, Triticum aestivum
  Clone ID: PAT_TA_99725.pep
MKLIAAYLLAYLGGNSSPSAADVKNILDSVGAEADEEKLEFLLAELKGKGTSTRKLICILEREEVLPLLPFKGGVANWLWGSLQACLHPGWGRNNACSKKGGKFKKKNLI

SEQ ID NO: 205308 - protein, 65 aa, Triticum aestivum
  unsure (1)..(65): unsure at all Xaa locations
  Clone ID: PAT_TA_99726.pep
NFFSLRVXXTLIXSHWKILKLLLSKLFHSFTRTTQRTLGIRTIISKIIRHIRVFQRISTLRLEET

SEQ ID NO: 205309 - protein, 79 aa, Triticum aestivum
  Clone ID: PAT_TA_99727.pep
ASCPTLASAPFLPSLPSPNHRRLSLRYPARRLGVAASAAPKGAAASEAARERRRFLERYGLNPDDFEEDAEAGFQGKEE

SEQ ID NO: 205310 - protein, 68 aa, Triticum aestivum
  Clone ID: PAT_TA_99728.pep
VSHSSPISTFPSRSCALAMATSDRIEWGLSFGFLGCCWCLHYNLWWPLGLFPSVSQVFFNMGNQDFIS

SEQ ID NO: 205311 - protein, 84 aa, Triticum aestivum
  Clone ID: PAT_TA_99729.pep
MHPHLHTEEVQKNCADVVAALEECHNRGFIWKVTGNCTDAKYKVNMCLRGLRLEAEQSRIARRPREKEGRKITRKGVGKGVVKN

SEQ ID NO: 205312 - protein, 145 aa, Triticum aestivum
  unsure (1)..(145): unsure at all Xaa locations
  Clone ID: PAT_TA_99730.pep
VPIPETILCSKRAEARERRVTKLPSAASSSSPWSATSRRLTKIDQHQLSXVDLQTKRVVAXILGMYDSKSXPKTPXPSXSFLXWXNCXTGNQRLYLQSXMGRGNXIPKSKEWXWIXYGWKXFPXRSXKXLSXXTQRQXXIXXKNF

SEQ ID NO: 205313 - protein, 122 aa, Triticum aestivum
  Clone ID: PAT_TA_99731.pep
PPPPNPSARRIWHFARRRHPQPPFCHRRARRPAQHSARTALRTQAARWRHCTAPWQPVAPPIPSAEGYKDCTRGCQALIRVNRLQEVVSFPPHGALPKKDGDKGRSHLECWLMAAGWFRFNT

SEQ ID NO: 205314 - protein, 109 aa, Triticum aestivum
  Clone ID: PAT_TA_99732.pep
WVGQAKSSLQQSRVLMITWFSVLLHIRNVGSRGIHDGLEQIGLQRLFFFNLVGLGIGTKSGGRHLRFEQGLDFLHRLPWLRSLLSRGRVGGLRHFLKSACVPRAEFGTR

SEQ ID NO: 205315 - protein, 138 aa, Triticum aestivum
  unsure (1)..(138): unsure at all Xaa locations
  Clone ID: PAT_TA_99733.pep
QRSACPLKVLERIMSECTSKQKINTDLHGFLFCVKGLIDALYHLILNASQEEPQVVNYKKRVSGAETFIPLVQYVSRLKPVMHIVNPVGEDEGKDIPGGDKKKASASWLHSSKLCMISTXLGKCPQAILPIRHXRDIY

SEQ ID NO: 205316 - protein, 46 aa, Triticum aestivum
  unsure (1)..(46): unsure at all Xaa locations
  Clone ID: PAT_TA_99734.pep
LXPLSIXSFVSLLCFVLFASSYVPQSRNRNMVSALIYFEFFLNLII

SEQ ID NO: 205317 - protein, 102 aa, Triticum aestivum
  unsure (1)..(102): unsure at all Xaa locations
  Clone ID: PAT_TA_99735.pep
MAPTVMASSATSVAPFQGLKSTAGLPVSRRSSSAGLGSVSNGGRIRCMQVWPIEGIKKFETLSYLPPLSTEALLXKQVDYLIRSKWXVPCLEFXSKVGFGFP

SEQ ID NO: 205318 - protein, 109 aa, Triticum aestivum
  unsure (1)..(109): unsure at all Xaa locations
  Clone ID: PAT_TA_99736.pep
LAGVADSNHLTLLVVCSAAYPALYISKPPVWSDPTIVGPEAVPPSDGRCSPAQSPSDMVALTKCGLPQPSLQXNGGLWGIAQALRAGGEIPARVARCWEXGGRSGGMFV

SEQ ID NO: 205319 - protein, 119 aa, Triticum aestivum
  Clone ID: PAT_TA_99737.pep
VSEQRQPWLQQASGNRWLRLRWGATNPCRSVPARPVFRNLCSYPLFLFLFLREIPWLIGTRPSIQEVIVKKIYPGSLLYSFSVFQDVTKMFVFQDYEVNFLARLRCIFFFEIYNQEVGY

SEQ ID NO: 205320 - protein, 119 aa, Triticum aestivum
  unsure (1)..(119): unsure at all Xaa locations
  Clone ID: PAT_TA_99738.pep
GRFGCGPGKSVGIVGVGGLGHFGVLFAKALGADKVVGISRKAEKRDDVLKLGADAYIATDEDEDWAKHNANTLDLIICTVSXSAKMPLTGYLXMLKNHGDFVQVGAPXGVAPYQRHPAQ

SEQ ID NO: 205321 - protein, 119 aa, Triticum aestivum
  unsure (1)..(119): unsure at all Xaa locations
  Clone ID: PAT_TA_99739.pep
MADNDAPVTLRTRKFIRNPLLGRKQMVVDILXPGRANISKTELSEKLASLYKAQKEQVXVFGLRTQFGGGKTTGLRPHLRLPPRALKKFEPKYRLIGSGLXYKPRAXQXDNKRKAAQET

SEQ ID NO: 205322 - protein, 129 aa, Triticum aestivum
  unsure (1)..(129): unsure at all Xaa locations
  Clone ID: PAT_TA_99740.pep
MLGRGGAADGDPDCTEVLEDNSKSILMGIISQLRKDMDLHRVTLPTFVLEPRSMLERVTDFMSHPDLLLXASKKTDPTVRFLDVXVRYFLTGWHIKPKGVKKPYNPVLGEVLSMQISIIVMGTGSQYKA

SEQ ID NO: 205323 - protein, 97 aa, Triticum aestivum
  unsure (1)..(97): unsure at all Xaa locations
  Clone ID: PAT_TA_99741.pep
MASRATDDSPSSSGEESDAHDGASGGGIDRVPHLAKGLARYALSCEHSRRPIKRXDINERVLVQHTRLFKQVFAHANNQAHXVFGVQLVEAPXSGRK

SEQ ID NO: 205324 - protein, 70 aa, Triticum aestivum
  unsure (1)..(70): unsure at all Xaa locations
  Clone ID: PAT_TA_99742.pep
RVESIMSRQPRLDTSVRQQVYSYVETPIELSPPGFPPFKILETSPQSXPLSLMIKTSTTNPKSTGETPHX

SEQ ID NO: 205325 - protein, 112 aa, Triticum aestivum
  Clone ID: PAT_TA_99743.pep
MAPHATDDGNNMSSEAPMTNGETPTSKALSHLHSYPVVHDSVETFKSNPYGSRALNLANNTYQSIVAPFHPYLRTPYSYISPYLARADQLGDSGLSTLETHLPIVKGRHFKT

SEQ ID NO: 205326 - protein, 58 aa, Triticum aestivum
  Clone ID: PAT_TA_99744.pep
LHTQHNPVLTGSTKDKQLCKLYCSTESQKRFRRVFIAVQVCLADPFEISLVQIRYMIG

SEQ ID NO: 205327 - protein, 96 aa, Triticum aestivum
  Clone ID: PAT_TA_99745.pep
MKYSLFFVAALSLFQLGSAVDQKKSAIIWFDDASTPDSFVNQVKDNILKAGGKITHVYTIIKGFAVIAPEKALSTVQAMGSEHSIRVEEDEIVSSL

SEQ ID NO: 205328 - protein, 96 aa, Triticum aestivum
  unsure (1)..(96): unsure at all Xaa locations
  Clone ID: PAT_TA_99746.pep
MSWQKTVLKPGNGADMPAVGANVKIDYTGWLRDPSNPDHEKGKEFDSSKGRGPLATPIGRGRVIKGWDEGVLSMTLGEEAILTIDSSYXLWRQGFK

SEQ ID NO: 205329 - protein, 125 aa, Triticum aestivum
  Clone ID: PAT_TA_99747.pep
MAPTVMASSATSVAPFQGLKSTAGLPVSRRSNGASLGSVSNGGRIRCMQVWPIEGIKKFETLSYLPPLNTEALLKQVDYLIRSKWVPLPRSSSKGWGLIFPLKQQRNPPGVTNEAGLLGQVGSLA

SEQ ID NO: 205330 - protein, 103 aa, Triticum aestivum
  Clone ID: PAT_TA_99748.pep
NEIGKSSLNPSKTRRHHETTTLSIEDITTSFDTLDGNQSVPVSSAQYQESHSNYENNSARNQDPYTIRILAVARRCSRILLTFVLIQVILQFLVTVVCHLEVL

SEQ ID NO: 205331 - protein, 86 aa, Triticum aestivum
  unsure (1)..(86): unsure at all Xaa locations
  Clone ID: PAT_TA_99749.pep
FGSWFKXYLNFKSYLIVLNGIXTIEEWDCIKTCFPNNKKGSRIIVSTEKVEVASLCIGAEDEALVHKKLFVDRFLYAFYSKVILMS

SEQ ID NO: 205332 - protein, 108 aa, Triticum aestivum
  unsure (1)..(108): unsure at all Xaa locations
  Clone ID: PAT_TA_99750.pep
PEPYXXARXEXSXGAPGXPSGGXRVIGANVGAHRTRTTKSSXCRRXRAXXRPRVLPPPXVLSSLLAEAPELPSLPLLASMGDQLTAGRACLGRSSSELTRTLVPSRQW

SEQ ID NO: 205333 - protein, 138 aa, Triticum aestivum
  unsure (1)..(138): unsure at all Xaa locations
  Clone ID: PAT_TA_99751.pep
LSPPQLPRHPRHSCRFFSSPRPRQSSASSGSPPGARDRAIRGESTQNQEKFGTQVQSRDPPGETSGTIHIHLDSKQQEETRKPVERARSQAWIGHQMWYWISRACLSNLINAALGSPKMTRALSRKGPNRPEKRGGEX

SEQ ID NO: 205334 - protein, 118 aa, Triticum aestivum
  unsure (1)..(118): unsure at all Xaa locations
  Clone ID: PAT_TA_99752.pep
LVPNSARGTPHLRLCSIHHPNPSSPSSPAPFTLAPTTHHPETTWPDSLTEEQVSEFXGAPSLCLTMDGXGPNHXQXKLGQPLWRSAXAKNPSRVXAPRTLINXXGXXTTXGTMASQNF

SEQ ID NO: 205335 - protein, 138 aa, Triticum aestivum
  unsure (1)..(138): unsure at all Xaa locations
  Clone ID: PAT_TA_99753.pep
ANMCCLLIKAGEMSKQLNQVDQSISSINSDVSVAIMVCIAPHTKPLKLYQVPDGHGRSLQLDKRTRSVPHTISEVAIEIKVALDKVQRNKAKCNEIEKRVNGVNALLSXFGNKRTHEGTIHEGFNKKATIQPFAMLPH

SEQ ID NO: 205336 - protein, 103 aa, Triticum aestivum
  unsure (1)..(103): unsure at all Xaa locations
  Clone ID: PAT_TA_99754.pep
MATMKDEKLSFSEKQEKLAVHIRSVDMTEDMQQEAIEVATEAMEKFHMEKDIAQYIKKEFDSRKGATWHCIVGRNFGSFVTHETKHFIYFYLXHCAILLFKTQ

SEQ ID NO: 205337 - protein, 71 aa, Triticum aestivum
  unsure (1)..(71): unsure at all Xaa locations
  Clone ID: PAT_TA_99755.pep
MPSFIVTLKDDVADDQLAAAKQKAKDAGGKITXEYTLIKAFXVEYPEGTVHSLXEDPSVQTVEEDKEMRTQ

SEQ ID NO: 205338 - protein, 138 aa, Triticum aestivum
  unsure (1)..(138): unsure at all Xaa locations
  Clone ID: PAT_TA_99756.pep
MPKEKTTRKTKRAAGEGKRKKDPNAPKRGLSAYMFFANENRERVRDENPGIAFGALGRKLGELWKGLSDSERKPYEDKAAADKKRYEGQKGNYLAGGDDXEKSSQLFLLTFLPSEAQWERTKRGQESTKGRIFGFIRR

SEQ ID NO: 205339 - protein, 62 aa, Triticum aestivum
  Clone ID: PAT_TA_99757.pep
MGKVHGSLARAGKVKSQTPKVEPQEKKKTPKGRAKKRLTYTRRFVNVTMTGGKRKMNPNPTS

SEQ ID NO: 205340 - protein, 91 aa, Triticum aestivum
  unsure (1)..(91): unsure at all Xaa locations
  Clone ID: PAT_TA_99758.pep
MEFPHRHXHGHGRRDDDDEXRRAPAPYGRHEPDAXGAPPPSYGRRPDXDAGDAYXRHPPAAYGAPPPSYGGPPPYGGREDRPRPITPVPGL

SEQ ID NO: 205341 - protein, 122 aa, Triticum aestivum
  unsure (1)..(122): unsure at all Xaa locations
  Clone ID: PAT_TA_99759.pep
MGIDLDRHHVRSTHRKAPKSENVYLQLLVKLYRFLARRTDANFNKVVLRRLFMSRTNRPPVSLSRIVSNVTEEQKGKTVVVVGTVNDDNRMLTVPKLSIGALRFTANGRARXQXXGGENLNP

SEQ ID NO: 205342 - protein, 104 aa, Triticum aestivum
  unsure (1)..(104): unsure at all Xaa locations
  Clone ID: PAT_TA_99760.pep
CERHLYMLSGRQMLDRTCVHTAHMEFKEFNNLRFGMDVTWAINYSTSYLLSGQTFSDXWXALLRAINIRQXXKRGRXFLREXQXPPXAGXXMGQKGILGGXING

SEQ ID NO: 205343 - protein, 67 aa, Triticum aestivum
  unsure (1)..(67): unsure at all Xaa locations
  Clone ID: PAT_TA_99761.pep
NPQPISSPIDSRLVGSSSPTASRCKIFVKTLTGXTITLEVESSDTTDNVKAKXSKDKEGIPPDQASA

SEQ ID NO: 205344 - protein, 140 aa, Triticum aestivum
  unsure (1)..(140): unsure at all Xaa locations
  Clone ID: PAT_TA_99762.pep
MAPTVMASSATSVAPFQGLKSTAGLPVSRRSNGASLGSVSNGGRIRCMQVWPIEGIKKFETLSYLPPLNTXGLLKQVDYLIRSXWVXCLQVQQGWVYLPVEQNAXPWVLTMGGYWTMWELXXFGWNDAKQXDQTVGQKKG

SEQ ID NO: 205345 - protein, 132 aa, Triticum aestivum
  unsure (1)..(132): unsure at all Xaa locations
  Clone ID: PAT_TA_99763.pep
MAGRKGGDRKKAVTRSVKAGLQFPVGRIGRYLKKGRYAQRVGSGAPVYLAAVLEYLAAEVLELAGNAAKDNKKTRIIPRHLLLXVRNDQELGXLLXGVNIPHGXGDPQHQXPLLLPKEIRPPAAXRKEGKAQ

SEQ ID NO: 205346 - protein, 121 aa, Triticum aestivum
  unsure (1)..(121): unsure at all Xaa locations
  Clone ID: PAT_TA_99764.pep
PLXDRTFXLWLGAHGXXPPSLATXAWLNRNTTLGGCPVIVPLVAARYQLCVTSGLCTICGDGDGVSALLLTRTRPTFAINVVQFIPLIPPDKYKYATSRSICGSVYKLDHAADAPSFGTPP

SEQ ID NO: 205347 - protein, 146 aa, Triticum aestivum
  unsure (1)..(146): unsure at all Xaa locations
  Clone ID: PAT_TA_99765.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFNKXGFIFREQNASPGYYDXXRYWTMWELPXMFGCTDATKVINXXGXXKKGXPDAV

SEQ ID NO: 205348 - protein, 76 aa, Triticum aestivum
  unsure (1)..(76): unsure at all Xaa locations
  Clone ID: PAT_TA_99766.pep
VPPQTQQKPDQPLEGRIGSFSHSTDWPXDQTEAAQRNGETKHLWEESXWDDDDTSDDFSNQLKEELXKKVEAAKRR

SEQ ID NO: 205349 - protein, 154 aa, Triticum aestivum
  unsure (1)..(154): unsure at all Xaa locations
  Clone ID: PAT_TA_99767.pep
RICWTLRWQNIXGAIARXXTXXQPASQXRTPWDALRTQAKVAASRCARQVTNITSTAEQSRGMASEWGAATMPFHALHGRKPADARQREPKCKEFPCAALPLFVSYIPSVSSGNRAPGGMAWLRLRLRLLAAPAARCPPDRTTGPQRRQRRVSR

SEQ ID NO: 205350 - protein, 74 aa, Triticum aestivum
  Clone ID: PAT_TA_99768.pep
GCLSIEVKLVDCRAINKISQLTWKYVERQPEKFFQVQHTLLKPDGTCRATPANTFRKSTIILMYDQKENKNWEG

SEQ ID NO: 205351 - protein, 116 aa, Triticum aestivum
  unsure (1)..(116): unsure at all Xaa locations
  Clone ID: PAT_TA_99769.pep
MAPTVMASSATSVAPFQGLKSTAGLPVSRRSNGASLGSVSNGGRIRCMQVWPIEGIXKKFENLSYLPTVXKXGLLKQVDXLIRSKWVXCLXFXKGGFNFREQKXSPGYXYGRXWAM

SEQ ID NO: 205352 - protein, 74 aa, Triticum aestivum
  Clone ID: PAT_TA_99770.pep
GNLLSRLVPDLKYMDAAGVDRLSDLTDCLLHTILSRLEARQVVQTCVLSSRWRRLWLAVPCLDIDGGEDQRGGR

SEQ ID NO: 205353 - protein, 106 aa, Triticum aestivum
  unsure (1)..(106): unsure at all Xaa locations
  Clone ID: PAT_TA_99771.pep
MAGRKGGDRKKAVTRSVKAGLQFPVGRIGRYLKKGRYAQRVGSXAPVYLAAVLXYLAAEVLELXGXAAKDNKXNRIIPRXLVXAVRKRTXXSARXXRGGTIAQGGX

SEQ ID NO: 205354 - protein, 109 aa, Triticum aestivum
  unsure (1)..(109): unsure at all Xaa locations
  Clone ID: PAT_TA_99772.pep
MAPISKPEITSNIQWVAQMNVDVEPTHGRKTSIIGTIGPKTNSVDMITQLRNAGLNVVRMNFSHGSYEYHQSVIEXTRKSVEIYPGRPVAIAXLDNKGPEIRTGKIWKG

SEQ ID NO: 205355 - protein, 155 aa, Triticum aestivum
  unsure (1)..(155): unsure at all Xaa locations
  Clone ID: PAT_TA_99773.pep
THKQRRSLLSCLLPPPSLSAMKPPHFTGEAAAGASWAHEVKQALRDKLRWAPAAGTTGTGGHXAARPPTASSAVTAEPAAQPATVPDCRGLWXPPRTPSXGFMFLGPLGGQNXXRKKQXCTHRNGXMPCPGTLXNWQPPXQKXWXLXXIYNNXXX

SEQ ID NO: 205356 - protein, 188 aa, Triticum aestivum
  unsure (1)..(188): unsure at all Xaa locations
  Clone ID: PAT_TA_99774.pep
MAPTVMASSATSVAPFQGLKSTAGLPVSRRSNGASLGSVSNGGRIRCMQVWPIEGIKKFETLSYLPPLSTEALLKQVDYLIRSKWVXCLEFSXVGFIFREHNASPGYYDGRYWXTCGKLPMFGWNDATKVXXRRWRXAXKELPDAYXRIIGFXNXXKCXWVXXIASXQPGWKESGKGKLNHQRAKKCH

SEQ ID NO: 205357 - protein, 179 aa, Triticum aestivum
  unsure (1)..(179): unsure at all Xaa locations
  Clone ID: PAT_TA_99775.pep
MAGASPLLLLSFLLLVSMAVADQCHDDDHAALVAIDTAMGSPYHFASWTPDSACCDWYDVDCDADTGRVVGLRVYQDANMSGAIPDAIGNLTFLETLTLQHLPGVSGGIPESLATLXNLSELTISYTGVSGRSFLLRALNINLLDSPKPQRGIPRPSPSTSSPRTNSGNRLPGEPVLPK

SEQ ID NO: 205358 - protein, 91 aa, Triticum aestivum
  unsure (1)..(91): unsure at all Xaa locations
  Clone ID: PAT_TA_99776.pep
MFIARSEYDRGINNLXPRKAVCSKVEYSLEAIKLGSTAIGVATSEGVVLGVXKRVTSTLLETSSVEKIVEIDQQYWLCQCPVYKPDARFNE

SEQ ID NO: 205359 - protein, 154 aa, Triticum aestivum
  unsure (1)..(154): unsure at all Xaa locations
  Clone ID: PAT_TA_99777.pep
MSSSRVGLRFLANSRAAFRNFRQNVSNNSKGFRFQSTDASAAAAEQQSTFXKRMWNSPVGVKTVHFWAPVMKWXLVIAGISDLARPAEKLSLTKNXALMATGGIWTRWXSSIKPKXXVLGXVTSXCLNGVXQSXRXFIWXTNQXGXPLQGMMKK

SEQ ID NO: 205360 - protein, 174 aa, Triticum aestivum
  unsure (1)..(174): unsure at all Xaa locations
  Clone ID: PAT_TA_99778.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREXHNASPGYYDGRYWDNVGSXLCSGGTDAQXVINEVEESKKGYXPLVRNNGFXKNXQVXWXKFIAXXQPXWKPAK

SEQ ID NO: 205361 - protein, 54 aa, Triticum aestivum
  Clone ID: PAT_TA_99779.pep
CKTIGFGGNQHNPLGVTYHIYIYNEVVYNVTIYTCKYNLTPSLNLSHFLMNLEG

SEQ ID NO: 205362 - protein, 172 aa, Triticum aestivum
  unsure (1)..(172): unsure at all Xaa locations
  Clone ID: PAT_TA_99780.pep
MARTKQTARKSTGGKAPRKQLATKAARKSAPATGGVKKPHRFRPGTVALREIRKYQKSTELLIRKLPFQRLVREIAQDFKTDLRFQSSAVSGXLXRAAESXLVGLFEXDNNLCGIHAKRVTXMPKDXQLAXRIRGEXAKSVRLCYRRNGSRVKACLVSGKGVGSCLRPCATI

SEQ ID NO: 205363 - protein, 117 aa, Triticum aestivum
  unsure (1)..(117): unsure at all Xaa locations
  Clone ID: PAT_TA_99781.pep
MLDKLWDDVVAGPRPETGLDKLRRAAATQPLAINTAAGEAIKQSPSMPTTPTTPVTPSSSTPPRGGSVWRSVFXNPGSNLGNKKLGAXLXXRPQANSPTVYDWVLQRRRTTKEQPAL

SEQ ID NO: 205364 - protein, 134 aa, Triticum aestivum
  unsure (1)..(134): unsure at all Xaa locations
  Clone ID: PAT_TA_99782.pep
XVSVISRQFQEEAFPSVRTVDLSSGPSVFLHLGTHLTWKNEIAESPERGNQECKDLGRSXEVRASRDIPLSILSINPRIPALGPSLILLQHAYPWTSWKDLFIHWLQSHLLFQVSRPVHGIKPTNLQRSLHLKL

SEQ ID NO: 205365 - protein, 134 aa, Triticum aestivum
  unsure (1)..(134): unsure at all Xaa locations
  Clone ID: PAT_TA_99783.pep
GQHSGNGTFPVXLEAFVPTXLFFGYGSPSWHXTKLPYNSILKXDVDIRKXDXYGKVVLSXXTTMFPGIADRMQKELTALAPSTMKIKIIAPPERKYSVWIGGSILASLSTFQQMWISKEEYDESGPAIVHRKCF

SEQ ID NO: 205366 - protein, 79 aa, Triticum aestivum
  unsure (1)..(79): unsure at all Xaa locations
  Clone ID: PAT_TA_99784.pep
GVLDSRAQSIDFKPPAINNQLKTLHKPSIWFSQLTFSTPPRXXXPQAXAQXPXGQPPXLXXXRQVXRXXQQQQRLXASQ

SEQ ID NO: 205367 - protein, 132 aa, Triticum aestivum
  unsure (1)..(132): unsure at all Xaa locations
  Clone ID: PAT_TA_99785.pep
MQVFVKSLEGNTITLDVSSNTSIAVVKSLIEEREGLPVNSQCLSYAGKPLVEGELALYGIANNNTLHLNAELLGGGXKKRKKKTYTTPKXKXKHKRKKGKMGNLKYYXVDESGKITRPRRECPKRQPGAGGL

SEQ ID NO: 205368 - protein, 83 aa, Triticum aestivum
  Clone ID: PAT_TA_99786.pep
ISKQPPSPFPNPSPSIITLRKQSLLLCRTTFANYWVTPVSINKIAMMLLCPIDADGFGGRRGISNWGSYSCSSGKIGHEEGDG

SEQ ID NO: 205369 - protein, 123 aa, Triticum aestivum
  Clone ID: PAT_TA_99787.pep
KAVEQHRDDSVLQIQTNRKLSLEQICGNLVPRHLYTQHTGSCNQGTPWPWIRAKAATLDSGVSPVSESAQPPSLGLPPLLLGRWCAPDSSSTGWSSTHTDKIGLPAAMLDLSPRRRIDVAAER

SEQ ID NO: 205370 - protein, 104 aa, Triticum aestivum
  unsure (1)..(104): unsure at all Xaa locations
  Clone ID: PAT_TA_99788.pep
MAEQIPTFKLVLVGDGXTGKTTFVKRHLTGEFEKKYIATLGVEVHPLGFTTNLGAIQFDVWDTAGQEKFGGLXDGXYYINGQCGIIKFDVTSXITYXNVPNWAT

SEQ ID NO: 205371 - protein, 75 aa, Triticum aestivum
  unsure (1)..(75): unsure at all Xaa locations
  Clone ID: PAT_TA_99789.pep
PRARETALLIREMFGYARDHQLLFXPCIIFMDEIDAIGERRFSEGTSDDREIQRTLMGLLIRLDGFHDLGKIKLV

SEQ ID NO: 205372 - protein, 97 aa, Triticum aestivum
  unsure (1)..(97): unsure at all Xaa locations
  Clone ID: PAT_TA_99790.pep
GLSSLMLTLWDMLHAPNADELLRDLAIMVSQAWVLRLPXPIQPQAIADEKLLCHRIGXIXTGAYNSCRXYPTXFSTRXXVXRPXXPXLKXMXQXRXN

SEQ ID NO: 205373 - protein, 112 aa, Triticum aestivum
  unsure (1)..(112): unsure at all Xaa locations
  Clone ID: PAT_TA_99791.pep
PTCLGLRTLWAMPAGSQPTVLLMIYSTLLLCRKFPNPRKLYLAATSITIPXQIXRQHTAPNQLGRLRCLGMMEFKDTYNXVGNTKXCPXSSXXCIPAXEXPRRWQTFWYXAK

SEQ ID NO: 205374 - protein, 150 aa, Triticum aestivum
  unsure (1)..(150): unsure at all Xaa locations
  Clone ID: PAT_TA_99792.pep
RLHPTHPPLFSSASVTHGRVRGAARQAPWLILPMGMQLCPRERATRPTGPCSSAHGTDXFPXNSRLDGDATCSSAAIWLRCSAPLWAVLWACARPPPSRRAQLLSFAGPGRTVATLSLLCGFLHNMQRGSNRFPGRRENGPPQWLSXAFX

SEQ ID NO: 205375 - protein, 124 aa, Triticum aestivum
  unsure (1)..(124): unsure at all Xaa locations
  Clone ID: PAT_TA_99793.pep
DDIDRAKHHGVDAMSTDDLKKLNKNKKLIKKLAKKYDAFVASDALIKQIPRLLGPGLSKAGKFPTPVSHAEDLANKMNEVKSTIKFQLKKVLCMGVAXGNVGMTEDXLIGNIMLGHQTTSVLAS

SEQ ID NO: 205376 - protein, 136 aa, Triticum aestivum
  unsure (1)..(136): unsure at all Xaa locations
  Clone ID: PAT_TA_99794.pep
MKALILVGGFGTRLRPXTLTSQNLWAKFGNRPMILQQRLRSLAAAGXVTEIVLAVNYRPDINGRXLXXYXEQYNIIIXFXADXXPLGTAGPLKLEXKSPGKXDXPIFXLNPTSXGIXFKKLVDLXSXXXKGNXSPR

SEQ ID NO: 205377 - protein, 125 aa, Triticum aestivum
  unsure (1)..(125): unsure at all Xaa locations
  Clone ID: PAT_TA_99795.pep
MVADALVYHPSVAHYLRFLATTLGRDKALRTIQYFARFYAWYLFRTNNPTSAIAPWDALKKQFGXTRKILRAGKFVEHIKAASVAFDNKSXPPDAVLKNLTVGRHXGYAGYXTLDSNTLVDXVGI

SEQ ID NO: 205378 - protein, 192 aa, Triticum aestivum
  unsure (1)..(192): unsure at all Xaa locations
  Clone ID: PAT_TA_99796.pep
MAPTVMASSATSVAPFQGLKSTAGLPVSRRSNGASLGSVSNGGRIRCMQVWPIEGIKKFETLSYLPPLSTEALLKXVDYLIRSKWVPXCLEFNKVXGFIFREAQTQSLGYYDGXYWTMWKLLCSVQPTQKKLINEXXEVXKEYPDPLSAIIGFXKMRKXKWVNLTXXKPPGXKDXGXAKSPKGNKGIDFLNN

SEQ ID NO: 205379 - protein, 146 aa, Triticum aestivum
  unsure (1)..(146): unsure at all Xaa locations
  Clone ID: PAT_TA_99797.pep
SCFVWNYRERSVQMWLIKFYTSNPVLHKKIQSVHRFIVLCCIPGLGVVRAAEFFLGFGFGCTCKILXMVNTLVMLLSXXGKGPKLTSSYDRLGKXKXEAXRXGGQQPXMSREPVPTGLKDEKXRTXGATTXXSGKXGXXPXNPPGQ

SEQ ID NO: 205380 - protein, 112 aa, Triticum aestivum
  unsure (1)..(112): unsure at all Xaa locations
  Clone ID: PAT_TA_99798.pep
LSLPSIQSTPAPTPPRLSAPRPRWPPPRPPXHXLAXRPRPPSRRLPSHPSPRLTSATLPRRPRRPPVPAPSLVAPVGRWPRPRCPRRPPAPSLSASSDAKPAPFRFGPAEKP

SEQ ID NO: 205381 - protein, 169 aa, Triticum aestivum
  unsure (1)..(169): unsure at all Xaa locations
  Clone ID: PAT_TA_99799.pep
ELFGTTGSVTITKEDTIILNGAGSKDSIAQRCEQIRGAIEDPSTSEYEKEKLQERLAKLSGXGVAVIXVGGSSEXVEVGEKKDXRFDDALCATRAAVEEXXIXPGGGVAPFEGRQXXLITLKGXNFDXXLRYQYPSKPIQKPLSYQLLINAGGKVLAGKIFKTPLKNRG

SEQ ID NO: 205382 - protein, 89 aa, Triticum aestivum
  unsure (1)..(89): unsure at all Xaa locations
  Clone ID: PAT_TA_99800.pep
ETVAEFSPKEXALFLRFVSGRERLATSKSQNAFTVTRLHGSTDALPQSATCFFTLKLPAYASREVLKHKLLLAICNCASIDADFQVRQQ

SEQ ID NO: 205383 - protein, 171 aa, Triticum aestivum
  Clone ID: PAT_TA_99801.pep
SSLSHWHSSCSAWPWRSARAWTWASATSAHRRTWATSRHRPVLATPALRPRLMVAPQPPPRASPPLPTPPPAPQRPRPPPVKRPLPERTRQSPTSPSLNRPPPRWPAVVKSGNAIPTVDYCGGQRGPGHRGLYARQRTTFRGWQRQQRTTSSVAAKNVQRSQQLFGAPFLN

SEQ ID NO: 205384 - protein, 150 aa, Triticum aestivum
  unsure (1)..(150): unsure at all Xaa locations
  Clone ID: PAT_TA_99802.pep
MGHSHGLRAGTRYAFSRDFKKKGSIPLSTYLKEYRVGDIVDVKCNGAVQQGLPYKYYHGKTGVVYNVTKSAVGVIIYKRVGNRYLEKRLNVRVEHVAHSRSREEFINRVKENAIKKRQAKEQGTHLHLKRXAVQPRDAXVVASADKIPRN

SEQ ID NO: 205385 - protein, 58 aa, Triticum aestivum
  unsure (1)..(58): unsure at all Xaa locations
  Clone ID: PAT_TA_99803.pep
XAYXRNRTGSTFYXQIXXVXXVLLTVWLLSAAVVFVNECCCXTXLLXXNXITXLLILP

SEQ ID NO: 205386 - protein, 133 aa, Triticum aestivum
  Clone ID: PAT_TA_99804.pep
LYRHDNGWYAALAPMVSTMVADACFSARPSDIVIATMPKSGTTWIKAMLYSTVHRREHPADGPDHPLNSLGPHECVKLLEYQLYIRNRIPNLDGLPDPRLFAAHAPLVSLPRSVMRMGCKIVYVCRDPKDALI

SEQ ID NO: 205387 - protein, 80 aa, Triticum aestivum
  unsure (1)..(80): unsure at all Xaa locations
  Clone ID: PAT_TA_99805.pep
FXFFXFFXFFFFDQNPGPPYELGSNLIIHPCIIAITSMHTLIFYRGKCKHQKHCTALPSVQSHDMYKPFSIATFFLCRMI

SEQ ID NO: 205388 - protein, 91 aa, Triticum aestivum
  Clone ID: PAT_TA_99806.pep
SSLPSNTILQAFENFFDTLDTTPVGMTNKTRDYGDLRVTLTKDLVWKWNEKGTGAARYGEFYLANSQGAMRPVGSFGQDKWDDRKIRELRS

SEQ ID NO: 205389 - protein, 36 aa, Triticum aestivum
  Clone ID: PAT_TA_99807.pep
VLGLFLVPTYKSEVPKKSVPVWSLELISPYMTILQL

SEQ ID NO: 205390 - protein, 89 aa, Triticum aestivum
  Clone ID: PAT_TA_99808.pep
PRAEFGTREILITAEEGSIGGFGSHVAHYLSLNGLLDGPLKLRSMFLPDRYIDHGAAEDQMEAAGLTPRHIAATVLSLVGRPVEALRLK

SEQ ID NO: 205391 - protein, 79 aa, Triticum aestivum
  unsure (1)..(79): unsure at all Xaa locations
  Clone ID: PAT_TA_99809.pep
ADPPQETIDYGTDXXXHGHGGDGDXVEWXXVXELREVVXAXDPSAKEXXDFAXPXFLRARDQNTTADAPPSRRRHHRRS

SEQ ID NO: 205392 - protein, 82 aa, Triticum aestivum
  Clone ID: PAT_TA_99810.pep
MGNALGCAGLGERLAAAARDGDAAEVRRLLAADPGLARCTATFGNLSSPLHRAARGRPPEHGRQRQPALRVRALPPPRQPGG

SEQ ID NO: 205393 - protein, 105 aa, Triticum aestivum
  unsure (1)..(105): unsure at all Xaa locations
  Clone ID: PAT_TA_99811.pep
LIPGTQSPDLERQSSNVYTNSVPMDPLTSAIAIXTLSAHSCXQXFNLISXLTNAPQSITHTRQLXMQXDECLISAGTIIGEQXDXKRSLLGLATEQFGQGPQIDA

SEQ ID NO: 205394 - protein, 145 aa, Triticum aestivum
  unsure (1)..(145): unsure at all Xaa locations
  Clone ID: PAT_TA_99812.pep
EDLKRGFVASNSKDDPAKEAANFTSQVIIMNHPGQIGNGYAPVLDCHTSHIAVKFAELVTKIDRRSGKEXLEALPKFLKNGDAGIVKMIPTKPMVVETFANXPPLGRFAVRDMRQTVAVGXVIKGVEKKDPTGXAKGTKAAIKKK

SEQ ID NO: 205395 - protein, 128 aa, Triticum aestivum
  unsure (1)..(128): unsure at all Xaa locations
  Clone ID: PAT_TA_99813.pep
MAPTVMASSATSVAPFQGLKSTAGLPVSRRSNGASLGSVSNGGRIRCMQVWPIEGIXKKFETLSXLXNGXRXEGLLKXGPTNLXRLQVGCLAXSSTRVGFNFREQNATPGYYDGRXWXMWKXPVPDGP

SEQ ID NO: 205396 - protein, 95 aa, Triticum aestivum
  unsure (1)..(95): unsure at all Xaa locations
  Clone ID: PAT_TA_99814.pep
RRRRPRWRRPSPPRRLPRQRRSPRRRRPKSRRLPPSRLRRPRRRHRPPPRRRRPRRPSQQLPXRDGGRGAQRAXRGRRQRPRXAWQRXSRQSSRR

SEQ ID NO: 205397 - protein, 80 aa, Triticum aestivum
  Clone ID: PAT_TA_99815.pep
NKSPEKATNRQPNRGESFSVCNNMNRSTADESASPKSAKILSDLNHHKLSPLSYTSKIDEWINRNTWMWLRKKSRQIAAS

SEQ ID NO: 205398 - protein, 132 aa, Triticum aestivum
  unsure (1)..(132): unsure at all Xaa locations
  Clone ID: PAT_TA_99816.pep
AAAAVYPPLDQRPVKNTVLLFDVDDTLTKPRQLVSPEMLQMLSELRHKVAIGFVGGSNLAKQQEQLGGAVDVTSLFDYCFAENGLTAIRMGETLASQSFIAWIGEDKYKALXKWILHYIADLDXPIKRGTFN

SEQ ID NO: 205399 - protein, 36 aa, Triticum aestivum
  Clone ID: PAT_TA_99817.pep
ECWIALTVSACGGASRAQILLRLAVAKRRRRTVSVG

SEQ ID NO: 205400 - protein, 141 aa, Triticum aestivum
  unsure (1)..(141): unsure at all Xaa locations
  Clone ID: PAT_TA_99818.pep
KRRTFHQPLHARQGDGPHGRLGGVGQAVEHDEPSRAQPSTGLHYTLLGRVGLVRCWRGSNELGACQHAPRPRKEGVPGDGLHLHDRQRLHLGQRPCGTCKEANNVKHLVXGGIIKTXXWTGGGRKDSCPXNWRQPPGXLLH

SEQ ID NO: 205401 - protein, 95 aa, Triticum aestivum
  unsure (1)..(95): unsure at all Xaa locations
  Clone ID: PAT_TA_99819.pep
GGXRQSSXCFERMXLKPSSEIFXDVXSNFVGGPAVTVVGVGSVXNGPLVXVGLDVLTVVXAAGGLGLVRTVGGAGSGLGLLSLLGGSRXLRGVGR

SEQ ID NO: 205402 - protein, 136 aa, Triticum aestivum
  unsure (1)..(136): unsure at all Xaa locations
  Clone ID: PAT_TA_99820.pep
NRVSGKKLGEFSRVSCDQSSGVGMEFEMASQHGALLKVGLFVLVQALVYLILAQVLLRLLHHQDPRXPAGALPQAXGRXGRTALRPAARGGNPRPARSPXNRXPPFPXNPNKKKVXXQSWEXGNXQPTERMHVVGS

SEQ ID NO: 205403 - protein, 126 aa, Triticum aestivum
  unsure (1)..(126): unsure at all Xaa locations
  Clone ID: PAT_TA_99821.pep
MQIFVKTLTGKTITLEVESSDTIDNVKAKIQDKEGIPPDQQRLIFAGKQLEDGRTLADYNIQKESTLHLVLRLRGGMQXIFVKTLTGKTITLEVESSDTIDNVKXKIQDKXGNPXGQTXAQSSGKF

SEQ ID NO: 205404 - protein, 117 aa, Triticum aestivum
  unsure (1)..(117): unsure at all Xaa locations
  Clone ID: PAT_TA_99822.pep
FTLNSLASCHSFRPIQNTNNIIDCYHNGIPPCFISSCIRHRIRTRQQIRSLWWRCRLIWLSRQPSFNNLLPRGGPRTALRRRGCWRTKKKXLALWANXNXTRXCWVAGGSSGTKLKL

SEQ ID NO: 205405 - protein, 142 aa, Triticum aestivum
  unsure (1)..(142): unsure at all Xaa locations
  Clone ID: PAT_TA_99823.pep
WPDDAVVFTLXTLPVLELRGAIPAGYWMRLHPVRLTVLAVLGNMVPVPFIILYLKKLATFLSQRSAWATRIMDLLFERARRKAAPVEEFQXWLGLMLFAAVPFPSNGSXAGNIIASVXLGMPFWAXLSANFNGKWFLAGVAG

SEQ ID NO: 205406 - protein, 129 aa, Triticum aestivum
  unsure (1)..(129): unsure at all Xaa locations
  Clone ID: PAT_TA_99824.pep
MAPTVMASSATSVAPFQGLKSTAGLPVSRRSNGASLGSVSNGGRIRCMQVWPIEGIKKFETLSYLPPLSTEALLKQVDYLIRSKWVPLLEXFSKVGFIFREQNASPGYXDXRYWDNVGKLANVPVAPTP

SEQ ID NO: 205407 - protein, 124 aa, Triticum aestivum
  unsure (1)..(124): unsure at all Xaa locations
  Clone ID: PAT_TA_99825.pep
MSTSITLSDGRKLAYDLRGPKDAPIILLSNSLLTDYSLWDYFVEDPTFREFRFLRYNQCGHGGSSAPEDPNHTTFATLADDVTELLKDLDIQKLYAWIGISMGAGEXVVTLVTPESPGGGKRLG

SEQ ID NO: 205408 - protein, 123 aa, Triticum aestivum
  unsure (1)..(123): unsure at all Xaa locations
  Clone ID: PAT_TA_99826.pep
MDASKLKKVAGKKFGGPRKKSVTRSVKAGLQFPVGRIGRFLKKGRYAQRVGSGAPVYLAAVLEYLAAEVLELAGNAAKDNKKTRIVPKHLLLAIRNEQEXLGRLLSGVNIAQGXVIPKSNPXV

SEQ ID NO: 205409 - protein, 115 aa, Triticum aestivum
  unsure (1)..(115): unsure at all Xaa locations
  Clone ID: PAT_TA_99827.pep
MGVIEKLSRKSGVIVGDDVLRLFQYAQEKKFAIPAINVTSSSTVVASLEAARDXKKSPIILQMSQGGAAYFAGKGVANPNQEASIAGANGRCSNPQSPPPKGIPVGSLKRTMGAK

SEQ ID NO: 205410 - protein, 121 aa, Triticum aestivum
  unsure (1)..(121): unsure at all Xaa locations
  Clone ID: PAT_TA_99828.pep
MAGRKGGDRKKAVTRSVKAGLQFPVGRIGRYLKKGRYAQAXVGSGAPVYLAAVLEYLAAKVLELAGNAGKDKKERTASSRANWLLAVRNEQGSSGKGWLRRASTNRPNGGGLIPQTIKLPW

SEQ ID NO: 205411 - protein, 100 aa, Triticum aestivum
  unsure (1)..(100): unsure at all Xaa locations
  Clone ID: PAT_TA_99829.pep
MDFSDIFRMVNFAVAVFVVLGGIAKLFPFNDFSHIILGVYLIIFGLGTALLEFQXFPKQVARYASFMFSFLXXXIFYIFNGSVNGGEAVVSQWWQSNWPE

SEQ ID NO: 205412 - protein, 139 aa, Triticum aestivum
  unsure (1)..(139): unsure at all Xaa locations
  Clone ID: PAT_TA_99830.pep
RDHIHATSRAYHQTSRVPVSRRAITAAMSGAVAKGKKQVNKNAYRRAKKKQQRSETPSETADSARESESPAPESDSNNEAQAVKPANLLTVDDIANQYDLDDPAFEEYKSVFEKFREPTEEEAATKDXEKPKIYLSDDD

SEQ ID NO: 205413 - protein, 115 aa, Triticum aestivum
  unsure (1)..(115): unsure at all Xaa locations
  Clone ID: PAT_TA_99831.pep
MXRGGSAGGGQSSLGYLFGDGEPAKPAAAPXAAKPAPAEKPAPAAADVAKQIPXAGIPGSRANNYYRANXQNTGNFLTDRPLNKVQAAPGGGSSLGYFVWVMLMDAGLMNERMLA

SEQ ID NO: 205414 - protein, 113 aa, Triticum aestivum
  unsure (1)..(113): unsure at all Xaa locations
  Clone ID: PAT_TA_99832.pep
LKLFGFHFSSAEEENHTTMDTPEHEAAEPEKGGSDSSSSSTTTTTATAAAAAGGGGGEGRRYECQYCCREFANSQALGGHQXNAHKKERQQLKRAQLQAAAAAAGRAAGGSAL

SEQ ID NO: 205415 - protein, 78 aa, Triticum aestivum
  Clone ID: PAT_TA_99833.pep
MDEHKTSPESLLFVFLRARDDNSLEVDFGALDLSTPHLTPPSSIGNGMQFVSRIMSWKLSGKPESMKPLLDYPGEASN

SEQ ID NO: 205416 - protein, 116 aa, Triticum aestivum
  Clone ID: PAT_TA_99834.pep
CSVRKLYQAWSSYSPSGRVGGGVLGHYGTTSYVAHHPVRKILPLVAMISGHCIPDRVLLPLDEGMPFVLCTERRPLEVHMRKSYGIGSFCLKIGNIIDSCRNGGARKNIRQAREYN

SEQ ID NO: 205417 - protein, 121 aa, Triticum aestivum
  unsure (1)..(121): unsure at all Xaa locations
  Clone ID: PAT_TA_99835.pep
MAPTVMXSSATSVAPFQGLKSTAGLPVSNGXRXRCMQVWPIEGIXKFXTLSYLPPLXTXALLXQVDYLIRSKWVPCLEFSKXGFIFRXHXASPGYYDXRYWTMWXLPMFGXTDATQVXXRS

SEQ ID NO: 205418 - protein, 83 aa, Triticum aestivum
  Clone ID: PAT_TA_99836.pep
DLSKLSRPYSPSGQTCISFHFDWSFHRRIHHETAKPSCNSDGLVPRYRAGDLSSSSSLKEPCSYALILDLLGKGEDTAKHEMG

SEQ ID NO: 205419 - protein, 127 aa, Triticum aestivum
  unsure (1)..(127): unsure at all Xaa locations
  Clone ID: PAT_TA_99837.pep
LHTVCLSFILAANKLPVPNLQNISATNPALFHQATLELKTLYLSPITMTSEVNPTQYSQSLQSPTAIPPRTKLQRRRKCHATKLVPGLXGLSSEKRMGVLXQXXKGLEQKRANNGPGTXQXWXGXKG

SEQ ID NO: 205420 - protein, 109 aa, Triticum aestivum
  unsure (1)..(109): unsure at all Xaa locations
  Clone ID: PAT_TA_99838.pep
MASATTFYDFSPPDKKGNPYPLTNYKGKVVLVVNTASKCGFTPQFDGLEKLYKSIEAKHPGAFTILGFPCNQFGNXDPGSNDEIQXFCQVNYGVTFPVLGKDLMLMGVM

SEQ ID NO: 205421 - protein, 92 aa, Triticum aestivum
  Clone ID: PAT_TA_99839.pep
ANNTKTQSHRRLYDGRETRIVLRHPYPEKGIGRKEDGCRNSKEGRQDQHGLGRSPGRHVLLRMRWHHLSLSHQHFISFSYTSTAPRAEFGTR

SEQ ID NO: 205422 - protein, 125 aa, Triticum aestivum
  unsure (1)..(125): unsure at all Xaa locations
  Clone ID: PAT_TA_99840.pep
MARTKQTARKSTGGKAPRKQXLATKAARKSAPATGGVKKPHRFRPXTVALREIRKYQKXSTELLIRKAPLPXXLVRGDXPRXSRTXLRFXSSAVSGPAXRAARVLTRXXSSEENKLXAIQSQSGN

SEQ ID NO: 205423 - protein, 104 aa, Triticum aestivum
  Clone ID: PAT_TA_99841.pep
GDNTLYSVANMTFNPSKRQALGRSFVARDSVAATQSTFFGTKAPAEVTQLALLLPNTDQATFIKLLKFVLEYIKGTEITEQHWTKLKESVEETTTTTTNNNTSR

SEQ ID NO: 205424 - protein, 89 aa, Triticum aestivum
  Clone ID: PAT_TA_99842.pep
MSDTDEHHFESKADSGASKTYPQQAGAIRKGGHIVIKARPCKVVEVSTSKTGKHGHAKCHFVAIDIFNGKRSFEGYRSFIPKTGDVPHV

SEQ ID NO: 205425 - protein, 143 aa, Triticum aestivum
  unsure (1)..(143): unsure at all Xaa locations
  Clone ID: PAT_TA_99843.pep
MKGHFFKHFSRDVAQRQALFRSLTTNLIKHDKITTTIVKAKQLRTFIXKMVTLSKKNSEHAQNQIRSYLYEXEAVQKGLFKPFPRNDSREXKKGXYTSIWKRFVGNKKKDCQMGPFLLGGKRAPNFFGKGKRRKKNFTPKQGF

SEQ ID NO: 205426 - protein, 77 aa, Triticum aestivum
  unsure (1)..(77): unsure at all Xaa locations
  Clone ID: PAT_TA_99844.pep
MSCNCGSGCSCGSDCKCGKVYPDLTEQGXSAAAQVAAVVVLGVAPENKAGQXFEVAAGQSGEGCSCGDNCKCNPCNC

SEQ ID NO: 205427 - protein, 127 aa, Triticum aestivum
  unsure (1)..(127): unsure at all Xaa locations
  Clone ID: PAT_TA_99845.pep
LFCPTGPPCHLRSRGPLLAHRDVYHRLPDLEVQLQRIPQRPLPGNHPIRTVRLHLDPVLQHRLPGHLPHREXQNFMSSDXFPTVVXXPQQLGXXWGRLXRNQLGAKAQXGPRKGGXPXXNLSAXGTK

SEQ ID NO: 205428 - protein, 146 aa, Triticum aestivum
  unsure (1)..(146): unsure at all Xaa locations
  Clone ID: PAT_TA_99846.pep
ASCRIRHEAHLLCPRTLASHSMLHQTLIPSSLAFSASASPSPDPLPFASKAAAAPPPRPPFAPQAMPSYAATXQALWTKXMXALKXTKRKEXXSDQGAXEXXAGWGFAEKXXFSVEGPAGPXRSSANPIRNGADXPRRKLPAAPVK

SEQ ID NO: 205429 - protein, 48 aa, Triticum aestivum
  Clone ID: PAT_TA_99847.pep
FFFFFFFFFFLGRYSHIYTMILRSDESHLNCKYIRFCLNRKFIASYFF

SEQ ID NO: 205430 - protein, 101 aa, Triticum aestivum
  unsure (1)..(101): unsure at all Xaa locations
  Clone ID: PAT_TA_99848.pep
MGLTFSKLFDKLWGKKEMRILMVGLDAAGKTTILYKLKLGEIVTTIPXIGFNVETVEYXEHPSSPLWGMSGGKDKSVLRWEGNYSKKNQRSTFRPRNGFAN

SEQ ID NO: 205431 - protein, 90 aa, Triticum aestivum
  unsure (1)..(90): unsure at all Xaa locations
  Clone ID: PAT_TA_99849.pep
LXPIVGSIGLRRMARPKFCVSHLGNHGWRLALHFKKSSSSSSVRQVARVSAPWLGERCLRLAGSPSWKPRFLFILICSFYEVYIEQNREE

SEQ ID NO: 205432 - protein, 104 aa, Triticum aestivum
  Clone ID: PAT_TA_99850.pep
PSRRLPFSRSSPTPPRTAPAAASSSSPNAVTVAPPAPPLFAGAPPAPPLFAGAPPTPSLFAAAPPAPPNVRKPPNGSSGQSSTWSLVREPNIAKIKYGFQCQIF

SEQ ID NO: 205433 - protein, 114 aa, Triticum aestivum
  unsure (1)..(114): unsure at all Xaa locations
  Clone ID: PAT_TA_99851.pep
LIATHSHTLTXXLFNVTLKESAPPSELEKAKEKARAEGGTIKHEYTLIKGFTVEYPXDHVXVLESNEQSPRSKXXPERXSIPGNPGRLNSKGGPQRNPKLSWGTHSPGLAVRQL

SEQ ID NO: 205434 - protein, 134 aa, Triticum aestivum
  unsure (1)..(134): unsure at all Xaa locations
  Clone ID: PAT_TA_99852.pep
FASVTSRIALQTRSTLAQRFYTTGAGVNTLLYVEHKDGAISGATLNALTAAKKLGXQVTALVAGDAPEGVAQQVAKLEGISKVLSAKNTAYANSLPEDIAPLLVEAQSKFGFTHLGDKTLLSGKEHFPLRAGCF

SEQ ID NO: 205435 - protein, 54 aa, Triticum aestivum
  unsure (1)..(54): unsure at all Xaa locations
  Clone ID: PAT_TA_99853.pep
XVRKXSRPIPAPWQTELLMITAETTTNSAICRSTIQTGXCGQXRHCXSIWXXCX

SEQ ID NO: 205436 - protein, 135 aa, Triticum aestivum
  unsure (1)..(135): unsure at all Xaa locations
  Clone ID: PAT_TA_99854.pep
ANGLSPIPKPPQIPNPXAREQTXEFFLKSLRRAASNPPTTIPQSIRWVDGRSRGSGRIPQSQEGRQAEKLQLEVKSKQERTRWKKSTEQAEYFCLGEGDAWRQINEQQLARRRRGGEGKRKVWEWGKGRYSSSSS

SEQ ID NO: 205437 - protein, 80 aa, Triticum aestivum
  unsure (1)..(80): unsure at all Xaa locations
  Clone ID: PAT_TA_99855.pep
MSCCGGNCGCGTACKCGNGCGGCNMYPEVEAAGATLLVSATATHKASSGGMEMAAENGGCGCTQXCKCGTXSCGCSCCSC

SEQ ID NO: 205438 - protein, 114 aa, Triticum aestivum
  unsure (1)..(114): unsure at all Xaa locations
  Clone ID: PAT_TA_99856.pep
HXXCFSSKRRSVQKHALQKICFPLFIYIXPAXSXPRXSSLKPDFLRLISMXCTMRSXFXVPRLSSPXGXMEXLARXSXPLVXGTRPSSKXQSHPSALCLXGSGGGPGTQFRPYS

SEQ ID NO: 205439 - protein, 116 aa, Triticum aestivum
  unsure (1)..(116): unsure at all Xaa locations
  Clone ID: PAT_TA_99857.pep
DTGDIVFDLNFTDVSVRTFMYNAWIRSGGDIMYGVQANASRNILADDEQIEAQISVSESDWKPNIYXGNATGDMRDYHTKWLERFVWPTFNISGKLNXFATTNVFAPWEKQIIXXQ

SEQ ID NO: 205440 - protein, 132 aa, Triticum aestivum
  unsure (1)..(132): unsure at all Xaa locations
  Clone ID: PAT_TA_99858.pep
NQGPELRASHPCIRTNPVTGWKSLFAFGHHLEEFEGLGDVENRMMKEFVQRLVTENHQLQARVRWEQDDLXIWDNRAVYHKRYLRLRWVLPVASASVTRVCGVRNPLLGFSALRGAPICLWAMDYLALENWD

SEQ ID NO: 205441 - protein, 101 aa, Triticum aestivum
  unsure (1)..(101): unsure at all Xaa locations
  Clone ID: PAT_TA_99859.pep
MAPTVMASSATSVAPFQGLKSTAGLPVSRRSNGASLGSVSNGGRIRCMQVWPIEGIKKFETLSYLPPLSTEALLKQVDYLIRSKXWVPCLEVQQRSGFIFR

SEQ ID NO: 205442 - protein, 94 aa, Triticum aestivum
  unsure (1)..(94): unsure at all Xaa locations
  Clone ID: PAT_TA_99860.pep
MPGVLETSPIQTPTSVTMALPIQTSTNVTMALPTQTSTSVTMALPTQTSTSVMMALPTQXTPTSVTPALPIQTPTSVTPALPTQTPTSVTMALL

SEQ ID NO: 205443 - protein, 153 aa, Triticum aestivum
  unsure (1)..(153): unsure at all Xaa locations
  Clone ID: PAT_TA_99861.pep
LLSTRLPTLLPAPLLSTPLTPSRAPLLPLTRLPPPLPLTRLPLRLPLTLLRPPRPPTRLPSLPTRPLPRPLPTRLPSPLRPTRPTPTTRLSTPTSYVCPEXNVNQPRAPSNLTTISNKQQPWNNPLEVKWIYVQPLEARMAFKGPPMTRGPSG

SEQ ID NO: 205444 - protein, 127 aa, Triticum aestivum
  Clone ID: PAT_TA_99862.pep
LVWAIVKNNNSFLVKRQNVQFSSEPSNLLNLNSFKYSGLANYKNAAIIPAARGVRVTLRKANKEQSPAKSANTVVIAKTRRQTAKSVANLIARGNKYKPDLPCCCRCPLLLASSPLKQTQRKERKGS

SEQ ID NO: 205445 - protein, 151 aa, Triticum aestivum
  unsure (1)..(151): unsure at all Xaa locations
  Clone ID: PAT_TA_99863.pep
PNXLXPKXXXRFKXLFPXXFGWPGSHXPAXLPRLLFTGQTVPLTASDLLSDSFLDFLEDSLLALGFFSLAGAFFFVGRTGAGGASLRLRSSTGMLRIESRDDVAVALVSRERINFNQGEIGQGRGRGRTLERSWKSRWDGWLSLVPNSARG

SEQ ID NO: 205446 - protein, 112 aa, Triticum aestivum
  unsure (1)..(112): unsure at all Xaa locations
  Clone ID: PAT_TA_99864.pep
MREILHIQGGQCGNQIGAKFWEVVCAEHGIDPTGRYAGDTDLQLERXNVYYNEASCGRFVXPRAVLMDLEARQQLDSVRSGPXGGILRPDKFLFRAIRPKKGAKGAYNRARS

SEQ ID NO: 205447 - protein, 91 aa, Triticum aestivum
  unsure (1)..(91): unsure at all Xaa locations
  Clone ID: PAT_TA_99865.pep
MSSQDYYGGQQPHYPPQSHPPQGGYYPPQQPGYGPPPPQGYPPQGXKQPPPPQQYQQEQRGGRDHGCLGACLATMCCCFLCEENCECCFDW

SEQ ID NO: 205448 - protein, 100 aa, Triticum aestivum
  unsure (1)..(100): unsure at all Xaa locations
  Clone ID: PAT_TA_99866.pep
MLDKLWDDVVAGPRPETGLDKLRRAAATQPLAINTAAGEAIKQSPSMXXTPTTPVTPSSSXPPRGGSVWAXAFSTPGSLGHNSGQTSSPPRNSPHSNELF

SEQ ID NO: 205449 - protein, 97 aa, Triticum aestivum
  Clone ID: PAT_TA_99867.pep
MDQFASSSGQAPLGNSGSPSPRHIVRLGRMTKIGVPIIAVLGIGYGITVARNAQRRIQRVSMQEEERLRRNAQLMDAYGDKSSLEDVQRARDQYHKD

SEQ ID NO: 205450 - protein, 117 aa, Triticum aestivum
  unsure (1)..(117): unsure at all Xaa locations
  Clone ID: PAT_TA_99868.pep
MAAAFSSTVGAPASTPTNFLGKKXKXQVTSAVNYHGKSSKANRFTVMXAXXLXEKRNTDKWNGLAXDISDDQQXHHQRGKGIXGSLFQGRPRXDRHPRALLPEYVPMGLQWKYRSNT

SEQ ID NO: 205451 - protein, 118 aa, Triticum aestivum
  unsure (1)..(118): unsure at all Xaa locations
  Clone ID: PAT_TA_99869.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGXNYRLLYDTKGXAFRLHSVRDX

SEQ ID NO: 205452 - protein, 79 aa, Triticum aestivum
  Clone ID: PAT_TA_99870.pep
MLSRWMGDVFDEPSFGITRDFFDRDLWGNQQRGVDFYRNQLGSFTPSTDVSENDKCICVKSNLPGLKKEDIRIDVDDQE

SEQ ID NO: 205453 - protein, 108 aa, Triticum aestivum
  Clone ID: PAT_TA_99871.pep
LFFLVGSSTSECGCNFFHGRLQLLQQLQGKKRWLRMGDEGDGVHPWLLEREGDGVHPWLLGREGEGVHLWLLEREGDEEHPWLLGREGEGVHLWLLEREGDEEHPWTQ

SEQ ID NO: 205454 - protein, 126 aa, Triticum aestivum
  unsure (1)..(126): unsure at all Xaa locations
  Clone ID: PAT_TA_99872.pep
ASCRIRHEDPPSAPPSSTTSRRISDSMARTKQTARKSTGGKAPRKQLATKAARKSAPATGGVKKPXRFRPXNVALREIRKYKKATRXSSXKLPFQXAXVXGXXPRTLKTGLRLSSPPLRPKEGAES

SEQ ID NO: 205455 - protein, 136 aa, Triticum aestivum
  unsure (1)..(136): unsure at all Xaa locations
  Clone ID: PAT_TA_99873.pep
MGIDLKRHHVKNSNRTAPKSDNVYLALLVKLYRFLARRTNAEFNKVVLKRLFMSRVNRPPVTVSRIVRNAKDXKTIVVVXTVTDDSPSFLELPKGFCCPFTLQKTGKGSVSLKVWVGEMVWTPWIFGLPPNKKQSG

SEQ ID NO: 205456 - protein, 136 aa, Triticum aestivum
  unsure (1)..(136): unsure at all Xaa locations
  Clone ID: PAT_TA_99874.pep
MAPAVMASSATTVAPFQGLKSTAGLPVGRRSSGSLXQASSNGGRIRCMQVWPIEGIKXKFENLSYLATLSKXGLLKQVHYLIRSXKWVAXLXFNKXGFXXRXXNXSPGYXEGRYWAMXELPMFRCTDPNKVLXEGE

SEQ ID NO: 205457 - protein, 112 aa, Triticum aestivum
  unsure (1)..(112): unsure at all Xaa locations
  Clone ID: PAT_TA_99875.pep
MSCCGGNCGCGAGCKCGNGCGGCKMFPDVEATAGAAAMVMPTASQQGEAPAGSKIGRAGKTGGXNWNNCKWREPPWRVVLVEAGTEPAQRPGGKRQQDEKQAIINNNNNQFN

SEQ ID NO: 205458 - protein, 105 aa, Triticum aestivum
  Clone ID: PAT_TA_99876.pep
HHHKMKSFIGDSSWLALTLLLLLHLITSPVLSQSTGLAIDYWQTSHCPQPCNIAGPDPSQWKYYHDANALQKCNDTTIFQMNLYNAVAGSKHPCTISSPALHLKV

SEQ ID NO: 205459 - protein, 140 aa, Triticum aestivum
  unsure (1)..(140): unsure at all Xaa locations
  Clone ID: PAT_TA_99877.pep
MVCXLKEYQVVGRKLPSETEASPKLYRMRIFAPNDVVAKSRFWYFLKKLRKVKKAAGEIVALNQIHXKRPEQIKXTLGIWIRXDSRSXGTHNMYKEYXAMKPCLETRYQPNYMGWVVAPFQKSGSKIWLAGKPKGLVRPQ

SEQ ID NO: 205460 - protein, 123 aa, Triticum aestivum
  unsure (1)..(123): unsure at all Xaa locations
  Clone ID: PAT_TA_99878.pep
RSKPSIKHHTTEVKPRPILSHVLAITPTNVKHNRTWAHQATRYKSRQNYQLEEPSPYSALLSPLPHNHQHVFPPPHIYPGTPRGSSLPQHVLASAISMERCRRKHKMTSNPGCEVSXQRAPEG

SEQ ID NO: 205461 - protein, 90 aa, Triticum aestivum
  unsure (1)..(90): unsure at all Xaa locations
  Clone ID: PAT_TA_99879.pep
SFRRPQAEETKPNPSSMATVAMDISKPPPAASGDESAKGARGGGEGLRQYYLQHIHDLQLQIRXKTHNLNRLXGQRNEPQLPEFRMLGRS

SEQ ID NO: 205462 - protein, 75 aa, Triticum aestivum
  unsure (1)..(75): unsure at all Xaa locations
  Clone ID: PAT_TA_99880.pep
MITKVYLSGSASTKKESLQHIFLSXSTLGXXISIILSVSHPKXAHKWNRDHXRAVQHNLWIKDSIYALGXXYHPT

SEQ ID NO: 205463 - protein, 99 aa, Triticum aestivum
  unsure (1)..(99): unsure at all Xaa locations
  Clone ID: PAT_TA_99881.pep
MSCCGGNCGCGTACKCGNGCGGCNMYPEVEAAGATLLVSATATHKASSGGMEMAAENGGCGCTQCKCGTXSCGCSCCSCHHRSCMQRACVHHRSYRFYY

SEQ ID NO: 205464 - protein, 127 aa, Triticum aestivum
  unsure (1)..(127): unsure at all Xaa locations
  Clone ID: PAT_TA_99882.pep
MIRRNTRLRREYLYKKSLETKEQATFDRKQKIKEAIEQGKDVPTELRKMDKGSKEDFGYDQAQEAPTTHEDDEYARAGVYDPKXLITTSRDPSSRLQQFSKEMRLVFPNSQRINPWWSCYEKKVEAC

SEQ ID NO: 205465 - protein, 99 aa, Triticum aestivum
  unsure (1)..(99): unsure at all Xaa locations
  Clone ID: PAT_TA_99883.pep
MLDKLWDDVVAGPRPETGLDKLRRAAATQPLAINTAAGEAIKQSPSMPTTPTTPVTPSSSTPPRGGXVWRSVFQPGSXLGNKSSGXXXSNAXXANSPNV

SEQ ID NO: 205466 - protein, 85 aa, Triticum aestivum
  unsure (1)..(85): unsure at all Xaa locations
  Clone ID: PAT_TA_99884.pep
RRTPVWIACXEQSVVTRLSLRSGKWXRXXRYERGXTGQKXSQAHFIFHFSLFSVFSIFVXSIYIFWTFFGXFXPNIIXLEGGGTX

SEQ ID NO: 205467 - protein, 76 aa, Triticum aestivum
  unsure (1)..(76): unsure at all Xaa locations
  Clone ID: PAT_TA_99885.pep
XDASXWVLDXXHRYXXLVTSNRWXRAXHXDQVDXXXPSGMXXDRLGKNAXRHISLSXFLSFQFFQIFXVSIYIFWA

SEQ ID NO: 205468 - protein, 62 aa, Triticum aestivum
  unsure (1)..(62): unsure at all Xaa locations
  Clone ID: PAT_TA_99886.pep
GAKRXHIXLQNQXESGVMRXAXRHXHRXXTRAGYYNDYKNLVSLLPEVQRAGGTLVPNSARG

SEQ ID NO: 205469 - protein, 136 aa, Triticum aestivum
  Clone ID: PAT_TA_99887.pep
ATNMKRIAQLLLVALVVVCCTANNTDVCLNPSNPSYNNIINFKQIDVTTTYVELPFHREVNVTSSNYNNCWTFEWDDLDIFQRTSTLFDDHFYGRLTGTLYDTCNHKVYEVEVYERCKPSLGPRSIKPNRVLSLID

SEQ ID NO: 205470 - protein, 103 aa, Triticum aestivum
  unsure (1)..(103): unsure at all Xaa locations
  Clone ID: PAT_TA_99888.pep
LKRLGFVSXHYFVKRILXIXVTAKSXRTXVAPVXLCCGTSXVXLETXLXIASTATTLTGKFAPCTCRATFPTXSGSXLXPFXPGGKAXKGVRPPXGLXYXKXL

SEQ ID NO: 205471 - protein, 129 aa, Triticum aestivum
  unsure (1)..(129): unsure at all Xaa locations
  Clone ID: PAT_TA_99889.pep
IKSHCAFSSKMPSKSYLFFGLAGHAMTAWAACAPGNYMPILSNFQLQLPYSTNGGSPLFVSGSQLSGCDGFQNPTWVLLGTKTTGNLRHECNPQFFRAAPKTSXSQQCRNRICAEAKPIRAGQQAXTTR

SEQ ID NO: 205472 - protein, 88 aa, Triticum aestivum
  unsure (1)..(88): unsure at all Xaa locations
  Clone ID: PAT_TA_99890.pep
MVRYAAHTIPNAKSARARGSYLRVSFKNTRETAQAINGWKLQRALAYLRECHQXRRAVPMRRYAGSTGSHCSXAKAFGVSXARWPVKC

SEQ ID NO: 205473 - protein, 126 aa, Triticum aestivum
  unsure (1)..(126): unsure at all Xaa locations
  Clone ID: PAT_TA_99891.pep
MANPRVFFDMTVGGAPAGRIVMELYKDAVPRTVENFRALCTGEXKGVGKSGKPLHYKGSAFHRVIPDFMCQGGXTSTRGNGNGGESIYXEXKFADEEIPPKSKTKPGILSMGXTPGPKTNGSXFHL

SEQ ID NO: 205474 - protein, 137 aa, Triticum aestivum
  unsure (1)..(137): unsure at all Xaa locations
  Clone ID: PAT_TA_99892.pep
SPWQSRMCRMTSLTRRPRLHWSAWAAASSLPPSKNALSXRNVGAMSVFTRGAPIIGICAAGPGAYAFFSRTMMNLREKXDAWAAAFGGFMXGKCSRTSFPXHTHPCWXLGGFRWHCPRAFPTSPEGKLGQASKKEGG

SEQ ID NO: 205475 - protein, 110 aa, Triticum aestivum
  Clone ID: PAT_TA_99893.pep
MGITMNRDIHAPTVPSGPTTAGTGFRDLSKLSMVELMSEKERIEAELSAYSTVLTSQGVTMDTSLTTFDGFPRDDIDVAQIRTTRARIIHLRNDHKEVMKHLGEGSTCTL

SEQ ID NO: 205476 - protein, 129 aa, Triticum aestivum
  unsure (1)..(129): unsure at all Xaa locations
  Clone ID: PAT_TA_99894.pep
MAAPRGAALVLAMVLAAMLVAPPATVHAISCSTVYSTLMPCLQYVQQGGSPARGCCTGIQXNLLAEANNSPDRRTICGCLKNVANGASGGPYITRAAALPSXKCNVALPYKISPNVXCNSIHLNELKAP

SEQ ID NO: 205477 - protein, 100 aa, Triticum aestivum
  unsure (1)..(100): unsure at all Xaa locations
  Clone ID: PAT_TA_99895.pep
MAETEYRCFVGGLAWATDDHXLQQAFSQXYGEILDAKIINDREXXRSRXFXFVTFXGNXEXMRQGQSRXMNGQRXLERGATSTVKPRAQSPARSRGAGGA

SEQ ID NO: 205478 - protein, 70 aa, Triticum aestivum
  unsure (1)..(70): unsure at all Xaa locations
  Clone ID: PAT_TA_99896.pep
ATTNLFRLVDNENVGIDDCDHHCSVSRHHRGKLMYTASLIQAITLIFSMILNFILQICIVFEEKLSGXQC

SEQ ID NO: 205479 - protein, 112 aa, Triticum aestivum
  unsure (1)..(112): unsure at all Xaa locations
  Clone ID: PAT_TA_99897.pep
ARRRPRPPPPSPPXASPAPATTLLAAMSPAGPGHAGHHLARRPRPGHPRRPPRPGARHPRQSSRPVAPGGPDPVTPTGLHPGHRRPRGRVLCLASSTRQASGDSAFASTANP

SEQ ID NO: 205480 - protein, 107 aa, Triticum aestivum
  unsure (1)..(107): unsure at all Xaa locations
  Clone ID: PAT_TA_99898.pep
PGTXWLGXRGXASRGVXELXPPXFSXGEFGGASQPHPPSXFGLDWRLRNPLRLGGVGXPSTLIPARRRTRTLKVSMATSLLYYTARPLTPRPFSLLASTFPFKSISH

SEQ ID NO: 205481 - protein, 148 aa, Triticum aestivum
  unsure (1)..(148): unsure at all Xaa locations
  Clone ID: PAT_TA_99899.pep
LTASSQSLASFPRRHPPRKGGCLAAAATAGAAPAASAATAAAGARCSPTWRPPPAPPPWSCPPPPTRGAPAGXSRRPGRPAAATAPPCKCGTAVAGLLLLQAANSPGAQGRGRARGRTKDLEGQSAKQPINQQVSTNPKLSSPAAMRF

SEQ ID NO: 205482 - protein, 124 aa, Triticum aestivum
  unsure (1)..(124): unsure at all Xaa locations
  Clone ID: PAT_TA_99900.pep
AASSLLKASSQSLARHHPPRKGGCLAAAATAGAAPAASAATAAAGARCSPTWRPPPAPPPWSCPPPPTRGSSGGXSRWPAGKPAAATAPPCKLREPPCGLRLAASCNWSRAPKEGPGRQGQTKD

SEQ ID NO: 205483 - protein, 123 aa, Triticum aestivum
  unsure (1)..(123): unsure at all Xaa locations
  Clone ID: PAT_TA_99901.pep
MPRQFFVGGNFKMNGVTDSIKSIVSNINKARXDPSTEVVIAPPTIYLSLTRELARXSIGVAXQNVYDKANGCFQWGEIERLSXSKGTKEWVGLLGWNNGASCFCCGKNERFLARKNKWLIDGV

SEQ ID NO: 205484 - protein, 47 aa, Triticum aestivum
  unsure (1)..(47): unsure at all Xaa locations
  Clone ID: PAT_TA_99902.pep
TYYEVCFRPYLQDFVWLYTLSVFHVRNTPFGWLMIVIRGGTDYSXLQ

SEQ ID NO: 205485 - protein, 103 aa, Triticum aestivum
  unsure (1)..(103): unsure at all Xaa locations
  Clone ID: PAT_TA_99903.pep
HTIKMKFSATIIALFAAGALAAPSGHGLAARTEARAAGRSRLTRPKQPASGALNGDLSTEAANATYVDYSSNWSGAVLTSPPRRXPPSPLSLRKFNVPNPXAR

SEQ ID NO: 205486 - protein, 83 aa, Triticum aestivum
  unsure (1)..(83): unsure at all Xaa locations
  Clone ID: PAT_TA_99904.pep
MQIFVKTLTGKTITLEVESSDTIDNVKAKIQDKEGIPPDQXKRLIFAGKASWEDGRTLADYNIQKESNLQLCPASAWWDANIP

SEQ ID NO: 205487 - protein, 144 aa, Triticum aestivum
  unsure (1)..(144): unsure at all Xaa locations
  Clone ID: PAT_TA_99905.pep
LSNGYNLRLPVDTGXPSTSSVIYRQRQEGASRQRXXCSPAXFARGSCSRRRSSCRRRXCSSFIFFCFGRLRLLCSKNTLYDAAIGEREVTNMNRARRRTAQRSPPAPGSAICGRCGERGDPSRSCAGRGEVPARRGAPVAGRAP

SEQ ID NO: 205488 - protein, 130 aa, Triticum aestivum
  unsure (1)..(130): unsure at all Xaa locations
  Clone ID: PAT_TA_99906.pep
MATSPPPTATGMPKVDAAKAKIGASDPTAPSGLGLYARFAFAGAVCCSVTHGALTPVDVVKTRIQLDPVTYNXGLIGGFRKTIXNEGAGAVWTGFGPTAAGYFLQGAFKFGGYEFFKQQGNQTWVGYEDR

SEQ ID NO: 205489 - protein, 108 aa, Triticum aestivum
  unsure (1)..(108): unsure at all Xaa locations
  Clone ID: PAT_TA_99907.pep
MAPTVMASSATSVAPFQGLKSTAGLPVSRRSNGASLGSVSNGGRIRCMQVWPIEGIKKFETLSYLPPLXSTEALLKQVDYLIRSKWVPCLEFNKVGFIFREXNASPGY

SEQ ID NO: 205490 - protein, 134 aa, Triticum aestivum
  Clone ID: PAT_TA_99908.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEVQQRVGFVFPVSTKSSPGYRWVDTGTMESLCSGNRPTQGGSNEG

SEQ ID NO: 205491 - protein, 103 aa, Triticum aestivum
  unsure (1)..(103): unsure at all Xaa locations
  Clone ID: PAT_TA_99909.pep
MQIFVKTLTGKTITLEVESSDTIDNVKSKIQDKEGIPPDQQRLIFAGKQLEDGRTLSDYNIQXKESTLHLVLRLRGGAKKRKERRCTTLPKKIKQQSAKKNKA

SEQ ID NO: 205492 - protein, 102 aa, Triticum aestivum
  unsure (1)..(102): unsure at all Xaa locations
  Clone ID: PAT_TA_99910.pep
MVRSNSIDSCYSSIQDVTYSCGYCGYALNLSSAARXTANIGSKYGKQIRKKGIVAFVAVDETRFTQADEVTCAPRLRPWTWRLFRRRSRLLCGKCGGRIGAA

SEQ ID NO: 205493 - protein, 63 aa, Triticum aestivum
  unsure (1)..(63): unsure at all Xaa locations
  Clone ID: PAT_TA_99911.pep
IFGLHLAPPXXFFFFFFFFFFFFFFFFFFFFFFFFFLNIFIRESCKVVRPPFLYGVNFVYMNG

SEQ ID NO: 205494 - protein, 139 aa, Triticum aestivum
  unsure (1)..(139): unsure at all Xaa locations
  Clone ID: PAT_TA_99912.pep
IPHRLAGHPGGAXGLFXKXRRAACXHNXDPSPCVPWYXRTNARPXXRLPXXDPAPPPPCXVQQEKTAKNMTXVKHRXVSLKEAMATDRRWFQXXQSVMLHXCAEYAVELNRXVEAYDMQARVSGLNNCGLASCRIRHEA

SEQ ID NO: 205495 - protein, 96 aa, Triticum aestivum
  unsure (1)..(96): unsure at all Xaa locations
  Clone ID: PAT_TA_99913.pep
FVTNCLGLYANRAQAYMSQQSWPEGWIDSKCSAECKPMGNVKAWWRGGKCLXLEMGRLXEARAWVEQALGIEGPASEGGKELVALLADVEAGSKRA

SEQ ID NO: 205496 - protein, 97 aa, Triticum aestivum
  unsure (1)..(97): unsure at all Xaa locations
  Clone ID: PAT_TA_99914.pep
SFLALMRIGRRHGKLQHYLKSFFRLKSWNIXLGLVVIRAKMLSIENSREYPLLLQSQNLRLGXKDSXCCEXALLTKHRNLLNLGCLNFLFSESVQRI

SEQ ID NO: 205497 - protein, 80 aa, Triticum aestivum
  unsure (1)..(80): unsure at all Xaa locations
  Clone ID: PAT_TA_99915.pep
FGPHGXCXSXPRPXIXDXPAXRPXVRRAQAAXLXGVIGHPGALNQVALLLXRXXLLISGMLPHVFXVIYLFXPYMHETKY

SEQ ID NO: 205498 - protein, 105 aa, Triticum aestivum
  unsure (1)..(105): unsure at all Xaa locations
  Clone ID: PAT_TA_99916.pep
PLYISSLKMXTLFPTWXFILFGILXPLSMVGGTLAPXIDTDKFIAGQNSLAHPPXLPHHPXVLALNYHLXKHXWSCXHARXGNHLRQLPSXXCWHKCRPRGXGXS

SEQ ID NO: 205499 - protein, 104 aa, Triticum aestivum
  unsure (1)..(104): unsure at all Xaa locations
  Clone ID: PAT_TA_99917.pep
RPSCVQXCSXAPLAPXPGSPPCALAASPGHDEQDSXRRPQATAAQPGGGGGRWKGEIRGVLEREIRGARSWTSTIGGDRRRRASGGDRRWLRVRQVLRSGAERW

SEQ ID NO: 205500 - protein, 100 aa, Triticum aestivum
  unsure (1)..(100): unsure at all Xaa locations
  Clone ID: PAT_TA_99918.pep
MDAMVAKAPVDPETVVEDVEHLSISPYGPARSSVTEHPLSEDEVQKMTDYFHASLYMCLGMIYLRRKPLLREPLTLXHLKATPFGKLGDQMLGQLHKDSK

SEQ ID NO: 205501 - protein, 140 aa, Triticum aestivum
  unsure (1)..(140): unsure at all Xaa locations
  Clone ID: PAT_TA_99919.pep
MAAIQADCSGEETRTTFHPTLWGDYFLQNKPQSSAQQAHMRERMEILLEQVRTVMKEANEIPKILELVITIERLGLGNHYENEIAQLLXVVLKSDYDDNNLHLXSLRFYLLRKNRYDVSTWXYSINSKTNKGXFGSIGYK

SEQ ID NO: 205502 - protein, 134 aa, Triticum aestivum
  unsure (1)..(134): unsure at all Xaa locations
  Clone ID: PAT_TA_99920.pep
GRFFNKILIGSSHXNYSMDDLLNFLNKVHRSMKCYYIEQSVATQVLTELLKLIGVTAFNNLLMRKNFCSWKRXMQIQYNITRLEEWCKSHDIPEGALQXEHLMQTXKLLQFKKGTVXKTTXIFMMFAGIITPTQ

SEQ ID NO: 205503 - protein, 91 aa, Triticum aestivum
  unsure (1)..(91): unsure at all Xaa locations
  Clone ID: PAT_TA_99921.pep
MADPVGDFGLIXLAVMGQNLILNTADHGFTVVAYNRTVSXVDRFLENEAKGKSIVGAHSIEEFCAKLKKPRRIMLLVMAGKAVDDFIEEPP

SEQ ID NO: 205504 - protein, 127 aa, Triticum aestivum
  unsure (1)..(127): unsure at all Xaa locations
  Clone ID: PAT_TA_99922.pep
MAIGKNKKLGKKKGAKKKVQDPFLRKEWYDVKAPAPFTKRYIGKTCVTXRTTGTRIATDYLKGRVVETSYAELSDNQDSWRKIKLSIEDIQGKSXMTNFHAMDMTKRQDXGXSSRKWENFDTLTEKD

SEQ ID NO: 205505 - protein, 101 aa, Triticum aestivum
  unsure (1)..(101): unsure at all Xaa locations
  Clone ID: PAT_TA_99923.pep
FPPNQIGFCSTXRTNFARLRLPFVGRRNNPHSEDASNLGRGGATSVGPGSCNPARQIDGTWRRPCCVGDGGGPPLLGTSYFFAGTYHYFLLELHFFVAAIN

SEQ ID NO: 205506 - protein, 102 aa, Triticum aestivum
  unsure (1)..(102): unsure at all Xaa locations
  Clone ID: PAT_TA_99924.pep
TMCPSPLPLSFXRWKKVTSKACCGMFNRRSFTAPYTNIHYKNVPRMSHGHTKIHSTLIQIGKCTNICRIFFEEYRSVLKLGMVRTNKYYLSLKMYIRFCRLV

SEQ ID NO: 205507 - protein, 116 aa, Triticum aestivum
  Clone ID: PAT_TA_99925.pep
MPSHQPVRLYTKAKVAGYQRSLATQYNDVSLLKLEGVHTKADTDFYMGKRVAFVYRARRTNKSGNNKKKSNIRVMWGKIVRHHGHNGTVRAKIQDETCLLRLLVPPFRVMLYPSRI

SEQ ID NO: 205508 - protein, 135 aa, Triticum aestivum
  Clone ID: PAT_TA_99926.pep
GVSGSAVAMETSHVTLMSNDVRRIPKAIRLARRTRRTIVTNIVFSVATKLAIVGLALAGHPLVWAAVLADVGTCLLVIMYKHDVAEGGRRREGQEMLRFFSPWISLSPQEAWPLLGRSVQFDWRLRGFICWWMLA

SEQ ID NO: 205509 - protein, 89 aa, Triticum aestivum
  unsure (1)..(89): unsure at all Xaa locations
  Clone ID: PAT_TA_99927.pep
MISTRLSRLGAVGTKSRVLLGSRGLATVSDSPLDKKVEMTNWEKGNYINYKKFSREXLPIVRGRLNRPLTFAXEKXIYSHLDDPQGQRD

SEQ ID NO: 205510 - protein, 137 aa, Triticum aestivum
  unsure (1)..(137): unsure at all Xaa locations
  Clone ID: PAT_TA_99928.pep
AELFYCSRITLATDFTASLAFFTSSFRVHAGFCGTVYTILPFWITTCDISYVFSVCLRAFWHLYARRMSFTFRYSSHCTVLRIGGAVHGRGGDPWQRADVYGVRGVDARPAQDAELTAALGRWMQDRKSEPDXPCFC

SEQ ID NO: 205511 - protein, 48 aa, Triticum aestivum
  Clone ID: PAT_TA_99929.pep
AVDGKQIGAVQSKDLCRAFFDMYIGDPPVSVETKQDIAQNVGGLIRRC

SEQ ID NO: 205512 - protein, 137 aa, Triticum aestivum
  unsure (1)..(137): unsure at all Xaa locations
  Clone ID: PAT_TA_99930.pep
VVQMFDLLRRTNAPLRDYLRSVLPSVRALVVDIFCVDALDVATELGVPAYLLYTCSASCLAVNLNLPHVQARIDATGDVGGPVLSFPGNRPIKLTDLPDGTFDPNHEAVQRSXLHLSARTLEFNGVLVNTFEWLXAK

SEQ ID NO: 205513 - protein, 110 aa, Triticum aestivum
  Clone ID: PAT_TA_99931.pep
EEANVSAGLMEADKGKDVDFVDEDKEQAEIQAAARKWDDIMRSRIDLMRRLGQPVRLFYPNNPVDPRILLNRESNCDKIDTGAGYEPSTLQVPSLFFMRFHLSGVVWISV

SEQ ID NO: 205514 - protein, 122 aa, Triticum aestivum
  unsure (1)..(122): unsure at all Xaa locations
  Clone ID: PAT_TA_99932.pep
MPPFPGGNLEGDDGKTSNLIVSDLLVKTPKINVFASLTRDFQPIASRLNDISQNTTVLAPLNSAINALPRKPWEDPEDYERFGDAKGVYXGEEGXDXATRNLXRFVEAHLVPVSPWTEGEGG

SEQ ID NO: 205515 - protein, 75 aa, Triticum aestivum
  unsure (1)..(75): unsure at all Xaa locations
  Clone ID: PAT_TA_99933.pep
AEEKASSRLVSSRNLEKLKGXKGSQLEANKKAMNIQCKICMQTFICTTSEAKCKEHAEAKHPKSELVQCFPHLKQ

SEQ ID NO: 205516 - protein, 47 aa, Triticum aestivum
  unsure (1)..(47): unsure at all Xaa locations
  Clone ID: PAT_TA_99934.pep
RGRGRGTXKPTITSREIQTSVRLVLPGELAKHAVSEGTKAVTKFTSS

SEQ ID NO: 205517 - protein, 88 aa, Triticum aestivum
  Clone ID: PAT_TA_99935.pep
SVVAAEVQKSTELLIRKLPFQRLVREIAQDFKTDLRFQSSAVSALQEAAEAYLVGLFEDTNLCAIHAKRVTIMPKDIQLARRIRGERA

SEQ ID NO: 205518 - protein, 48 aa, Triticum aestivum
  Clone ID: PAT_TA_99936.pep
AWSRPRYNKKPTITSREIQTSVRLVLPGELAKHAVSEGTKAVTKFTSS

SEQ ID NO: 205519 - protein, 64 aa, Triticum aestivum
  Clone ID: PAT_TA_99937.pep
TTTHVVFVLSGAGNNWAKGHYTEGAELIDSVLDVVRKEAENCDCLQGFQVCHSLGGGTPWGAPR

SEQ ID NO: 205520 - protein, 92 aa, Triticum aestivum
  unsure (1)..(92): unsure at all Xaa locations
  Clone ID: PAT_TA_99938.pep
VFFFWIIFIXFVEIFLKGNGLGFGIFFFFXSNIFXXXIWKGFSLSPLNSGXGVEFEGDVISLFHFLFXXSDKVRSLREGFFRPNFPNLTCFK

SEQ ID NO: 205521 - protein, 43 aa, Triticum aestivum
  Clone ID: PAT_TA_99939.pep
MRECISIHIGQAGIQVGNACWELYWCQTIAQVTARLSPRRPME

SEQ ID NO: 205522 - protein, 138 aa, Triticum aestivum
  unsure (1)..(138): unsure at all Xaa locations
  Clone ID: PAT_TA_99940.pep
MAVTFSDLHTADGLKALEAHLAGKTYISGDGITKDDVKVFAAVPVKPSAEFLNAARWYDAVAAAVSSRFPGQASGVSASSAPAAAAPAASKDEDDDDDMDLFGDETEEDKKAAAEREAAKPAKKKESGKSSVLMDIKX

SEQ ID NO: 205523 - protein, 111 aa, Triticum aestivum; identical to SEQ ID NO: 134315
  Clone ID: PAT_TA_99941.pep

SEQ ID NO: 205524 - protein, 88 aa, Triticum aestivum
  Clone ID: PAT_TA_99942.pep
AWSRPRYQKSTELLIRKLPFQRLVREIAQDFKTDLRFQSSAVSALQEAAEAYLVGLFEDTNLCAIHAKRVTIMPKDIQLARRIRGERA

SEQ ID NO: 205525 - protein, 49 aa, Triticum aestivum
  unsure (1)..(49): unsure at all Xaa locations
  Clone ID: PAT_TA_99943.pep
KHVTAVIYSKQXXTVRSSISKVHSALADKTLNHKTTQYLSKSIKPQYLT

SEQ ID NO: 205526 - protein, 101 aa, Triticum aestivum
  Clone ID: PAT_TA_99944.pep
ISSGRPGRYKSEDEEHKKKVESKNALENYSYNMRNTIKDEKVASKLPADDKKKIEDAIDAAIQWLDTNQLAEADEFEDKMKELEALCNPIIAKMYLGRDHA

SEQ ID NO: 205527 - protein, 48 aa, Triticum aestivum; identical to SEQ ID NO: 205518
  Clone ID: PAT_TA_99945.pep

SEQ ID NO: 205528 - protein, 40 aa, Triticum aestivum
  Clone ID: PAT_TA_99946.pep
SSGRPGRYKPVNPLMAGVQCNAWCSPLICSCCMTSSVNRS

SEQ ID NO: 205529 - protein, 94 aa, Triticum aestivum
  Clone ID: PAT_TA_99947.pep
AWSRPRYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 205530 - protein, 152 aa, Triticum aestivum
  Clone ID: PAT_TA_99948.pep
GRPGRYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYLGRDHA

SEQ ID NO: 205531 - protein, 88 aa, Triticum aestivum; identical to SEQ ID NO: 205524
  Clone ID: PAT_TA_99949.pep

SEQ ID NO: 205532 - protein, 97 aa, Triticum aestivum
  unsure (1)..(97): unsure at all Xaa locations
  Clone ID: PAT_TA_99950.pep
TAPPGRNLPPKKLKFPGNPPKDKKKSRIIPPXLFFPLKKKKNLEKFLAGVPIGHGGFIPKINPXXLPKKRGKKKEKGPKSPKKIXNSPKKPPPPKKA

SEQ ID NO: 205533 - protein, 43 aa, Triticum aestivum
  Clone ID: PAT_TA_99951.pep
RKICAGMTPAKHHTTGNKRALYNGVLSLLIYQLGSDLCNKLQY

SEQ ID NO: 205534 - protein, 64 aa, Triticum aestivum
  Clone ID: PAT_TA_99952.pep
TTTHVVFGQSGAGNNWAKGHYTEGAELIDSVLDVVRKEVENCDCLQGFQVCHSLGGGTPWGAPR

SEQ ID NO: 205535 - protein, 97 aa, Triticum aestivum
  unsure (1)..(97): unsure at all Xaa locations
  Clone ID: PAT_TA_99953.pep
CPSKHALFHTPEMYFRSNQLHRRHKAENCAKQNGKILLVTLVFANFSQTELEHKLHIRKKVPSVSIHARLKLMQTWKLPHNHVEWKFXXKYLPGRPL

SEQ ID NO: 205536 - protein, 94 aa, Triticum aestivum; identical to SEQ ID NO: 205529
  Clone ID: PAT_TA_99954.pep

SEQ ID NO: 205537 - protein, 57 aa, Triticum aestivum
  unsure (1)..(57): unsure at all Xaa locations
  Clone ID: PAT_TA_99955.pep
RPRXXXXNVGVIVNPKGEMKGFAIPGPVGKECVYLWPRIAXNANAIVLKPVSSCKNV

SEQ ID NO: 205538 - protein, 156 aa, Triticum aestivum
  Clone ID: PAT_TA_99956.pep
AWSRPRYPSPQVSTSVVEPYNSVLSTHSLLEHTDVSILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYLPGRPLESI

SEQ ID NO: 205539 - protein, 123 aa, Triticum aestivum
  Clone ID: PAT_TA_99957.pep
SVVAAEVILQRKRQAACGNGNGSSAHNVKEDKSAAVSHRQAESLVEAEKEGYDNTISSEECKSRSGDEEYKEEGQVPASSSHGDKAEAEDMIEVENQEADNYEQRQGESEYEATEGYLPGRPL

SEQ ID NO: 205540 - protein, 88 aa, Triticum aestivum
  Clone ID: PAT_TA_99958.pep
LGWRPRYQKSTELFIRKFPFQGFVREIGQDFKTDLRFQSSPVSALQEAAKAYLVGLFEDTNLWAIHAKGVTIMPKEIQFAPRIQGERA

SEQ ID NO: 205541 - protein, 88 aa, Triticum aestivum; identical to SEQ ID NO: 205524
  Clone ID: PAT_TA_99959.pep

SEQ ID NO: 205542 - protein, 81 aa, Triticum aestivum
  Clone ID: PAT_TA_99960.pep
MSFKVHDGVFAWCSLDVHPTQPYVLSGCDRQIKLWDWDQDWNCIQTFEEHSDNSNELKFNPEDTNIFASASDDCTSAATTL

SEQ ID NO: 205543 - protein, 66 aa, Triticum aestivum
  Clone ID: PAT_TA_99961.pep
MCACTSQADCAVLIIDSTTGGFEAGISKDGQTREHALLAFTLGVKQMICCCNKMDATTPKYLPGRP

SEQ ID NO: 205544 - protein, 28 aa, Triticum aestivum
  unsure (1)..(28): unsure at all Xaa locations
  Clone ID: PAT_TA_99962.pep
TFKGFLILLFCWDYLWQKKXXXXEKNKN

SEQ ID NO: 205545 - protein, 152 aa, Triticum aestivum; identical to SEQ ID NO: 205530
  Clone ID: PAT_TA_99963.pep

SEQ ID NO: 205546 - protein, 103 aa, Triticum aestivum
  unsure (1)..(103): unsure at all Xaa locations
  Clone ID: PAT_TA_99964.pep
SRPWGNNAPPGRYXPPKLXEFPGNPPKDKKKSXXIPPPLLFPLRKKKKFGKFLAGVPMGQGGLIPKINPVLFPKKTAKKKGKGPNSPKKIANLPKKPPPPKKA

SEQ ID NO: 205547 - protein, 135 aa, Triticum aestivum
  unsure (1)..(135): unsure at all Xaa locations
  Clone ID: PAT_TA_99965.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTXGGFEAGISXDGQTR

SEQ ID NO: 205548 - protein, 153 aa, Triticum aestivum
  unsure (1)..(153): unsure at all Xaa locations
  Clone ID: PAT_TA_99966.pep
TFLILALLAIVATTATTAVRVPVPQLQPQNPSQQQSQEQVPLVQQQQFLGQQQPFPPQQPYPQPQPFPSQQPYLQLQPFPQXPQLPYSQPQPFRPQQPYPQPQPQYSQPQHPXSQQQQQQQQQQQXEQXILQXILQQQDSMGIFFAANTNRGI

SEQ ID NO: 205549 - protein, 171 aa, Triticum aestivum
  unsure (1)..(171): unsure at all Xaa locations
  Clone ID: PAT_TA_99967.pep
MKTLLILTILAMAITIGTANIQVDPSGQVQWLQQQLVPQLQQPLSQQPQQTFPQPQQTFPHQPQQQVPQXPQQPQQPFLQPQQPFPQQPQQPFPQTQXPQQPFPQQPQQTHFPKTQTTPNNHFSPTXHXQPXFPQELQQTPXQTXFPQAPSXXKKXPFXPXPXKXNWXXTP

SEQ ID NO: 205550 - protein, 153 aa, Triticum aestivum
  unsure (1)..(153): unsure at all Xaa locations
  Clone ID: PAT_TA_99968.pep
MKTFLILALLAIVATTATTAVRVPVPQLQLQNPSQQQPQEQVPLVQEQXFPGQQQPFPPQQAIXPKPQPFPSQQPYLQLQPFPQPQLSYPQXPQPFRPQQPISTSPQPQYSQPTTTKFRKXQQASKQQTTNNXPTNQILTTFQNKISLAGFFF

SEQ ID NO: 205551 - protein, 153 aa, Triticum aestivum
  unsure (1)..(153): unsure at all Xaa locations
  Clone ID: PAT_TA_99969.pep
MKTFLILALLAIVATTATTAVRVPVPQLQPQNPSQQQSQEQVPLVQQQXFLGQQQPFPPXQPYPQPQPFPSQQPYLQLQPFPQPQLPYSQPQPFRPQQPYPQXQPXYSQPQHPISXAAAXKQQXQXQQGXKQDTNQNFWQNKLDSAMDCCQQH

SEQ ID NO: 205552 - protein, 153 aa, Triticum aestivum
  unsure (1)..(153): unsure at all Xaa locations
  Clone ID: PAT_TA_99970.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQXADCAVLIXIDSTTGGFXEAGISKDGQDPVEATPSFAFNSLGGEA

SEQ ID NO: 205553 - protein, 176 aa, Triticum aestivum
  unsure (1)..(176): unsure at all Xaa locations
  Clone ID: PAT_TA_99971.pep
RSSITRRQASPPSSLSPPASFTPLPPXAPPPSSFPPNQSRLSPPPPPRRPRLLPWTPPPPPSPPSPRSPSSPARSTKAPCGACTGTGSSRWEGGARGTGGWSGKFAFSPTSWPRGPAPRRRAAGYSRSSGAARGTAKGQVAGAPWALAFLAFQFAGWPFPGQSPPDSGPLPGNPGV

SEQ ID NO: 205554 - protein, 162 aa, Triticum aestivum
  unsure (1)..(162): unsure at all Xaa locations
  Clone ID: PAT_TA_99972.pep
MKTLLILTILAMAITIGTANIQVDPSGQVQWLQQQLVPQLQQPLSQQPQQTFPQPQQTFPHQPQQQVPQPQQPQQPFLQXPQQPFPQQPQQPFPQTQQPQQPFPQQPQQPFPQDSXXPPQXFSQQPQQPFPQDXNXPPTXIFPQVPRXPKXXPFFPQAPKKK

SEQ ID NO: 205555 - protein, 64 aa, Triticum aestivum
  unsure (1)..(64): unsure at all Xaa locations
  Clone ID: PAT_TA_99973.pep
ITSRENAKISDKSQPGLGXEWIFINFPKAQIXLIKARXTXANITRHXLTINSRLXWXXGLNSRP

SEQ ID NO: 205556 - protein, 145 aa, Triticum aestivum
  Clone ID: PAT_TA_99974.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLGANNKSPVVQAIHFCKA

SEQ ID NO: 205557 - protein, 171 aa, Triticum aestivum
  unsure (1)..(171): unsure at all Xaa locations
  Clone ID: PAT_TA_99975.pep
LARRRPPPSASADPSLPPHAAPMADPYRSYLPSSSHDRVPLGGYPGYVPHEESSYYASKMAALRGVPNIPRVDVPLQSRAYGLDVPAGVSHPAYGLDVPSRREPSCLWFGCSRRREPSCLWFGCSSRREPSCFGWIGCTANWSXGRGEPXPFWEDQPLXQKKXFXXLEKSX

SEQ ID NO: 205558 - protein, 115 aa, Triticum aestivum
  unsure (1)..(115): unsure at all Xaa locations
  Clone ID: PAT_TA_99976.pep
VYNEKSQQVCIILRXLRRQWLGKLKKIIIKIGCRGVLLGCPYCSQPFFAAFCSRFALPPQITASPLLPTPSCFTTARLEIPTADAXATLDVAAATNAPPLARKCSPTSGIDGWKR

SEQ ID NO: 205559 - protein, 135 aa, Triticum aestivum
  Clone ID: PAT_TA_99977.pep
MGKEKIHISIVVIGHVDSGKSTTTGHLIYKLGGIDKRVIERFEKEAAEMNKRSFKYAWVLDKLKAERERGITIDIALWKFETNKYSCTVIDAPGHRDFHQRTMINWDLPRLIGCAYQTPPTGLKYLPKDRPSAPL

SEQ ID NO: 205560 - protein, 79 aa, Triticum aestivum
  unsure (1)..(79): unsure at all Xaa locations
  Clone ID: PAT_TA_99978.pep
MSSKPSSRRSSFTLRQPPVVDVGCNCRRPKLFSXLFSSSSLPFRGRGGKPKSPNASSTSTTTXXXGNSADSASWGPRVL

SEQ ID NO: 205561 - protein, 166 aa, Triticum aestivum
  unsure (1)..(166): unsure at all Xaa locations
  Clone ID: PAT_TA_99979.pep
MKTLLILTILAMATTIATANMQVDPSGQVQWPQQQPFPQPQQPFCQQPQQTIPQSHQTFHHQPQQXFPQXQQTXPHQPQQQFPXAQQPQQPFPQPQXTXPPRNPPDXPFPQXXQQXISPKPSXNPPTNQXPQVTXQPIXXLFPPSPQQQIFRXAXXNXXXIXFPQX

SEQ ID NO: 205562 - protein, 123 aa, Triticum aestivum
  unsure (1)..(123): unsure at all Xaa locations
  Clone ID: PAT_TA_99980.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGXSQADCAVLXIDSXTGGV

SEQ ID NO: 205563 - protein, 126 aa, Triticum aestivum
  unsure (1)..(126): unsure at all Xaa locations
  Clone ID: PAT_TA_99981.pep
AHSRGGEDGGGAGGGRVPSSGELRGMDKKNSVRLIEAIEQLNPEATVKLTQAIEKLIXELKEKSPFDALSXRKKSFIEASKAFTLFAGAGLNAMNAFAITLAYMSMHSMNVNADAANTTSTAAPSY

SEQ ID NO: 205564 - protein, 120 aa, Triticum aestivum
  unsure (1)..(120): unsure at all Xaa locations
  Clone ID: PAT_TA_99982.pep
MKTFLILALLAIVATTATTAVRVPVPQXKPQNPSQQQPQEQVPLVQQQQFPGQXQXQFPPXQAISAXRNHFPSQTTNICKLQPIXPQXPXPFPAXNXPISGRXAIHFPPXXXXFPQPAKP

SEQ ID NO: 205565 - protein, 124 aa, Triticum aestivum
  unsure (1)..(124): unsure at all Xaa locations
  Clone ID: PAT_TA_99983.pep
MKTFLILALLAIVATTATTAVRVPVPQLQPQNPSQQQPQEQVPLVQQQQFPGXQQQFPPQQXPYPQPQPFPSQQPYLQLQPFPQPQPFPPXLPFXAXRQSFSXQQSQFTKAPQGPTQQPIQIFA

SEQ ID NO: 205566 - protein, 139 aa, Triticum aestivum
  unsure (1)..(139): unsure at all Xaa locations
  Clone ID: PAT_TA_99984.pep
MKTLLILTILAMAITIGTANIQVDPSGQVQWLQQQLVPQLQQPLSQQPQQTFPQPQXTFPHQPQQQVPQXPQQPQQPFLXPQQPFPQQPQXXSPQXXQTTPXISPSXPQQPFPPXLXQTPXNXISPNKQQXXISPQNPN

SEQ ID NO: 205567 - protein, 78 aa, Triticum aestivum
  Clone ID: PAT_TA_99985.pep
MARGLKKHLKRLNAPSHWMLDKLGGAFAPKPSSGPHKARECLPLILILRNRLKYALTYREVQSILMQRHIMVDGKVPH

SEQ ID NO: 205568 - protein, 68 aa, Triticum aestivum
  unsure (1)..(68): unsure at all Xaa locations
  Clone ID: PAT_TA_99986.pep
ALFAFPVVYDPIFFTTVSLLPPLXAHCTAPCSQLPPSPPSELGXRNWKEGXVXGVAAMHHPEXGGAGY

SEQ ID NO: 205569 - protein, 131 aa, Triticum aestivum
  unsure (1)..(131): unsure at all Xaa locations
  Clone ID: PAT_TA_99987.pep
RQNAGSGSLGIXPREAPKPELGRRPPCSXLLVXATGGRLSAXPXRPPAXESPPPARPAAAPPRTPPLPSPSAPPPGSPSAPRRPASTLRPGAGRAGRRPAGPGRPGGGGGRRARAACRMCTWRRRRRRGMG

SEQ ID NO: 205570 - protein, 145 aa, Triticum aestivum
  unsure (1)..(145): unsure at all Xaa locations
  Clone ID: PAT_TA_99988.pep
SKPLEXXSHAPGVXKGPXXVQIGXPIKKXTGPXAGVWPAGFLICHWNXPAGLPIARHCPLLAXXLXXXRKRPXXAALPAGXNGNPKXVQPAPXAIPPXRPIEEPQAPAPTLPLGPTXRPQELXSRSPPASARHRRYASGKRRHPR

SEQ ID NO: 205571 - protein, 110 aa, Triticum aestivum
  unsure (1)..(110): unsure at all Xaa locations
  Clone ID: PAT_TA_99989.pep
MADGEDIQPLVCDNGTGMVKAGFAGDDAPRAVFPSIVGRPRHTGVMVGMGQKDXYFGEQGQSKKGILNXKXPDSTMPQANWGTNWKNLGIKISNQAPFLQLKEQPNYWLN

SEQ ID NO: 205572 - protein, 125 aa, Triticum aestivum
  unsure (1)..(125): unsure at all Xaa locations
  Clone ID: PAT_TA_99990.pep
MGKEKTHINIVVIGHVDSGKSTTTGHLIYKLGGIDKRVIERFEKEAAEMNKRSFKYAWVLDKLKAERERGITIDIALWKFETTKYYCTVIXDAPGQRXDFIKNMITGTSXADCAVLXIDSXTGGF

SEQ ID NO: 205573 - protein, 164 aa, Triticum aestivum
  unsure (1)..(164): unsure at all Xaa locations
  Clone ID: PAT_TA_99991.pep
MKTLLILTILAMAITIGTANIQVDPSGQVQWLQXNXVPXLQQPXSQQPQQXFPQXQQXFSHXPQQQVPQPQXQPQQPFLXPXXHSPKQTQXXXPQSXQPQXXIXPGXHNKPFSPXTQQPXKQXFSPKXXKXPIXPRLQXTPTNXFPRLQXXKKXLFPQANLAAP

SEQ ID NO: 205574 - protein, 182 aa, Triticum aestivum
  unsure (1)..(182): unsure at all Xaa locations
  Clone ID: PAT_TA_99992.pep
MKTFLIFALLAIAATSAIAQMETSRVPGLEKPWQQQPLPPQQQPPCSQQQQPFPQQQQPIIILQQSPFSQQQQPVLPQQXQPVIILQQPPFSQQQQTKFYQQQXPIFHNNKQXQSTNQQTTNIFRRQQTTKFLPTNNQPIFQQSNNNPPIFXSXQQXIFXXNQLFPQXTPFPKQNPFSTNLP

SEQ ID NO: 205575 - protein, 156 aa, Triticum aestivum
  unsure (1)..(156): unsure at all Xaa locations
  Clone ID: PAT_TA_99993.pep
MKTLLIVTILAMATTIATANMQVDPGYQVQWPQQQPFPQPQQPFCQQPQQTIPQPHQTFHHQPQQTYPHQPQQXFPQDPSNHNNHFPKXQXTFPQQPPTXNFPXNPPQPFPQASTTPNNNFPXVTSNXQXXFPXAPNKQFPGKPQXTGLIPPTNRF

SEQ ID NO: 205576 - protein, 181 aa, Triticum aestivum
  unsure (1)..(181): unsure at all Xaa locations
  Clone ID: PAT_TA_99994.pep
MKTLLILTILAMAITIGTANIQVDPSGQVQWLQQQLVPQLQQPLSQXQPQQTFPQPQQTFPHQPQQQVPQXPQQPQQPFLQXPQQPFPQQPQQPFPQTQQPQTNNFPQQPQQTISPXLNNPTTIFPXXQQQPXPPXLKXPQQTNFPRLQXTXXKPFSPGPXKXLAGSPQQXXKIXSPPKKG

SEQ ID NO: 205577 - protein, 168 aa, Triticum aestivum
  unsure (1)..(168): unsure at all Xaa locations
  Clone ID: PAT_TA_99995.pep
MKTLLILTILAMAITIGTANIQVDPSGQVQWLQQQLVPQLQQPLSQXPQQTFPQPQXTFPHQPQQQVPQXLKQPXQPFLQPQQPFPXNXQXQPFPPXTQQPTXNHFPQATNNXPIFPRTSNNPQQPIFPPXTNXQSNSPPGXQTTPNIQFSPRLQGXQQXTFFPQGPQ

SEQ ID NO: 205578 - protein, 116 aa, Triticum aestivum
  unsure (1)..(116): unsure at all Xaa locations
  Clone ID: PAT_TA_99996.pep
ARSPDPPVPPPLTQRAAAARKPQSPSPPRPHPWQPQGPPPPPRGLXPHAXPGLDPTRRLXPARPPATFYGRRASPGPPPARRXGSPSPPAXXPAXTDSPXPPPHPXLXGPPRTQEA

SEQ ID NO: 205579 - protein, 50 aa, Triticum aestivum
  unsure (1)..(50): unsure at all Xaa locations
  Clone ID: PAT_TA_99997.pep
MAALPVMKLGTLLLRTLSKPIANRLKSQAAVQPKFREFIIXIXQTNHRIN

SEQ ID NO: 205580 - protein, 119 aa, Triticum aestivum
  unsure (1)..(119): unsure at all Xaa locations
  Clone ID: PAT_TA_99998.pep
MALVLHSGNGNKNAFKALIAARVXGSKVELNKNFEMGVSNKXTPNSSKXNPLGKGPVLENPEGAVFENNGFGSXVXXSXGXNCLGGXPLIKKRLXNKGRXFGAKKVIPKTXRGVYQRVG

SEQ ID NO: 205581 - protein, 60 aa, Triticum aestivum
  unsure (1)..(60): unsure at all Xaa locations
  Clone ID: PAT_TA_99999.pep
MKTFLILALLAIVATTATIAVRVPVPQLQPQNPSQXQPQKQVPLVQQQQFPREXKTFPTK

SEQ ID NO: 205582 - protein, 141 aa, Triticum aestivum
  unsure (1)..(141): unsure at all Xaa locations
  Clone ID: PAT_TA_100000.pep
GSXTLPFAPXEGRTXTIQRNFPPPAPPSPSHSXQKGARRQGVSFSPRYLFASRINTMLAERKSRRAAGHRRRRREWGFFPFFPMNPSLDSLLTGTTAAARRRKIGGGGGAAARWRLTYREGEATPLDRGGGVAAQEKRTRR

SEQ ID NO: 205583 - protein, 79 aa, Triticum aestivum
  unsure (1)..(79): unsure at all Xaa locations
  Clone ID: PAT_TA_100001.pep
MNRLRAGSPVYGRQRSGSSTGFTSPGGISPFXHRSSSTSFAASLQRPQKLAKKIKVAGRPSQQGRALHIPKNRPQMPLQ

SEQ ID NO: 205584 - protein, 177 aa, Triticum aestivum
  unsure (1)..(177): unsure at all Xaa locations
  Clone ID: PAT_TA_100002.pep
MGKEKTHINIVVIGHVDSGKSTTTGHLIYKLGGIDKRVIERFEKEAAEMNKRSFKYAWVLDKLKAEREXGITIDIALWKFETTKYYCXVIDAPGXRDFIKNMITGTSQAXCAVXXNXSNXGGFEGGIXKGGQNRXQCLXAFNPGVKQIFGSVKXMAXTXXNYXKAXYKXIFKEXXSY

SEQ ID NO: 205585 - protein, 151 aa, Triticum aestivum
  unsure (1)..(151): unsure at all Xaa locations
  Clone ID: PAT_TA_100003.pep
MAAANAPIAMREALTLTSLGIAPQFVTFTHVTMESDRYICVRENSPQNNVVIIDIGMANQAPPQRPINXRFRAQLNPKTRILXLKGQXXGXTKVNXKFSXFKPKKKLXSNKMXXKVLFGKWXTPXXLGWXKKNXFXXGQXXGDPEPTKXFG

SEQ ID NO: 205586 - protein, 194 aa, Triticum aestivum
  unsure (1)..(194): unsure at all Xaa locations
  Clone ID: PAT_TA_100004.pep
MFGFGHHHKDQAPPASGPNQXIFKIYCRASEDYCLAVRDGEVVLAPVNPKDETQHWLKDMRFNNNVKGRGXGMPAFALRQKRATGPPPLKQLQSGPSPNPVKAXWPXKPGRNXGXPPGSVGXXNKGIGERXFRLNXQWAKKXRLRFQPLQRGXXDNGGVEKREQRFFSGNWCKGGKTNAWKNXGPGAXGANPSN

SEQ ID NO: 205587 - protein, 96 aa, Triticum aestivum
  unsure (1)..(96): unsure at all Xaa locations
  Clone ID: PAT_TA_100005.pep
MARGLKKHLKRLNAPSHWMLDKLGGAFAPKPSSGPHKARECLPLILILRNKLKYALTYREVQSILMQRHIXVXGKXRNDKTXPAGFMDXISIPKTG

SEQ ID NO: 205588 - protein, 101 aa, Triticum aestivum
  unsure (1)..(101): unsure at all Xaa locations
  Clone ID: PAT_TA_100006.pep
HKFTVKTLLILTIFVAALTIATANIQVDPSGQVQWXQQQPFXKPQPFSQANNTNXFPQPQQKXPLQPKKKFXQPQEPKKPFXQGQKTQXXIXQQTQKPXPQ

SEQ ID NO: 205589 - protein, 126 aa, Triticum aestivum
  unsure (1)..(126): unsure at all Xaa locations
  Clone ID: PAT_TA_100007.pep
MGKEKTHINIVVIGHVDSGKSTTTGHLIYKLGGIDKRVIERFEKEAAEMNKRSFKYAWVLDKXLKAEREKGITIDIALWKFEXTTKYYCNVIDAPGQRDFIKEXMLLGTPKAECAVLXIXSNNGGF

SEQ ID NO: 205590 - protein, 82 aa, Triticum aestivum
  Clone ID: PAT_TA_100008.pep
MAEHKEEPVAESMMDKISDKFHGGDSSSSSSDSDDEKKGVGGGRQRQNLTASGREETRPTPSSGGRETCCSMEEKKSPGAWW

SEQ ID NO: 205591 - protein, 191 aa, Triticum aestivum
  unsure (1)..(191): unsure at all Xaa locations
  Clone ID: PAT_TA_100009.pep
MGKEKTHINIVVIGHVDSGKSTTTGHLIYKLGGIDKRVIERFEKEAAEMNKRSFKXYAWVLDKXKAEREKGINIXIALXKFQEQQSXLATVXXAPGQXRTXTKKXINGXSQAECAXLNNXTQQLGXXXAGXXKDGKTLNNAXLXXNXGVKQIICSFKKMDXTXXNYQKXXYKEIXKEXPSYLKKGGTLKRF

SEQ ID NO: 205592 - protein, 46 aa, Triticum aestivum
  Clone ID: PAT_TA_100010.pep
MSADLHYQIQLILHIFLGELICLKFMCGNAFRNDSNKPFIPEQTYT

SEQ ID NO: 205593 - protein, 59 aa, Triticum aestivum
  unsure (1)..(59): unsure at all Xaa locations
  Clone ID: PAT_TA_100011.pep
MPVSRIAVGSHREVYEVGALKAALAEFISTLIFVFAGQGSGMAFNKLXSPDGAANPAGL

SEQ ID NO: 205594 - protein, 186 aa, Triticum aestivum
  unsure (1)..(186): unsure at all Xaa locations
  Clone ID: PAT_TA_100012.pep
MKTFLILALLAIVATTATIAVRVPVPQLQPQNPSQQQPQEQVPLVQQQQFPGQQQPFPPQQXPYPQXPQPFPSQQPYLQLQPFPQPQXLPYPXPQLPYPARPQXLPYPQXPQPISDQQTTNFQQIGNQQVFATNKQPISQASKQAXTXTXXKNNNKQQQQQQILQQXILEQQLXPCKGLYCNNSIA

SEQ ID NO: 205595 - protein, 129 aa, Triticum aestivum
  unsure (1)..(129): unsure at all Xaa locations
  Clone ID: PAT_TA_100013.pep
HLLLLKSAXVSAKPTLYAAPKASTXSMPQAXPTQSVDFIALQNEVEKXLKKLXGWXXFSAXINFFSRVXXXQCTNNPFWGPGXXLXXKKSPXXKILKKNKXGGQXWGKXLQLXGLAKNXGFXXFXVGIF

SEQ ID NO: 205596 - protein, 129 aa, Triticum aestivum
  unsure (1)..(129): unsure at all Xaa locations
  Clone ID: PAT_TA_100014.pep
RTFLPSIQISPTPPPPPPPPHXPPAAAEPRAPARPRCSRCRAPHPPPPPRSATPGSSPXPSPPPLALPPLLTPSPRLPSSTRRLTQLTPSPSLAPASPPLPRXFXTNICASVGTVDWATEPTQLKNTSD

SEQ ID NO: 205597 - protein, 157 aa, Triticum aestivum
  Clone ID: PAT_TA_100015.pep
TSAATRPSSPPSAARPTSSRRPSSPRPNEDKGAPTINPARSPPPRQAPASSAAPSGSPSSPPPTPRTPSPRPGPLRCPATTSFSSSLASSIIESASLAPPGKRADGFHSGKLVVNPAKVKKVVAEKIIVSVLAVNGTLSPGGKNLKIGFWGTEWWKN

SEQ ID NO: 205598 - protein, 174 aa, Triticum aestivum
  unsure (1)..(174): unsure at all Xaa locations
  Clone ID: PAT_TA_100016.pep
PTPHSSLSKKKKKTPHSSLQPAMTGDPAAAGPGRKAPPPARPPRPXSPSSPPSPSGSTSPPRSPSSXPPPSXPLPPPPPSPPASPPPPPLRRAPPQAPTKAGTFLXSTPGPAGQSGTTTRSFSRGSPAGILFLSAASFLPVGAPRALNFPGKARGFGGPLRPRNRGEIRIFQGV

SEQ ID NO: 205599 - protein, 161 aa, Triticum aestivum
  unsure (1)..(161): unsure at all Xaa locations
  Clone ID: PAT_TA_100017.pep
MARGLKKHLKRLNAPSHWMLDKLGGAFAPKPSSGPHKXXKCLPXILILKNXRLKYALTXREVQSILMXRHXITVDWKRPQLDXXXNPGWFQXEINFQFPKNWWKKLTRLXGMNTKGXLXAFNLLREERXXKFKXPAKVXRSVQFGQKGXPNLNNYDXPNXR

SEQ ID NO: 205600 - protein, 152 aa, Triticum aestivum
  unsure (1)..(152): unsure at all Xaa locations
  Clone ID: PAT_TA_100018.pep
DPISPIPXPLGFSTMASASRALLLSRASPLHAAASRFLRPVAAAGKPPPGXAGPVPRRGALGGGEAIRDATRELVAAGLVPELGANARPRKRXSSKGANXNNGXVXHGSRPQGKGLNPMSTSXKLXXGKXKPSPKVXGSEKEARDEDXLRVN

SEQ ID NO: 205601 - protein, 172 aa, Triticum aestivum
  unsure (1)..(172): unsure at all Xaa locations
  Clone ID: PAT_TA_100019.pep
MKTLLILTILAMAITIGTANIQVDPSGQVQWLQQXXVXQXQQALSXXPQHTFPQPQQTFPHQPQQQVPQXPQQPQQPFLQXPQQXFPQQPQQPFPQTQQPKQPFSQATTRTIFPRXXKPQQPFPQQPKXSNSPQTQTXPNNQFSQAXXNXKXPFPXPKKNLATPNKLIPPKK

SEQ ID NO: 205602 - protein, 171 aa, Triticum aestivum
  unsure (1)..(171): unsure at all Xaa locations
  Clone ID: PAT_TA_100020.pep
MGKEKTHINIVVIGHVDSGKSTTTGHLIYKLGGIDKRVIERFEKESRXRLTSGRSKYAWVLDKXXAEREXGITIXIALWKFXETTKXYCTVIXAPGXRYFIKNMITGNSQADCAVLNNDSTTGGFEGGNSKGGQTRXQXLLGFXPGVKQIIWCWNKMVPTXLIPKXRFKEX

SEQ ID NO: 205603 - protein, 192 aa, Triticum aestivum
  unsure (1)..(192): unsure at all Xaa locations
  Clone ID: PAT_TA_100021.pep
PPSPIPPPTMTTSPIQRPDRRLLSIPTRRRRQWIRCVAACPRSPRAAAGPGNLSRASITAAAHPPHARPTTGATPRAPPRXQLPPPNCNPRTGPQIPTTPDCLVPPTNSVGLXPNSGGLLQNEPAGPWNXGPDXRXQRPKXNCGIXNVCCKKKQXFLNSGLWNFWVWNPXRVEXXXAXERTFRCXQXLNXXN

SEQ ID NO: 205604 - protein, 162 aa, Triticum aestivum
  unsure (1)..(162): unsure at all Xaa locations
  Clone ID: PAT_TA_100022.pep
MKTFLILALLAIVATTATIAVRVPVPQLQPQNPSQQQPQEQVPLVQQQQFPGQQQPFPPQQAIXPKPQPFPSQQPYLQXLQPFPQPQLTYPQPQLPYPQXQLPYPQPQPFRPKQPYPQSQPQXYSQPQQPISXQQXQXQQQQQKQQQQPQXQQVXQQXLXQH

SEQ ID NO: 205605 - protein, 160 aa, Triticum aestivum
  unsure (1)..(160): unsure at all Xaa locations
  Clone ID: PAT_TA_100023.pep
XXKGFSWPKIXVGKLDLXKTQIHGVLSFQGGXEXPPFPQAGXKLARPLARLTNSPFSHQAPRINXVRFSDPEXXXPDVPGKPQGXPAXPPGXLWPAGRRQXPKAXGGLFXFPXPQSKVGGGAEAEDPNFXIXLGNGGRPASSWIVFRRRRFRLGGSVWCY

SEQ ID NO: 205606 - protein, 126 aa, Triticum aestivum
  unsure (1)..(126): unsure at all Xaa locations
  Clone ID: PAT_TA_100024.pep
SRSHLGRGTRSRRRXSTPRCCPSLSPRGTSPEQRTAASAPQLLPLSLCHRPRPRPGRISRLHVLQHSSRTPPAWIRSGXNAAASNLMPIAVAKNPAAPPTNWLAPNRLRLRLLLXXVNPASPGTPI

SEQ ID NO: 205607 - protein, 186 aa, Triticum aestivum
  unsure (1)..(186): unsure at all Xaa locations
  Clone ID: PAT_TA_100025.pep
SLLRPPPPFVPSPLPPFVPSPPPLHPFTVALALIRRVNHTSQAPASTDPALVQDPAPILVRTRRRRRPRIWLHLSPSRRRGALCRKPRSKEEQPPPRFEKEVXAAEVRKELGTKNFLPXRAATTPPPTPPPSAWQKWVSTSLLTPFKGKNSPPLPISSLRQRQXLPPLTDLXKKRASXNPGVPSWQ

SEQ ID NO: 205608 - protein, 177 aa, Triticum aestivum
  unsure (1)..(177): unsure at all Xaa locations
  Clone ID: PAT_TA_100026.pep
MSTMXTLFXLXIXAMXXTIAXANXQVDPSGQVQWPQQQPFRQPQXPFYXXPQQTFPQPQQAFPHQPQQQFPQXPQQPQQQFPQPQXPQQXFPQPQQAQLPFPQQPKXPFPQAQKPQQXFSQSQXQPQXXFSXAQKTQKSFPQXQXTVXSSHFYKNQLEPLXEITLXXMXPVFLGVPP

SEQ ID NO: 205609 - protein, 175 aa, Triticum aestivum
  unsure (1)..(175): unsure at all Xaa locations
  Clone ID: PAT_TA_100027.pep
MKTFLILALLAIVATTATTAVRVPVPQLQPQNPSQQQPQEQVPLVQQQQFLGQXQQPFPPQQPYPQXPQPFPSQQPYLQLQPFPQXPQLPYSQPQPFRPQQPYPKPQXQXYSQPQQPISQATSKQASKQQQTTTNXXXQPANPSTKFCNKQLDSNADCCCKQTQQRRGKLKRFCN

SEQ ID NO: 205610 - protein, 131 aa, Triticum aestivum
  unsure (1)..(131): unsure at all Xaa locations
  Clone ID: PAT_TA_100028.pep
MWGERAHHKHGHHHDNVGSKDQQPKFIANNYSSVDEVIAAXRETGLEXSNLILGXDXNKSNEWSXXHSFGKKSLHANSXNPNPNEQANSXXGRTITTFDEYYFIPSXGFGDXPNKXNPGLNFYKKTVPGFG

SEQ ID NO: 205611 - protein, 192 aa, Triticum aestivum
  unsure (1)..(192): unsure at all Xaa locations
  Clone ID: PAT_TA_100029.pep
MASPAPPFPGAPPTPSSHDAPAAPPCRPDASPTLEAQADLPDHLTEEILLRLPAAADLARASMAGPSLRRIVADHSFLRRFRTLHPPPLLGILSDSFLPAQPPHPSAAAARTLAATDFSCSFLPSREQPWRRCDFRDGRALLCVAPDACDLVRDVAVCDPLHRRYLLLPPVPXXLSDIVYHWELFLAPAGGA

SEQ ID NO: 205612 - protein, 103 aa, Triticum aestivum
  unsure (1)..(103): unsure at all Xaa locations
  Clone ID: PAT_TA_100030.pep
NTITNLKIHQGFNKITNHNSPKGVPLVTIQQITAAHLYSSLPPLPHNKTEERQNLQLKAVTQGQPAACFCGLIXSCXTMXTLSGCFTEDPSKTGAARPKTRLY

SEQ ID NO: 205613 - protein, 181 aa, Triticum aestivum
  unsure (1)..(181): unsure at all Xaa locations
  Clone ID: PAT_TA_100031.pep
TRLIPKLEPIALTPELEPSPDGHPDLTGHLHFTQHQIDAVPADHRLVVSNPQPEPNPQGSIPPAHSDTSVSSSSSTAKKRARGGEMVRVNTVTPQXHIHFRSLVRRARLTFEALRGIYQREESYDXXXRNRFDLRASSKMLSRGLWLYRDVRIVXXIPGVLVGDAFHYRAELCVVXXHCTP

SEQ ID NO: 205614 - protein, 192 aa, Triticum aestivum
  unsure (1)..(192): unsure at all Xaa locations
  Clone ID: PAT_TA_100032.pep
SVLAARELTDDLSIAASHESWMLQYGRVYKDATEKAQRLKVFKANVEFIESFNAENHKFYLGVNQFADLTNEEFKTTTANKGYKSSLERAPTGFRYENVSLDALPATVDWRTKGAVTPIKDQGQCGCCWAFSAVAATXXIVKLKTGKLISLSEQELVDCDVHGVDXXCXXGLMDDAFKFIISNGGLTGESXY

SEQ ID NO: 205615 - protein, 144 aa, Triticum aestivum
  unsure (1)..(144): unsure at all Xaa locations
  Clone ID: PAT_TA_100033.pep
WSVLVLWCWWQQRRLRRQNNQEMGTKSATRTDMLVDIGTEAGCDNLEVPRHVGNGSASPAKGTKRKFVVDATKGASPGVNASNTGQHLHSRRKGKGPGKHAKLEDNKGATXXGRDQTPIGVFEDECVFXHSFXTSEQFXXXMXX

SEQ ID NO: 205616 - protein, 175 aa, Triticum aestivum
  unsure (1)..(175): unsure at all Xaa locations
  Clone ID: PAT_TA_100034.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIXXLFL

SEQ ID NO: 205617 - protein, 138 aa, Triticum aestivum
  Clone ID: PAT_TA_100035.pep
SVLRWIALVLLPAIAVRVSGARMAEPSRVIHIRNVGHEISETDLLQVVQPFGAVAKLVMLRTKNQALVQMEDLSASISAIQYYTTIQPSVRGRNVYLQYSSHQELTTDQSSHGRNPDQVHNYPVALWVLYSISMIAFL

SEQ ID NO: 205618 - protein, 147 aa, Triticum aestivum
  unsure (1)..(147): unsure at all Xaa locations
  Clone ID: PAT_TA_100036.pep
ARGRSPSSSAPPPPADRRPPRHRTPPRMSRPLAAPPAPAXSSPLPPPSPAASSPPXDSPLPATTAHPKPSPCRRRGFGDSSPAHTSPPHIAQPTGWSSSARWPWPWGAQAPPPISSPPPSQSHQFPWIPMLPPFAAADLVATSTANI

SEQ ID NO: 205619 - protein, 110 aa, Triticum aestivum
  unsure (1)..(110): unsure at all Xaa locations
  Clone ID: PAT_TA_100037.pep
MSWRDPAVPATGRFNSRPQPVPPPTPHPPPVVVIDEDDDDVGADDVAAAESEVFIIDDDDDDVEIARVMAACISKKGNSSCSNVINIDDDDXXDXXDGGRAGPSMXXAGX

SEQ ID NO: 205620 - protein, 92 aa, Triticum aestivum
  unsure (1)..(92): unsure at all Xaa locations
  Clone ID: PAT_TA_100038.pep
MAATGVGAGCLAPSVRLRADPAHRATACVVRARLRRVARGRYVAELSREGPAARPAQQQLAPPVVPGFLAPPPPAPAQSPAPTQPPLPDAGX

SEQ ID NO: 205621 - protein, 142 aa, Triticum aestivum
  Clone ID: PAT_TA_100039.pep
HEGQISHAPHLLFPGTTPPPRRRAIPMAATGGGGGGGGRHWIEAETPDFRARMRRIYLPTKLATYFQPKYSPNSLEAQTLIARLEEDAFRGTNSKVEYVKKISDKVVTMLRNKTDELQRRAQLQSQLQQAIEAQALHGGSSS

SEQ ID NO: 205622 - protein, 176 aa, Triticum aestivum
  Clone ID: PAT_TA_100040.pep
MTSHRRLRSTARPPLENDDLLSEVLLRLPPQPSSIPRASLVCNPWRSLVSDPGFLRRFRLQHRRNAPLLGFFYISFAEGSSRDIYFVPTMDRPNRLPEGRFYLPADPEDGYRALLGCRDGLVLILRLPWRCPEKTKTPLASWRPVLVWDPVSGDQHPIPVPLVPDDVKLSWWNNAG

SEQ ID NO: 205623 - protein, 101 aa, Triticum aestivum
  Clone ID: PAT_TA_100041.pep
TVRAAAEEAVRRADQRLQLLLLLRPVGLPPWPTLPPCSGCTGRRASLYGQPRPHFPLHQPPPLSPAGAGLLPRPDPCATNLSDGSTTAYSPIGHGSMVASR

SEQ ID NO: 205624 - protein, 179 aa, Triticum aestivum
  unsure (1)..(179): unsure at all Xaa locations
  Clone ID: PAT_TA_100042.pep
KRKRKQGLGREGQTKSKRLKNTSCAHTVSSHPRRPVRPPHFRVSACGSQPQPTPESPAARRKSPRIRRPCSATPTDPRTPAPRRRPPTSPSPTASSPSAATSATSPPSPPPPPPRPLLPRPPRHPQRRRAPPRLPTPTPPPTPRPTPPTPSSAWSATSSTSPRPSAXIPPGTTWSAGRS

SEQ ID NO: 205625 - protein, 134 aa, Triticum aestivum
  unsure (1)..(134): unsure at all Xaa locations
  Clone ID: PAT_TA_100043.pep
HEAPSRLRPRPAPNPSHPIPSHPFPHLTNDSQATAPAVSCTALLHPPPTSPRVPLPPQNLSPRTIYPPTSDCGRLIRRARRWRRREPTRSGRGGDDEATAAAEPAAALGGGXGGALLRQRGQGRGGPXXXXHGR

SEQ ID NO: 205626 - protein, 127 aa, Triticum aestivum
  unsure (1)..(127): unsure at all Xaa locations
  Clone ID: PAT_TA_100044.pep
MAXXXXKRISKGRKGXXXXAVDPFTKKQWYDIKAPLLFTSRNVGKTLVSRTQGTKIAXXGLKHRVFEVSLADLXXDEDQAYRKIXLRAEDVQGMNVLTNFWGMDFTTDKLMSIVRKWQTLIDXYVDX

SEQ ID NO: 205627 - protein, 208 aa, Triticum aestivum
  unsure (1)..(208): unsure at all Xaa locations
  Clone ID: PAT_TA_100045.pep
LAAPASRRRWPAAPPRAPKSSFLPLLPCADQRSHADLAGRSDVFCRRCRVHPIWQRRNGLGGEIPTWPPPTVVSWRQSDDTKDLPRTATTGHAHDTSPRRHACVLGSTSVGSTLVVGRAMGSLRVLPLPRECDPVFCSLHWQREDPFPISSGENDPLGPLWHLHCLVNQAANRGIKXXVFEXXXIGSXXXISHAHIESRAGEXXIEHA

SEQ ID NO: 205628 - protein, 128 aa, Triticum aestivum
  unsure (1)..(128): unsure at all Xaa locations
  Clone ID: PAT_TA_100046.pep
SRWCTCGPTPPSTPPPHPPPGTRTPRPCAGARRRTAGPLKPTTPTPRSRASRPRSSASPRASTTSASPRATTPSPPRRGRGRGGSASPPSTTSPLMPXTPTTCSSSRTSSSPRPPRRSPSPPPSSXGG

SEQ ID NO: 205629 - protein, 194 aa, Triticum aestivum
  unsure (1)..(194): unsure at all Xaa locations
  Clone ID: PAT_TA_100047.pep
MKTLLIVTILAMATTIATANMQVDPGYQVQWPQQQPFPQPQQPFCQQPQQTIPQPHQTFHHQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNXLLQXCNPVSLVSSLISMILPRSXXXXM

SEQ ID NO: 205630 - protein, 180 aa, Triticum aestivum
  Clone ID: PAT_TA_100048.pep
MESVMLPASMVLVQLFSILLVLLSKLALNTGMRPFVLLAYRNLIGAAAVAPLTFVFERKKAKIPNLIEWGWISMNATSGVILAMGLYYYGLRGTNATYSVVFLNLIPIVTSVVAILLRAEKLVFRKWHGKMKLLGIVACAGGTMVVSLYKGKMLHHPWPTHLLSHTAAPAAHHNMVIGTS

SEQ ID NO: 205631 - protein, 185 aa, Triticum aestivum
  unsure (1)..(185): unsure at all Xaa locations
  Clone ID: PAT_TA_100049.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQISERLGVQVSDVXXAII

SEQ ID NO: 205632 - protein, 73 aa, Triticum aestivum
  Clone ID: PAT_TA_100050.pep
LGQNVGWGVGKILLKVLQNEQFFLGGHQRNRGYHFKTYGSYYGNVLRFYCRGGGKLFDGKMKSKLCDPWYCCG

SEQ ID NO: 205633 - protein, 187 aa, Triticum aestivum
  unsure (1)..(187): unsure at all Xaa locations
  Clone ID: PAT_TA_100051.pep
QSLRWQQPSPPPXMQVDPSGQVQWPQQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVPILRPLFQLAQGLGIIQPQQPAQLEGIRSLVLKTLPTMCNVYVPPDCSTINIPY

SEQ ID NO: 205634 - protein, 197 aa, Triticum aestivum
  unsure (1)..(197): unsure at all Xaa locations
  Clone ID: PAT_TA_100052.pep
MKTFLIFALLAIAATSAIAQMETSRVPGLEKPWQQQPLPPQQQPPCSQQQQPFPQQQQPIIILQQSPFSQQQQPVLPQQQPVIILQQPPFSQQQQPVLPQQPPFSQQQQPPFSQQQQPSSQQPPFPQQHQQFPQQQIPVVQPSVLQQLNPCKVFLQQQCSHVAMSQRLARSQMWQQSSCHVMQQQCCQQLPQIPEQX

SEQ ID NO: 205635 - protein, 126 aa, Triticum aestivum
  unsure (1)..(126): unsure at all Xaa locations
  Clone ID: PAT_TA_100053.pep
IWSHRSWATNYIQIWSPRCGRPTIFSRSGANMMIGDGGKRHTISDGHVLPRLASEKLVVASTSRSAINIKEEFEADIMQNINRSSDTPISMHRVMFGPXXWADLPHGLLHSIIXLLGSTXXXXXXI

SEQ ID NO: 205636 - protein, 83 aa, Triticum aestivum
  unsure (1)..(83): unsure at all Xaa locations
  Clone ID: PAT_TA_100054.pep
XARQCHRSFKCCPGMQVXSXXRXXRXXRPPREEEAVXSAQXXPGGGDRSPAGEIGGDWKRAGGGGGGVIRDCRVLAGVILLFY

SEQ ID NO: 205637 - protein, 148 aa, Triticum aestivum
  Clone ID: PAT_TA_100055.pep
SRQLRDKFDALFSGLFSFPIYFPGTPFYRCMQARKNVQKILRDTLAERLSTPGKKHGDLLDVIVQELQGEGPLISESFAVDLVSTLLFSSVFTLSGIIAVAFKSLHDNPDVVHALQVGCINYVILYIYTSSIIKILVVLLMLVDPRHI

SEQ ID NO: 205638 - protein, 190 aa, Triticum aestivum
  Clone ID: PAT_TA_100056.pep
MDNSAPPVIIVGAGPSGLAASACLARRGVDSIVLERDDCVGSLWQKRAYDRLHLHLPKQASALPHLPHDDDAPAYLPRDHFVRYLDAYADRFAVRARLRLRREVRSARFVDGRWEVEAVNLATGDAEQYTARFLVVATGEFDEKVLPEVPGLDTFHGEAIHAGEYRSGEGMRGKEVLVVGCGNSGMEIAL

SEQ ID NO: 205639 - protein, 189 aa, Triticum aestivum
  unsure (1)..(189): unsure at all Xaa locations
  Clone ID: PAT_TA_100057.pep
PTTFHGAGILVPAMNTDALLRFNCRKRCLPADGRLDDHWRGQQRKRRGVRVLVPDCFLVPPPEAKSADFDMWDYICSIPDRLGWGNGLRLLKGWVRASKDVPQDPSDLTCLTKNSDVKPGRVVVAGNWKVDDPVKVALKAAAPPPPRREKVKPYWKYLHEETRHNDKSLGEIDARVALLEXXLEEXXXV

SEQ ID NO: 205640 - protein, 130 aa, Triticum aestivum
  Clone ID: PAT_TA_100058.pep
MKTFLILSLLAIVATTATTAVRVPVPQLQPQNPSQQQPQEQVSLVQQLQYPGQQQPFPPQQPYPQPQPFPSQQPLPQPQPFLPQLPYPQPQPFPPQQPYPQPQPQYPQPQQPISQQQAQQAQQQQQQQQQ

SEQ ID NO: 205641 - protein, 65 aa, Triticum aestivum
  unsure (1)..(65): unsure at all Xaa locations
  Clone ID: PAT_TA_100059.pep
VSAAAXXGXEGNGPAAAGLGAASLGTVPAIPXXLPARGLVXRGXRLGWVGRPRGLLRGLAERASC

SEQ ID NO: 205642 - protein, 147 aa, Triticum aestivum
  unsure (1)..(147): unsure at all Xaa locations
  Clone ID: PAT_TA_100060.pep
MKTLLILTILAMATTIATANMQVDPSSRVQWPQEQPPPQSQQPFSQQPQQSFPQQQQWMIQSFLQQQMNPCKNFLLQQCNPVSLVSSLVSIILPRSDCQLMQQQCCQRXXQIPQQLQCAAIHNVAHSIIMQQEQQRGVQILRPLFQL

SEQ ID NO: 205643 - protein, 154 aa, Triticum aestivum
  unsure (1)..(154): unsure at all Xaa locations
  Clone ID: PAT_TA_100061.pep
MVRHKKQYNTMGVVDNMQNVKVKEEEDENINMKGKRKQNKAEGGKKAEEKQNSSKRKMDKNKEEKEKRMRVVDKNDDEKEREDRSKRKENEKKVKSHIERKEDNDNKKEEQGQREIEKEKVEEEKEIXXXXXRKEEEDSKEKDKDXNDKTNCPH

SEQ ID NO: 205644 - protein, 199 aa, Triticum aestivum
  Clone ID: PAT_TA_100062.pep
NTYVSVTILLACLILALGGKEVKCIRRDENTSGVPLNRKVNNTIVVDRGDVYDCIDVNLQPAFSHPLLKRHKIQMEPSSFPQSVSTKSPSIHARPPAQLSLIECPTGMIPIFRKNRRIHKLVQAINKVISKNEQQEVAGFEYLDVLYGTRAKINIYEPKVKNNSKDLSASWIQIKGIQKLADGIGAGSWVYYSGDSLAH

SEQ ID NO: 205645 - protein, 144 aa, Triticum aestivum
  unsure (1)..(144): unsure at all Xaa locations
  Clone ID: PAT_TA_100063.pep
MAEAAGPTPLLHGLPDEISIWEILVRLPPKPLLRCRAVCRAWRRAASARDFLLAHHARQPSLPLLFVDTDDQSSIDIITCDQRAADELHSVARLDAPSGVSLRACCDGLLLLRTWNXXXPSLSICNPVTRQYAPLHRLDDXXXX

SEQ ID NO: 205646 - protein, 138 aa, Triticum aestivum
  Clone ID: PAT_TA_100064.pep
ISLGAAKRIFPLASLPSYSKPTSAMAEPCKIPAAMVAESVERSYVLKIDGYSRVKGLLKNGKFVASTPFSVGGHNWTVKYYPNGCPKYCDDFISLYVHHESAGAKEVKAKLTLNVLDKNGNPVPSYTRTTPVNTFSKQ

SEQ ID NO: 205647 - protein, 176 aa, Triticum aestivum
  Clone ID: PAT_TA_100065.pep
SPTHLPYGWTGSLKHLVCTMASDQQQPDMGMPGAGRMTSALCVAWSTLLLLRSDAQISPLLHYAHYNPTFEIGDKRRRGAAWDGSGGRGGHDGCGGSSVVLPWHRRPRWQRAARRWVGWGFLLCSCFEVGEGRRSNEQCRKRRSRRGSGTDGLARGGGGAAAARNPSGRSGVWGSS

SEQ ID NO: 205648 - protein, 77 aa, Triticum aestivum
  unsure (1)..(77): unsure at all Xaa locations
  Clone ID: PAT_TA_100066.pep
ISDGRDKNCIPPGRPARIGAGIWRRFPPSVLFFFLDDCLSLFSTFRRRLPVPVNTEIVPDYCHTGILNCECTRKKXK

SEQ ID NO: 205649 - protein, 107 aa, Triticum aestivum
  unsure (1)..(107): unsure at all Xaa locations
  Clone ID: PAT_TA_100067.pep
MWLPWVKTRSSSPTSASTCSSTALAAASPRLSFNSPSLKDLQALLRSDPAAPSPSPPQPPHTXPCSPSAARVFHRVRIAASALRGASQPGGRRPAPPXXGDRRVVLX

SEQ ID NO: 205650 - protein, 56 aa, Triticum aestivum
  unsure (1)..(56): unsure at all Xaa locations
  Clone ID: PAT_TA_100068.pep
XGVXXNXGXPLPLRLXXSFPPPXNPRRPAAASFIPGACARRKPLTLAELSGASRPR

SEQ ID NO: 205651 - protein, 88 aa, Triticum aestivum
  unsure (1)..(88): unsure at all Xaa locations
  Clone ID: PAT_TA_100069.pep
RVGVIHNYKYVCKQDCIFTPVLFWCXVSWDLLSIKYAKGYLFLVAPFGNFNNVMXRXMGNTDNITYIRVLVHTLLPXXIIGPTKLIWX

SEQ ID NO: 205652 - protein, 109 aa, Triticum aestivum
  unsure (1)..(109): unsure at all Xaa locations
  Clone ID: PAT_TA_100070.pep
TSXXKVSXHXRLMFNCWGRLRXXFLXSPPFAXPGXLSSSRPFPXFPVAAVELGAELAVALGARLGGACGRTCGXSSRAFWPXXPLALGVGXGWGGEGRRRRGERVQGFP

SEQ ID NO: 205653 - protein, 150 aa, Triticum aestivum
  unsure (1)..(150): unsure at all Xaa locations
  Clone ID: PAT_TA_100071.pep
MFGFGHHGHHXQXPPAHAPAAAGGNQPTFKIFCKADEGYCLSVRDGNVVLAPSNPRDEXHQHWFKDMRFXQARSRDEEGNPAFXAIVNKATGLXRQSTPLGQSHPVKAXCHXXPEYFXXPMLDRKRTFGKFRLHFMGEIPPPNFRTPSKG

SEQ ID NO: 205654 - protein, 135 aa, Triticum aestivum
  unsure (1)..(135): unsure at all Xaa locations
  Clone ID: PAT_TA_100072.pep
IFSXPDGTGGGEXIRTGARSXNRXGPWXXTXIXXNGYDEGDEAIVXPATLTAPIAXXPHKXPFPRRRRXHRRRVRRRRRLGPRXAXSAPGPSPASXVXXXRGSVAPWAGLLRRPGAAAVGGGGVAAGAGRRAMEG

SEQ ID NO: 205655 - protein, 75 aa, Triticum aestivum
  unsure (1)..(75): unsure at all Xaa locations
  Clone ID: PAT_TA_100073.pep
MASNGVGNSNSPYSASSPDVRPSSPLPATNSSPPQSARRAXGRLRXGPTSFSSXRAGFETPPXPGPPHSVQVLAK

SEQ ID NO: 205656 - protein, 45 aa, Triticum aestivum
  unsure (1)..(45): unsure at all Xaa locations
  Clone ID: PAT_TA_100074.pep
HPXEICHIXLNXXGXXSSXHVRLXXYXYHXPSAREVXSLAXRNVN

SEQ ID NO: 205657 - protein, 99 aa, Triticum aestivum
  unsure (1)..(99): unsure at all Xaa locations
  Clone ID: PAT_TA_100075.pep
MRECISIHIGQAGIQVGNACWELYCLEHGIQPDGQMPGXKTVGGGDDAFNTFFSETGCXGNMSPRAVFVXLEPXVIDEGKDWVLNGQALSTLEPYQLGK

SEQ ID NO: 205658 - protein, 115 aa, Triticum aestivum
  unsure (1)..(115): unsure at all Xaa locations
  Clone ID: PAT_TA_100076.pep
MNFSVGAGGSGDGGGEGGRVQAERWLEIAAKLLAARDIVGCKRFAERAXVEXDSLLPGRTKSLARLFLSQGDGSNRKKPEPPVLPRPSKQTGGPIRGPFGRPLGVPPSKSKPPPG

SEQ ID NO: 205659 - protein, 48 aa, Triticum aestivum
  unsure (1)..(48): unsure at all Xaa locations
  Clone ID: PAT_TA_100077.pep
KDEXTKAPLNPXGITLRNAIYNPVNFQLPKKXLSGEVQQSHIYIPYYS

SEQ ID NO: 205660 - protein, 165 aa, Triticum aestivum
  unsure (1)..(165): unsure at all Xaa locations
  Clone ID: PAT_TA_100078.pep
ASKQMVGVFLMIWVRSDIREHVKNLKVSCVGRGLMGYLGNKGSISISMSLHQTSFCFVCTHLTSGQKDGDELRRNADVVEILKKXTRFPHAHGARDEKXPEAILXHDRIIWVRDXNYRIAPSYRSXKALVQDHNWETXVGKKDXXXIKXKGFGGIPAGKKEGFQP

SEQ ID NO: 205661 - protein, 129 aa, Triticum aestivum
  unsure (1)..(129): unsure at all Xaa locations
  Clone ID: PAT_TA_100079.pep
MARTKQTARKSTGGKAPRKQLATKAARKSAPATGGVKKPHRFRPGTVALREIRKYQKSTELLIXKLPFQRLVREXSQDFKXTDLRFPKLPPLAAEGRAITLGALFQGTKSSAHTPKRLNWPKGTFRPGP

SEQ ID NO: 205662 - protein, 140 aa, Triticum aestivum
  unsure (1)..(140): unsure at all Xaa locations
  Clone ID: PAT_TA_100080.pep
MSCCGGNCGCGTACKCGNGCGGCNMYPEVEAAGATLLVSATATHKASSGGMEMAAENGGCGCTQCKCGTXSCGCSCCKLLNSSSIMHAPCRAFIIHIDLLYHVTTWIGPLMATDPASTKVHEFVKAPKKTSPDLKKKKKK

SEQ ID NO: 205663 - protein, 75 aa, Triticum aestivum
  unsure (1)..(75): unsure at all Xaa locations
  Clone ID: PAT_TA_100081.pep
GRGSITNKSEXSQVXSFLMVLWXGFHLNKHXXIPVNLSHXMKSXXXKSXXKVXPRLSXXICXLAXXNXDXCPGTG

SEQ ID NO: 205664 - protein, 83 aa, Triticum aestivum
  unsure (1)..(83): unsure at all Xaa locations
  Clone ID: PAT_TA_100082.pep
PLASPRRRRTHSAAPSPAXPPSPDGQXPRSSSTCATSSTSAPITLPSTIXTXXGLDXDXAVGARXHXLXAPTSXXGXPNXAGV

SEQ ID NO: 205665 - protein, 46 aa, Triticum aestivum
  Clone ID: PAT_TA_100083.pep
AGHNISIEREKHQLFNHHMSRIEHHIFNISTDRVKHEFFHLNPSLW

SEQ ID NO: 205666 - protein, 142 aa, Triticum aestivum
  unsure (1)..(142): unsure at all Xaa locations
  Clone ID: PAT_TA_100084.pep
MARTKQTARKSTGGKAPRKQLATKAARKSAPATGGVKKPHRFRPGTVALREIRKYQKSTELLIRKLPFQRLVREIAQDFKTDLRFQSSGVSALXEGRRRPNLGGGCSRTTTLCANHAKXVHHHAQRXFXSARRIPLEKLKVC

SEQ ID NO: 205667 - protein, 115 aa, Triticum aestivum
  unsure (1)..(115): unsure at all Xaa locations
  Clone ID: PAT_TA_100085.pep
MAQKDAANGNGATTRPPPTPSPIRFSKFFQANMRILVTGGAGFIGSHLVDKLMEXTRKNEVIVADNFFTGSXKDNLKKWXXQPKISSLNVNGTNWRGVDQNSNQPLLVPGLNQIL

SEQ ID NO: 205668 - protein, 120 aa, Triticum aestivum
  unsure (1)..(120): unsure at all Xaa locations
  Clone ID: PAT_TA_100086.pep
ESCRDSVFEELXXPGVFRMFKVHCRSSSRFQIPETHYLSXQGLLISTLQTPPWSKLESVSASRXXGARAAATQYSXEGELVPATSKXDSNSRGGPGYPXXPLXXEVXLPRAQLXXSXXXV

SEQ ID NO: 205669 - protein, 102 aa, Triticum aestivum
  unsure (1)..(102): unsure at all Xaa locations
  Clone ID: PAT_TA_100087.pep
ARVFFFFFCTQNQLNISLNLAILHAYETSSSQHITFCFIYLSTSQYSTSPVAFTRLHCIVRCHWDVLPSPRTIGXNHSRVFXSXPSXGRXPTGKKNRXMEDC

SEQ ID NO: 205670 - protein, 117 aa, Triticum aestivum
  unsure (1)..(117): unsure at all Xaa locations
  Clone ID: PAT_TA_100088.pep
GRMRVLRRLLRKYREAKKIDKHMYHDMYLKVKGNMFKNKRVLMESIHKSKAEKXAXEKTLSDQFEAKRAKSKASRERKHAXRREERLAXGPKRPCTSTSGCSSKLRQQAGTKRPRPK

SEQ ID NO: 205671 - protein, 196 aa, Triticum aestivum
  unsure (1)..(196): unsure at all Xaa locations
  Clone ID: PAT_TA_100089.pep
APVPSRPQPTSHLRLASRRQFHSLAXGKIKIGINGFGRIGRLVARVALQSDDVELVAVNDPFITTEYMTYMFKYDTVHGHWKHXSDIKLKDDKTLLFGEKPVTVFGVRNPEXEIPWGEAGCPITLWKSTGVFTDKGQRXAAHFKGGAKKVVISXPNKDAPMFXGLXVNXDKXXLKTFXIVSKXXAXTTKLALAPLS

SEQ ID NO: 205672 - protein, 77 aa, Triticum aestivum
  unsure (1)..(77): unsure at all Xaa locations
  Clone ID: PAT_TA_100090.pep
SYFSISCFSISCFSSMVFFYKCLVVQQQGAESYSWPSFGIVLCIEHKTATIADGTVCVATMLSFRQDGIKLQVTXFV

SEQ ID NO: 205673 - protein, 114 aa, Triticum aestivum
  unsure (1)..(114): unsure at all Xaa locations
  Clone ID: PAT_TA_100091.pep
MSCCGGNCGCGAGCKCGNGCGGCKMFPDVEATAGAAAMVMPTASHKGSSGGFEMAGGEXTGGCELAPTCKLRQPVRVAPCCLQLEPARRPGRAKRNDREKAKQIQPTNQQALSN

SEQ ID NO: 205674 - protein, 74 aa, Triticum aestivum
  unsure (1)..(74): unsure at all Xaa locations
  Clone ID: PAT_TA_100092.pep
LQEVKKYTHPCTYASSSSLATTYKLLRSVQANSCISHMHKNIFQKLMFVRVKYEWMELLTRLGITILXGXQKNN

SEQ ID NO: 205675 - protein, 152 aa, Triticum aestivum
  unsure (1)..(152): unsure at all Xaa locations
  Clone ID: PAT_TA_100093.pep
SWLRQSRICASLQILARPRCRPPCVAVAFPSARSPNPVHLYASLPLLPDLWLALLVTSGVXFRGGRCSPXCDWRPRPVSRLPPPRSSTQGAWDCPXLWPRAKILCSXFAGXLGKRXNTXWGWPXPFFWEXGLPMXPXFXXPCXXSXNWVKSS

SEQ ID NO: 205676 - protein, 126 aa, Triticum aestivum
  unsure (1)..(126): unsure at all Xaa locations
  Clone ID: PAT_TA_100094.pep
MAPKVAVAKKGDAKAQAAKVAKAVKSGSIKKTAKKIRTSVTFHRPKTLSKARDPKYPRXSTPGRNKLDQYQXILKYPLTTGVCXMKKIEDNNTLXFIRPNLKGXTKKERLRAAVKEKCSNIQGQKG

SEQ ID NO: 205677 - protein, 128 aa, Triticum aestivum
  unsure (1)..(128): unsure at all Xaa locations
  Clone ID: PAT_TA_100095.pep
GYCDADWASCLDDRRSTSGYCVFXGGNLVSWRSKKQPAVSKSTAEAEYRAMSKGLSEMWTTNLLAELKIFXTGCMNVWCDNKSAINIAHNPXVQHXXTXHVGNRQDSSSKEKLHAGDHQLSLSGTFAF

SEQ ID NO: 205678 - protein, 204 aa, Triticum aestivum
  unsure (1)..(204): unsure at all Xaa locations
  Clone ID: PAT_TA_100096.pep
XFLXXGVXFXPXPXLVAXPPQPCKXPLEXXRXSRPXRQGXXAXPNPLKESRPGLXPXRFGALXSXXQRSSGDSPXPPLRKVGAALVFRSKPPVSPGASPFPAPXILPTLXSFFPVAPSTESSTXAPRIGAPPPTNRAPQLGKNVTFHRREGGGLARVMGGEVQDCGEEDTDERERVATXRRATGRREGERSGSETARAVGEREP

SEQ ID NO: 205679 - protein, 100 aa, Triticum aestivum
  unsure (1)..(100): unsure at all Xaa locations
  Clone ID: PAT_TA_100097.pep
RXQXXEHRXXAXGAEVRXRXTGERLPXAGGGTLXXAHXASWXXCAPQXPSGXCASAAPPSVISXQXEEXRQGAXLRQLGXXHXHHHXHRIGARAAAWLEK

SEQ ID NO: 205680 - protein, 77 aa, Triticum aestivum
  unsure (1)..(77): unsure at all Xaa locations
  Clone ID: PAT_TA_100098.pep
PKLEAIWHGTLVRQQSLPATSNHYQELXNDQXTXGPRVTNRPENSIWXLPALHFRXGAKXMGKHXKFLHHPFGACSE

SEQ ID NO: 205681 - protein, 102 aa, Triticum aestivum
  unsure (1)..(102): unsure at all Xaa locations
  Clone ID: PAT_TA_100099.pep
MGKEKTHIXIVVIGHVDSGKSTTTGHLIYKLGGIDKRVIEXRFEKEAAEMNKRSFKYAWVLDKLKXAXREKGYHHLILPCGFREQPLHPFIDGSWVKRLNFN

SEQ ID NO: 205682 - protein, 86 aa, Triticum aestivum
  unsure (1)..(86): unsure at all Xaa locations
  Clone ID: PAT_TA_100100.pep
PISPPQRRKGSVSHHSLXAKQSGSNPRXSXASGSGHLPRGRCRRXPPXRRRLXXRRRXXXPPRXPRPXRRCLPRXSPPXXRXPXXT

SEQ ID NO: 205683 - protein, 120 aa, Triticum aestivum
  unsure (1)..(120): unsure at all Xaa locations
  Clone ID: PAT_TA_100101.pep
MARTKHTXRKXTGGKAPRKQLATKAARKSAPATGGVKKPHRFRPGTVALREIRKYQKSTELLIRMLPFQXRLVREIAQXDFKDRXPLPSPPAVSXLXXAPXAXTLVGLFXDTXLCHPRQS

SEQ ID NO: 205684 - protein, 157 aa, Triticum aestivum
  unsure (1)..(157): unsure at all Xaa locations
  Clone ID: PAT_TA_100102.pep
IRGDLSATRTVRQKRRAGAGACAAYKKWERAAMXGVSLVADAAEELEHKMTTQNLSCNADATVLSFITQQRXLLLMMRAQIXERKQDPQAPSKLKLQLFPINEATRKXLGKGDHNPHLGLTLKFQEKNVFLVLKKSGISWGTNNHGRLGFPNWGTEG

SEQ ID NO: 205685 - protein, 98 aa, Triticum aestivum
  unsure (1)..(98): unsure at all Xaa locations
  Clone ID: PAT_TA_100103.pep
FFFFFFFFQLMCGRQXFSYMVMXXIXHYHRXGTHGLIIKLPEPTYVQQKPRRADDLVQXXHLSKYYMIRYWXLDXWGSEFISFLPPIAGFXRXASXLS

SEQ ID NO: 205686 - protein, 60 aa, Triticum aestivum
  unsure (1)..(60): unsure at all Xaa locations
  Clone ID: PAT_TA_100104.pep
IDYMLSSPLVYIFPNYPFCDGLLSYHSRECMLTNVLMKKKKKKKKKKKKKKKKKKTXGGX

SEQ ID NO: 205687 - protein, 85 aa, Triticum aestivum
  unsure (1)..(85): unsure at all Xaa locations
  Clone ID: PAT_TA_100105.pep
CVLIHQRNSSSLVACSVNRXVTXKXTKWSSLALSLRFEXGXXXAFYNXXXLEXGFXLSXSYPXKXKIGXKXXHPXXXFXXCRFPX

SEQ ID NO: 205688 - protein, 115 aa, Triticum aestivum
  unsure (1)..(115): unsure at all Xaa locations
  Clone ID: PAT_TA_100106.pep
DNARRDGGRXXPRRSPPRTXFXPPPVPRARANTATSATRAIEDLVLRLACWKPWSWEGAEMADVTSPQVTAPDAISATASAASTANTXTSATRAIEDLVLRLACWKPWSWEGXES

SEQ ID NO: 205689 - protein, 175 aa, Triticum aestivum
  unsure (1)..(175): unsure at all Xaa locations
  Clone ID: PAT_TA_100107.pep
KRPPTRIKSGXGIXKPNXPFEXHXGFRXNSGAGLXQGLQQXQGPLNPPSXSXGNPDRAALPXPDPXXSAXSGKXXAAPXAXDGEPPRGRSRGRAVPAAGGSKLAQAATKERRGQASQDGARAGPAAAYHHTGQARRRPPTAAGGGVSXRCXLEAVAKVSPPSRPGRTTRGRRAES

SEQ ID NO: 205690 - protein, 128 aa, Triticum aestivum
  unsure (1)..(128): unsure at all Xaa locations
  Clone ID: PAT_TA_100108.pep
KXRPLVESPXVAPSPGPSKASPARPALRPGRKEGNVLARLGPGSGPDCGPPPRNRRRRAPRSLLPWRHSGGAAVRGGGSSGRRGGGGEDGAGWTDTLRRRRRRLAVGRPPAGPAVASRQTGGGSGSEP

SEQ ID NO: 205691 - protein, 124 aa, Triticum aestivum
  unsure (1)..(124): unsure at all Xaa locations
  Clone ID: PAT_TA_100109.pep
GTNESPANLVSDRPQARRILLPRRLKMQIFVKTLTGKTITLEVESSDTIDNVKAKIQDKEGIPPDQXQRLIFAGKQLEDGRTLADYNIQXRESTLQLVLRVRWVGMQDLPSKLNWAKNINPLKG

SEQ ID NO: 205692 - protein, 115 aa, Triticum aestivum
  unsure (1)..(115): unsure at all Xaa locations
  Clone ID: PAT_TA_100110.pep
MGDRVKGTXKWXXXTKGFGFISPEDGXXDLFXHXVLHQXPTATAXSNXNDTXXKFXVITGXDGXTKASDLTAPGGXTXLXRXPAPGRIXGXLTXGXXPXXYTXXGAQPVPLVSEP

SEQ ID NO: 205693 - protein, 68 aa, Triticum aestivum
  unsure (1)..(68): unsure at all Xaa locations
  Clone ID: PAT_TA_100111.pep
LGKNXLVTPNPEXARLVPDSRXQEFPLLXTQIXSTPNEXXSXXFFLSSCGGGGETVGVGGILVQRVCA

SEQ ID NO: 205694 - protein, 121 aa, Triticum aestivum
  unsure (1)..(121): unsure at all Xaa locations
  Clone ID: PAT_TA_100112.pep
GXRXXIXFKXLXSGKXXXGIYPXQIQXTPIXTLFFKKXKXNXYXLGFXVTXAKMASXXNXHXILFGQLXFFXMXRXXCXSCXFISLKCXYMHNKNEDISKYRSLFDQPKNVASFQFLLEST

SEQ ID NO: 205695 - protein, 169 aa, Triticum aestivum
  unsure (1)..(169): unsure at all Xaa locations
  Clone ID: PAT_TA_100113.pep
FSLPPPHYLPPRDPPQIQKFPSSSQPDXTPXSLXLLLCFLLEPVAATEQEPSRPSLTDPAGCALRRPRRRRSRRGPALSRSSPPYLFSSPCFSLTRFPLTRNDAMGLPFPPDSLTSSLLFKELQRMXPQEPSQWXPXGIAGPXANNXXQXTGWAKXXXGXMXQKPXPXA

SEQ ID NO: 205696 - protein, 140 aa, Triticum aestivum
  unsure (1)..(140): unsure at all Xaa locations
  Clone ID: PAT_TA_100114.pep
MAKEVSEEPEHAAPAHKDYSDPPPAPLFDMGELRMWSFYRAIIAEFVATLLFLYITVATVIGYKVQSAADPCGGVGVLGIAWAFXGMXFXLVYCNAGISGGQIKPGVNFGAPPGACPLLPGDLNPAIAPGNSWAPIVQIN

SEQ ID NO: 205697 - protein, 125 aa, Triticum aestivum
  unsure (1)..(125): unsure at all Xaa locations
  Clone ID: PAT_TA_100115.pep
AHPISSPIDSRARRILLPHRLKMXIFVKXLTGKTITLEVESSDTIDNVKAKIQDKEGIPPDQQRLIFAGKQLEDGRTLADYNIQXKESNLHLVLRLRGGMQIFVKTLNGKEHHSGGLRADNIEQF

SEQ ID NO: 205698 - protein, 185 aa, Triticum aestivum
  unsure (1)..(185): unsure at all Xaa locations
  Clone ID: PAT_TA_100116.pep
MGKEKTHINIVXXGHVDSGKSTTTGHLIYKLGGIDKRVIERFEKEAAEMNKRSFKYAWVLDKLKAERERXITIXIALWKFXTTKYYCTVIDAPGXRDFNKNMITGTSQADCGVLXXQPXNGGFXXXGSPKXGQXXXANXPLVXXPGVKQNYXAAAKXLXXTXPQFSKGVKKGVLTLKGKLKFLFP

SEQ ID NO: 205699 - protein, 209 aa, Triticum aestivum
  unsure (1)..(209): unsure at all Xaa locations
  Clone ID: PAT_TA_100117.pep
GSFKYAWVLDKLKAERERGITIDIALWKFETTKYYCTVIDAPGHRDFIKNMITGTSQADCAVLIIDSTTGGFEAGISKDGQXTREHALLAFTLGVKQMICCCNKMDANTPKVLKRAVTXKLSKEXXXYLKERPVKTLXRVPLFPXSXFXGEXNIEKXNKPDWXKGLXLLXGPDQXNXPXXPXKKPLGFPXKELKNCXXGTXPXALFXXG

SEQ ID NO: 205700 - protein, 113 aa, Triticum aestivum
  unsure (1)..(113): unsure at all Xaa locations
  Clone ID: PAT_TA_100118.pep
MAANERHWQPPSSWSALPLELAGLVLRLLPAYADRARFXAVCPQWRAAARQKLMPPPLPLLALPDXTFYSLPYDEALPIPRRLRWVQRPGGNWLCLSARTMGCFLCQTVLQYP

SEQ ID NO: 205701 - protein, 74 aa, Triticum aestivum
  unsure (1)..(74): unsure at all Xaa locations
  Clone ID: PAT_TA_100119.pep
NGVDVVEAAXXVGXDGGLVXEKVXPXSXGEMKXNPLVTLXXFTVPXPPLPHLAPPKTKDQNPSRKPXCXIRXEA

SEQ ID NO: 205702 - protein, 114 aa, Triticum aestivum
  unsure (1)..(114): unsure at all Xaa locations
  Clone ID: PAT_TA_100120.pep
MAPXAXKXPVAEKAEKTTAANKTKAXKRPPASKEGGEKKGKXKSKKSVETXKIYIXXVLKXVHPXDIXISSKGMSINESPLSMDIXXKAPPGEVRPRLAPPTNNEAQPITNRFQ

SEQ ID NO: 205703 - protein, 150 aa, Triticum aestivum
  unsure (1)..(150): unsure at all Xaa locations
  Clone ID: PAT_TA_100121.pep
MANPRVFFDMTVGGAPAGRIVMELYKDAVPRTVENFRALCTGEKGVGKSGKPLHYKGSSFXRVIPDFMCQGXDFNKGNGTGXESXKGEEISXPKISSKNXXKPGILSIXQSGAPKXKGXNFSXXTGPLXFGPTGNTLSFREVXXGNGLLQ

SEQ ID NO: 205704 - protein, 105 aa, Triticum aestivum
  unsure (1)..(105): unsure at all Xaa locations
  Clone ID: PAT_TA_100122.pep
EREREREREREREREREREREREREREREXPXXETPPHPTIPXVSPAKYQRHPWPPRRRXXRWRXXPRRRRQPRXTRAEXRXPXSNEGEKGNKSNERDLTRFSRC

SEQ ID NO: 205705 - protein, 132 aa, Triticum aestivum
  unsure (1)..(132): unsure at all Xaa locations
  Clone ID: PAT_TA_100123.pep
LLSXFHALFYSTRXLPNILALXLVNLAYSFWFKGNYLCTLQALIIAXVVFKCDMIPLLGTKRVALLXTKSFSLKEPVKCFXNTALLXIGXKGTKFXXNNVGXXKSWWXXNFEIFLGLNXFLXPKXXXGXVXP

SEQ ID NO: 205706 - protein, 55 aa, Triticum aestivum
  unsure (1)..(55): unsure at all Xaa locations
  Clone ID: PAT_TA_100124.pep
FFFFFYCDVHLEFSGLLTNVQTKSAKPTKLYGPSSNRXVLISRRIEKQTGGKTRD

SEQ ID NO: 205707 - protein, 119 aa, Triticum aestivum
  unsure (1)..(119): unsure at all Xaa locations
  Clone ID: PAT_TA_100125.pep
MRECISIHIGQAGIQVGNACWELYCLEHGIQPDGQMPGDKTVGGGDDAFNTFFNETGAGKHVPRAVFVDLEAHXVFDEXRDWALYRQLFQPRATLIKWQREGCKPNSPRWSFTIGGGIG

SEQ ID NO: 205708 - protein, 117 aa, Triticum aestivum
  unsure (1)..(117): unsure at all Xaa locations
  Clone ID: PAT_TA_100126.pep
MDVSGTGAGAKGKKGAAGRKAGGPRKKSVTRSVKAGLQFPVGRIGRYLKKGRYAQRVGNGAPVXLAAVLEYLXAXLLELPGNAAKDNKKNRIIPRQLLLXVKKXXELXXLLGXVNNA

SEQ ID NO: 205709 - protein, 203 aa, Triticum aestivum
  unsure (1)..(203): unsure at all Xaa locations
  Clone ID: PAT_TA_100127.pep
ESLASPTSSPVSSRSRRRHRTPIQPXRRXSPRPPVPSPPTFYSSPKGREGKARQGKGEGAPRSTAASARRPPPDPRPSTXGNLIGARKSPSPRSSPXNLRKRXXRPXTPLAPAXAEQFGSPRXVERRPXCLXERRAXLXPQLXPQKASFXSNDXTXXKVKGIFQIGKIWEKXXSNLXPXGTXNQXXAXFXAPXWXXKXKKXEX

SEQ ID NO: 205710 - protein, 136 aa, Triticum aestivum
  unsure (1)..(136): unsure at all Xaa locations
  Clone ID: PAT_TA_100128.pep
XFFXPXXPFFSRGPPRGEGFLPGXLLPXXLLXLLKKGSXNGPGGPPPXGXGEGERPNXXXLALFXPATGARGDXNXSAPFGGPPGFPNRGFGQGXXQALIWARXXLFPPXGXVDFPXHLVTXLLCPXXPCGGVXGV

SEQ ID NO: 205711 - protein, 130 aa, Triticum aestivum
  unsure (1)..(130): unsure at all Xaa locations
  Clone ID: PAT_TA_100129.pep
LPSLATTHSQGGCLXAAATAGAAPAASAATAAAGARCSPTWRXPPARPPWSCPPPPTRGAPAGSRWPAGRPAAATAPPASAAPRAAAPAAAATEPXHRXPAXKRSTMRSKQSSSTTTTQYVPLRPNARLK

SEQ ID NO: 205712 - protein, 96 aa, Triticum aestivum
  unsure (1)..(96): unsure at all Xaa locations
  Clone ID: PAT_TA_100130.pep
MAETEYRCFVGGLAWATDDHNLQQAFSQYXEILDAKIINXRETXQVPXXFGFXTFGXEESXRQXIQXINXXEFDGSQXITVNEAQSRRXXCLXXGX

SEQ ID NO: 205713 - protein, 101 aa, Triticum aestivum
  unsure (1)..(101): unsure at all Xaa locations
  Clone ID: PAT_TA_100131.pep
QSHFHLISSHPRQRTDGPISSPISSSXSASSSYFFFFPCPSTIAAYFFLYLFLVINLHILSIIFFFFFFFLTLIDNVAWDLQLHXKQQGPRSTGSSLLGPL

SEQ ID NO: 205714 - protein, 212 aa, Triticum aestivum
  unsure (1)..(212): unsure at all Xaa locations
  Clone ID: PAT_TA_100132.pep
DEVKLMDAKGAERYKFHNMNTGAEEFHKLLIACGASLTYATKEWVNNHYKWIIWKLASLERCYPTKAAGKFLTVANVLDELKYRYDREVNNGHRSAIKKILEGNALPSLMMVLCISXAIYSHPDVHKVRXCRDKMKMKTXSTNKXXLAAKRNMPAXIEXTDGWYAPTKPPLDXGXXQXQLXXKRKXFIGTKRLXXMGDLLCVGWXGPVSIXR

SEQ ID NO: 205715 - protein, 149 aa, Triticum aestivum
  unsure (1)..(149): unsure at all Xaa locations
  Clone ID: PAT_TA_100133.pep
MAGRKGGDRKKAVTRSVKAGLQFPVGRIGRYLKKGRYAQRVGSGAPVYLAAVLEYLAAEVLELAGNAAKDNKKTRIIPRXLLLAVRNEQXLXXVLXGVTIXQGXVXPXIXSVCSPKNXPXQKGGKSPKKKGANKSPKKKPQQGKPKNPS

SEQ ID NO: 205716 - protein, 56 aa, Triticum aestivum
  unsure (1)..(56): unsure at all Xaa locations
  Clone ID: PAT_TA_100134.pep
PFDETXVNAXXFLXRGGXERVXGRTGAKQPEGERRTPHHTLANQADREPPGRHESP

SEQ ID NO: 205717 - protein, 87 aa, Triticum aestivum
  unsure (1)..(87): unsure at all Xaa locations
  Clone ID: PAT_TA_100135.pep
LXXXGTXPPLLSSGKFFAIEGXIGSSYLSSPXFRNQMDELSLPCCXPNXDDEEVWNAKDPSYVTHRRAATFRDAIIERGEDARPHRR

SEQ ID NO: 205718 - protein, 100 aa, Triticum aestivum
  unsure (1)..(100): unsure at all Xaa locations
  Clone ID: PAT_TA_100136.pep
LGWQDGEEGVRNVTVDRAVLTGXTTXGLRIKTWAMPNSGSVTNVSFSRITMNRVANPILVDQXNYCPRKVDCPGNSSGVARXSNISYXDIEGTSGEPRCK

SEQ ID NO: 205719 - protein, 146 aa, Triticum aestivum
  unsure (1)..(146): unsure at all Xaa locations
  Clone ID: PAT_TA_100137.pep
MARTKXTARKSXGXRAPRKQLATKAARKSAPATGGVKKPHRFRPGTVALREIRKYQKSTELLIRKLPFQRLVREIAQDFKTDLRXFQSSAVSALQEGRRRANLVXPLSRKPXLCAHPXXSAVTIMPXGNSPANPVARGAFSNGPSG

SEQ ID NO: 205720 - protein, 62 aa, Triticum aestivum
  unsure (1)..(62): unsure at all Xaa locations
  Clone ID: PAT_TA_100138.pep
RTSLEFFFFFFHLLPLLLHEHWMPXVXXIQSXQRAQHLTGKXNLHRSHACACAHLSTNQSHK

SEQ ID NO: 205721 - protein, 134 aa, Triticum aestivum
  unsure (1)..(134): unsure at all Xaa locations
  Clone ID: PAT_TA_100139.pep
MARTXQTARKSTGGKAPRKQLATKAARKSAPTTGGVKKPHRYRPGTVALREIRKYQKSTELLIRKLPFQRLVREIAQDFKTDLRFQSHAVLALQEAAXXYPVRLFQGNKLCANPXXKRVNIXPKDIQLPESVRG

SEQ ID NO: 205722 - protein, 179 aa, Triticum aestivum
  unsure (1)..(179): unsure at all Xaa locations
  Clone ID: PAT_TA_100140.pep
MFGFGHHGHHGQXPPAHAPAAAGGNQPNFKIFCKADEGYCLSVRDGNVVLAPSNPRDEHQHWFKDMRFSXQIKDEEGNPXAFAIVNKGTGLRPSKHSXLGQXHPVXLVPFNPEYLHEVPXCWTGEQSTXGKGXPCIPGTNRPFTPFNRGKDQRGGCNNQFLWGVGGEKGKIPLGGGPPG

SEQ ID NO: 205723 - protein, 106 aa, Triticum aestivum
  unsure (1)..(106): unsure at all Xaa locations
  Clone ID: PAT_TA_100141.pep
VVAKTITSQKMAATPVLAVLQVAAXPQSLVAAPRNAGSSKRHVPSLLWNGWFQLPRGAGCSSLCSWFQQKSGVYVTSPFTGWGRGRGSKLMAARIXEGCAWWWWTA

SEQ ID NO: 205724 - protein, 104 aa, Triticum aestivum
  unsure (1)..(104): unsure at all Xaa locations
  Clone ID: PAT_TA_100142.pep
ASGAVAHFSPVGXXAPRGAAVVLAMVLAAMVVAPPATVHAAISCSTVYSTLMPCLQYXXQGGSPARGCCTGIQNLLXGGQQXXPDRXALXAXCLKNVXNRLRGP

SEQ ID NO: 205725 - protein, 132 aa, Triticum aestivum
  unsure (1)..(132): unsure at all Xaa locations
  Clone ID: PAT_TA_100143.pep
RKLLNLTRLXIXTAKYYYIKVAAPDCSVRAASSLGIXGTSISRRPSRNWTLHPXLGXSNSLSLXATXHXXFGKTLFKPXSKXXNXTXXNWGIQPKLLLXSXXGESLXXWVXPRGKLFQXMAGAKXAXRXIGX

SEQ ID NO: 205726 - protein, 89 aa, Triticum aestivum
  unsure (1)..(89): unsure at all Xaa locations
  Clone ID: PAT_TA_100144.pep
NIXPPXXNYCXRNGCIXTYFTSTYIHLCPFPQQVFPXXRXKILXXFATQXLXSPRHXWXSXLIHLNIASKLPCPVIKIIIXPHTSQAXS

SEQ ID NO: 205727 - protein, 135 aa, Triticum aestivum
  unsure (1)..(135): unsure at all Xaa locations
  Clone ID: PAT_TA_100145.pep
MSGRGKGGKGLGKGGAXRHRKVLRDNIQGITKPAIRRLARRGGVKRISGLIYEETRGVLKIFLENVIRDAVTYTEHARRKTVTAMDVVYALKRXGRTLYGFGGARPQLRCKISDVPIPLRRSPLSKLFFPTPLFP

SEQ ID NO: 205728 - protein, 157 aa, Triticum aestivum
  unsure (1)..(157): unsure at all Xaa locations
  Clone ID: PAT_TA_100146.pep
RCRWCSWASSRATVLVAGPSARACGSRAPISSPGGLDYLGNPNLVHAQSILAIWAVQVVLMGFIXGYRVGGXPSARGLXIIYPGGAFDPLGLAXDDPDTAAELKVKELKNXRLAMFXMFGFFVQGIVNRGKGPVETHRNPVQKTPGLSPTNFPRSNV

SEQ ID NO: 205729 - protein, 188 aa, Triticum aestivum
  unsure (1)..(188): unsure at all Xaa locations
  Clone ID: PAT_TA_100147.pep
RHXQXXXRXXPTPRVRVRQVRENPICRRGSRKTSATQQIRAGACRIRPRTPRPRQDDGTHRDEPGERNRPDPPPAPRRGARRRPTQQPGGHRATTGRPRGRCTSRSAAGARRRARRRXRTHHRGHAQDQPPRAGARARRRXSHHRGFARRRVPAAAEEGRRGGGGGSRGLVSARAAPAERRGGLFPSC

SEQ ID NO: 205730 - protein, 206 aa, Triticum aestivum
  unsure (1)..(206): unsure at all Xaa locations
  Clone ID: PAT_TA_100148.pep
ARGRLRRRRTNRGSSDSSDQERRAGRKSTYAGGDEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGXXLYXXXD

SEQ ID NO: 205731 - protein, 110 aa, Triticum aestivum
  unsure (1)..(110): unsure at all Xaa locations
  Clone ID: PAT_TA_100149.pep
MRIRELGDGDGRPVEGEEXXDAWAGGGGGEVVRLRAKRALVGAGARVLFYPTLLYNVLRNQFXXEFRWWDRVDXCILXXAVPFPXDVPRLKXLGVXXXXXLXXXXXXXXX

SEQ ID NO: 205732 - protein, 157 aa, Triticum aestivum
  unsure (1)..(157): unsure at all Xaa locations
  Clone ID: PAT_TA_100150.pep
CXXRSRVCSVSNRXXNLAEEPAAAWPSQVSFLXRGGREVEGAESGSECLACWQVQVPTSSLLSPPLFPRRARVTEPNLIGRGVREGGRVDISSQDDAFKARTRKKGKGPGRPPGRADTLSSSLARGGGPCRVASRWGARTYAVRCSPYSPGTPAPRA

SEQ ID NO: 205733 - protein, 210 aa, Triticum aestivum
  unsure (1)..(210): unsure at all Xaa locations
  Clone ID: PAT_TA_100151.pep
ARGRAPPLEGLSRHHKQVHAHLLRRGHPFPPAEHAEPDRAYLSVLRAATATPVLALAACACLRRAGLPAPGRHALPALLRAAARARCADSVGQAHAIAVRVGAEDDGFIGTALVGAYAACRRVADARKMFEVMPDRDLVAWGVMLDSYCQTQDYREALLLLNKLKRSRIVPDQVILATVLSACGHTRHLRSGKVIHSYILVSXIXIDARL

SEQ ID NO: 205734 - protein, 98 aa, Triticum aestivum
  unsure (1)..(98): unsure at all Xaa locations
  Clone ID: PAT_TA_100152.pep
MAKLPIVGRSVHSSRKPNESMRLVVVTIIGVVFGFFIGISFPTVSITKLHFPSSIVXYIXXKNSGLTAXXILNHAWISARNAXXNTSESSXXTTMKXY

SEQ ID NO: 205735 - protein, 155 aa, Triticum aestivum
  Clone ID: PAT_TA_100153.pep
ARGIDKSSTNERFQEPSTSDSNKSFPSIAASQSSDVKQPASSSSDARTAEPSFVRKGVIGNEVPNSNPKSGQVAKMPSKPHQSSLPSDQQFKHSVNNNQDRLARVTQRAGTVNEWQRRSGYPGRSSGSNKKYGTGRVKQIYVAKSSSKSSQAPSS

SEQ ID NO: 205736 - protein, 155 aa, Triticum aestivum
  unsure (1)..(155): unsure at all Xaa locations
  Clone ID: PAT_TA_100154.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQXFSXXXXDYLGHPSLXXA

SEQ ID NO: 205737 - protein, 103 aa, Triticum aestivum
  Clone ID: PAT_TA_100155.pep
FSARASRRHRGWNFEEQAMHGEIFICRQEIADTSAVQLTILISETYFCYCEKTEVRTWKNMDVDKVIHRQEITNKLSLFKNLHFTSKTYVVVRKYKGSRASAT

SEQ ID NO: 205738 - protein, 67 aa, Triticum aestivum
  unsure (1)..(67): unsure at all Xaa locations
  Clone ID: PAT_TA_100156.pep
XFCIPVFXARFLCKTGQKNYIFGGVGPIFPPKATFLFSGCSPKNGRCWFPPPPGRERFFSWEMGLTF

SEQ ID NO: 205739 - protein, 119 aa, Triticum aestivum
  unsure (1)..(119): unsure at all Xaa locations
  Clone ID: PAT_TA_100157.pep
AXXXXXXXXXXXXXRHHRQQRRAMWVPPAARSQRRRRPRPARGRRGARRRTPAHPWRSASSALAALSAAAAASAAEDGDASAAVDLRWWRADVAAIPASKLLGRGGEGSNYMVLGGASC

SEQ ID NO: 205740 - protein, 65 aa, Triticum aestivum
  unsure (1)..(65): unsure at all Xaa locations
  Clone ID: PAT_TA_100158.pep
FFFLDKCWGCLLIIILRETRLQMLATXATQVVWYKKVVTSGNKQLNTSCTILYYWVSLSHVKKKT

SEQ ID NO: 205741 - protein, 59 aa, Triticum aestivum
  Clone ID: PAT_TA_100159.pep
SSCRYSHSLAGWFSIGSTNAHFLISQCFNLLDMRLPKESFFFTIITYLSGRVCQFFSEL

SEQ ID NO: 205742 - protein, 68 aa, Triticum aestivum
  unsure (1)..(68): unsure at all Xaa locations
  Clone ID: PAT_TA_100160.pep
MTSTVQSLLLSSMEQNNKPQDEDRLGALTDDILLSILXSVDLATAAXTXALSTRXXSLPWLLPXXNPM

SEQ ID NO: 205743 - protein, 206 aa, Triticum aestivum
  unsure (1)..(206): unsure at all Xaa locations
  Clone ID: PAT_TA_100161.pep
ARGSPCPSVHSPRPPPPTPPPHNLLPHAAPPPPPHGRCRRLLLLPAGAALPPTPPVWCRPASPPRASDPQRRPATAPARPAPAMATAPPCARRRQRPLPCRAMPPDPVHSLGPALGGPAPMASAPPRDAVRRPRPQPSPTALPRTSANPAPMHPSKIPPSPSYSTSLPYLXXRATLPIVGVNFRGRGHHTHRQPARFQCSSVRCAP

SEQ ID NO: 205744 - protein, 186 aa, Triticum aestivum
  unsure (1)..(186): unsure at all Xaa locations
  Clone ID: PAT_TA_100162.pep
MLPTTATASTPPPPPAEPPGEPHAALFLALGYMRLPELLACWRVCRLLGEAVAGDPLLWRRLAVEPPLSGRVTDQVLLKLTARAEGTLRSLRLFGCLHVSDAGLLRVVEHNPRVTEIYVPGCKGLTGDGVVNIVQLLHEHKGNISRLRLDGISRMSKHHLDIIMSLMCKXNPQGQQDGIPLFYNHR

SEQ ID NO: 205745 - protein, 95 aa, Triticum aestivum
  Clone ID: PAT_TA_100163.pep
ARGFRLHHKRSSDCVECITKAQEEKGRISQNLTRCKGTYQVWAYVKLSLETAIMLCCKVLYLFMITVLTDIVQDAQIDCQLAWHLVLSGLLLLLK

SEQ ID NO: 205746 - protein, 151 aa, Triticum aestivum; identical to SEQ ID NO: 151947
  Clone ID: PAT_TA_100164.pep

SEQ ID NO: 205747 - protein, 207 aa, Triticum aestivum
  unsure (1)..(207): unsure at all Xaa locations
  Clone ID: PAT_TA_100165.pep
ARGAHSPRRAPLPFSTAAADPCPPPCPPPSSPSPPGAQPGLLPRSSWRASSSAYSRSRRPRRPHRLYRRQEGAPAAAALRADPCFRTACLGAAIDCYIDASTHPPNPLLRGRRLDPWNPSRLIDWLIGSLPASHPPCPPPPPSCHTTTTILPVRRRHAIAATYPTTLWRRRPERDGVAGLCACLRGFPSWPPEPWVNHVGXXSPPRX

SEQ ID NO: 205748 - protein, 182 aa, Triticum aestivum
  Clone ID: PAT_TA_100166.pep
MNPDRKTTLELSVRAYAETKSGPVINPTIGTSFDSLDEAYEFYNLYSWEYGFGARLAKSRLNVNRKRCMQEILYACAGKPMRENSRSSRCGCEAMIRFLRSNDNGWYISEFKSGHNHPRSSRCGCKAMIRLLRSNDNGWYISEFKSGHNHPRSSRCGCEAMIRLLRSNDNGWYSARRRPRIN

SEQ ID NO: 205749 - protein, 196 aa, Triticum aestivum
  unsure (1)..(196): unsure at all Xaa locations
  Clone ID: PAT_TA_100167.pep
MEAHMRSMTATFLLVLLSLSAAAPSVRGQAVAAAPAPAAAAPKTIKAVLTKAGQFTKFLQLLQSTQEEEQIDTQLKGKASSGAGLTVFAPPDNAFTALKSGSLNSLSDQQKTSLVQFHVVSQLLPMAQFDTVSNPLRTXXGDTGRGKYPLNVTSDGGGRVNISTGVVNASVDGTLYTGDRXXVYXXDXXLLPWALX

SEQ ID NO: 205750 - protein, 153 aa, Triticum aestivum
  unsure (1)..(153): unsure at all Xaa locations
  Clone ID: PAT_TA_100168.pep
RLCASNALSQQIERINHYYGSRLVYSNSWYLSLSVTTNFIQRSQIHLCWTRKWREPWALSIYRHEILQAFPQLVAGPVRSQLPLSRRPLAGVRAARGRRGQSLVLRRRASXTITAIAAPVHTHXLVGAREVEPGARAAEXXRXXVVXPRXXXX

SEQ ID NO: 205751 - protein, 172 aa, Triticum aestivum
  unsure (1)..(172): unsure at all Xaa locations
  Clone ID: PAT_TA_100169.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRRIVRPPKKGSAVQRPRTRTLTAVHDGILEDVVYPAEIVGKRVXXRLDGAKVIKIYLDPXXRNNTEYKLETFSA

SEQ ID NO: 205752 - protein, 176 aa, Triticum aestivum
  Clone ID: PAT_TA_100170.pep
HEARFLFRSALRRQRPFPSLASRSWPFPSSTTSSPAGRRRPRSRSPPVPSPRRQPRPSRSPAHLPGVGRSSPLSSVGSSNHPRLRRPATSTARDDREKLQLQQYGPGDLVTVLLFGDAAEHLQLLGWPGPFSCNLQSSVCILWVVDSEHFVQLVCIPYFITNSFDHTTCLLIFTGI

SEQ ID NO: 205753 - protein, 154 aa, Triticum aestivum
  Clone ID: PAT_TA_100171.pep
ARGASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 205754 - protein, 134 aa, Triticum aestivum
  unsure (1)..(134): unsure at all Xaa locations
  Clone ID: PAT_TA_100172.pep
PPPAARRPSPTAVARRPMPMRCEPVTTAASRRAAXPDRRRSAPRAPAPTSGDRRPAPPSPXPPSVAPLPVTRPSAVSDDRRVEARGATLTDVDRRAEPRPRPLETGAPRRHPRPPVSRSTARDTAVRRRCSAPR

SEQ ID NO: 205755 - protein, 182 aa, Triticum aestivum
  unsure (1)..(182): unsure at all Xaa locations
  Clone ID: PAT_TA_100173.pep
IEPKIPSPSLTLPGSRSAKAPARSARDGSSVAAEAGAAAPAPXPSSAATLRSAPPLRRPPSPSPSSPAAARSSSPPMTTSRSSRPRPPLLPASRRRSPLAPRIRPRFXKARNRRSPPRRRPRSPPRRRPLKRSRPRPRSRPLKRAAMRPRPRSRPLKRPAMXXSPKSRSWXXXXXXPSPRAP

SEQ ID NO: 205756 - protein, 182 aa, Triticum aestivum
  unsure (1)..(182): unsure at all Xaa locations
  Clone ID: PAT_TA_100174.pep
MSQEPDAEEEWAAVEGRGAHLVTGAAERPFIIHGFNTYWLMSFAADEATRPRVTAAIAEAAGAGLNVCRTWAFADGGYHALQTAPFCYDEEVFQALDFVVSEARRYKMRLILSLCNNWEDYGGKAQYVRWGKEAGXXLTSDDDFFSDPTLKGYYKAFVXXVLSRINTITNXXYKDDPTILAX

SEQ ID NO: 205757 - protein, 181 aa, Triticum aestivum
  Clone ID: PAT_TA_100175.pep
MASTLCSPRHHHRSYICRRRLRPSPPSHARPRSGAGGPPGLNTTKYLCSHPMSTGRGSPVSCSSMEASKSKPGPEHLIVLVHGIMASPSDWTYGEAVLKKRLGDNFFIYASSSNIYAKSFDGINVAGRRLAKEVLDVVQKMAGLKKISFIAHSLGGLFARYAISILYSQQAKGSGASVMLT

SEQ ID NO: 205758 - protein, 100 aa, Triticum aestivum
  Clone ID: PAT_TA_100176.pep
GACLEVGGGGRQIPRVGCACAGAGGGQPPLQFLVLGFGAECLLDGAQPLGLLPHQSINQSSKIKMIALLPLHRWASKRRGEEGMGRSGEATTRATGSVSI

SEQ ID NO: 205759 - protein, 176 aa, Triticum aestivum
  unsure (1)..(176): unsure at all Xaa locations
  Clone ID: PAT_TA_100177.pep
MTPPFRPSPSSTAPAPRGCGGERCASGREAWPLHHVRHNDVFCRLCSSCVLLYHPASFCSACLLLLHTDAAAAAAAAQDPHFDPAVAPPGPTAECSNCGLFVAHVTCIPDPVSFVCPPCAAEAEGRPFTYAPAARRVMDERAARILLIAARLAHESIGRAAAAARXXAERRVQXXA

SEQ ID NO: 205760 - protein, 103 aa, Triticum aestivum; identical to SEQ ID NO: 107316
  Clone ID: PAT_TA_100178.pep

SEQ ID NO: 205761 - protein, 201 aa, Triticum aestivum
  unsure (1)..(201): unsure at all Xaa locations
  Clone ID: PAT_TA_100179.pep
CARGXXXXXXXXXPPRPCRNAAAPRRRRRTSSRSSPRRPRPRRCRCRAPPPPPRTXWPPQARPRRCRRPWSRRWLPPRTTSSSAHLTGCATMAAPSTASQEGGDKKRRAWQKGRWHGHRELARWGAPKGENAPVEEGRRSGLGQGERGAAQGSKRRAHGSEREGARDGTVGSRQLGVQWQQRAREDKEVLIPLRARVVASC

SEQ ID NO: 205762 - protein, 200 aa, Triticum aestivum
  Clone ID: PAT_TA_100180.pep
ARGLVADLSPNGDLGHYNLHVFSSETSEWSTKHVQLKVPANVLPRDLPSQTDKVIRLGVSTVGWVDLWRGIVVCDVLQKDPALRFLPLPKADFDLRREGRARQVRDVVGLPDGFINFVEIENCIRWFTVVSKSTLKTAGVFDVADTISDVKLLSHSDDGMDDVTDDNPVRHAPAGWKIRTMLRSIHWDLWHKSRTVHLTT

SEQ ID NO: 205763 - protein, 203 aa, Triticum aestivum
  unsure (1)..(203): unsure at all Xaa locations
  Clone ID: PAT_TA_100181.pep
TRIDAPGXRDCXKNMITGTSQADCAVLIIDSTTGGFEAGISKDGQTREHALLAFTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTXXKSVEMHHESLLXX

SEQ ID NO: 205764 - protein, 186 aa, Triticum aestivum
  unsure (1)..(186): unsure at all Xaa locations
  Clone ID: PAT_TA_100182.pep
MATPPAPSPSPVKLRLVFDKARLLRRAQRDLRRCWLLLRPELATVADLAAHVAARFRLHRSCPGGVVLTMDGFAVPPFESTCIFKDXXIIXVQQKACKRMVHHDDVHCIEDPEKVEMRPLPTEDKILAIEYQIDSSKHQEEEVHCDHQPEEKVTSDHDLENGHTSSKRKRKDEDAKIPESSRRKLK

SEQ ID NO: 205765 - protein, 78 aa, Triticum aestivum; identical to SEQ ID NO: 106969
  Clone ID: PAT_TA_100183.pep

SEQ ID NO: 205766 - protein, 120 aa, Triticum aestivum
  unsure (1)..(120): unsure at all Xaa locations
  Clone ID: PAT_TA_100184.pep
XXXAAAAHNAQGNRSQTTNXXXTFGXAXXDVKSDRXXWGASTEPIPLRPSETRMPPNQCRDRAPLHRATTHVVPEIAISTHNQKPSGAAAPTSIAPDDEEIRANCNMLTLQDDASKKETT

SEQ ID NO: 205767 - protein, 153 aa, Triticum aestivum
  unsure (1)..(153): unsure at all Xaa locations
  Clone ID: PAT_TA_100185.pep
MAPKADKKPAAENKVEKAAEKTPAGKKPKAEKRLPAGKTASKEAGGEAKTRGRKKGSKAKKGVETYKIYIFKVLKQVHPDIGISSKAMSIMNSFINDIFEKLAGESAKLARYNKKPTITSREIQXSVRLVLPGELAKHAVSXXTXXVTKFTSS

SEQ ID NO: 205768 - protein, 121 aa, Triticum aestivum
  Clone ID: PAT_TA_100186.pep
TRPRAEFGTRDFSSRRSSRAKSVSSHAGAAPSPTPRACQQPPPLTLPCAASSVLRSFERGGRALVRMRCPLRIVKAQRVASPLCPASPLHPPGQAHGELCCPHLLHFWPKCSFGPWHVFFL

SEQ ID NO: 205769 - protein, 170 aa, Triticum aestivum
  unsure (1)..(170): unsure at all Xaa locations
  Clone ID: PAT_TA_100187.pep
MQILVDTVAGETISLKVDPSDTIYLVKEKIQDKQLLTFNGEQLDALADYGVRDGSALGLRLHPLHEKMQIHVVESLTGRVMNLAVTTSDTVDNVKAKIHKWHGFPKDQQCLIFANRQLDDDEEEGRTLADLNIRNDATLLLVLHSRCPXXMMKIYVKTLRQNFYNLXXRS

SEQ ID NO: 205770 - protein, 130 aa, Triticum aestivum
  Clone ID: PAT_TA_100188.pep
HEDPPHRPRPAVPLHRRHLTYTAPSPPPQPRHLLHSLPDLDAPRAAPDHAVAPDGGLPAASARPRRPSSLPLALLQHRRPPQRRRMPGAAIDPSPSTSTTTPCRWIGHRRQAPAPSTASPTSATPRPTLM

SEQ ID NO: 205771 - protein, 194 aa, Triticum aestivum
  unsure (1)..(194): unsure at all Xaa locations
  Clone ID: PAT_TA_100189.pep
PPSLPARAGAPPSHASVFPCGVLLLGPLLAQRGIGMGHARVRRRSTRIRRSVADLPGSAGPSQEPNSQPPPPESTVCPNAPARFLLRGESSKGWAARSPAVHGEHPCSGKNKLKSIVFVPFPAPPLSSSGNEDDWTEVKSRKGRRALQKPAGKPXRRPXGRSGRRPAINGDAGHAAFLSXXXXLCFHCLSSSHR

SEQ ID NO: 205772 - protein, 95 aa, Triticum aestivum
  Clone ID: PAT_TA_100190.pep
RNSERVYQLLREQCHDDCCAISPLFSFILFTSVFYFCFISCNHKFTATHPSQILAISLSSPFLSSSYTVLDSLDIQLRGCRNEQKHVVACLNCCK

SEQ ID NO: 205773 - protein, 91 aa, Triticum aestivum
  Clone ID: PAT_TA_100191.pep
IFFSGSGFRVLLNEFLCMLLTYLACELVYMFTFGYFNMIENNRGLFLFLFCNLMLIAIGWFLGTTSQIGDEVAADMDPKQKCATQINCKSA

SEQ ID NO: 205774 - protein, 72 aa, Triticum aestivum
  Clone ID: PAT_TA_100192.pep
ARGRLGASGSGGGRRLLVVAGPGSYPPRCTSKCGSCNPCYPVHVAVPPGVPVTTEYYPEAWRCRCGNRLYMP

SEQ ID NO: 205775 - protein, 153 aa, Triticum aestivum
  unsure (1)..(153): unsure at all Xaa locations
  Clone ID: PAT_TA_100193.pep
SASTATSRTPRPAPPPPSRRRSRAGRSRRSKSTAPWSPRCCTSSPGTPRRRRTSSRRPRAKRCARRARSTAASAAPKATVTAGGPQRRRRNKKNKYRGVXQRPWGKWAAEIRDPRRAVRVWLGTFDTAXDAARAYDRAXVEFRGPRAKLNFPF

SEQ ID NO: 205776 - protein, 183 aa, Triticum aestivum
  unsure (1)..(183): unsure at all Xaa locations
  Clone ID: PAT_TA_100194.pep
TREKRSSSPPMHGHGEPHCCQAPRPIPTPXSPPPSLLRPPAPHVGRPPDPGXQCTPAPPAMPFARSRPRCTPAPPCDALHRIQAAAHPRAPWRRPAPDPGRGAPLPPPPPPGSARVDAAYRQRDGYHGMGGTLPHNSAQFASSASAIHFFLEKQKKLFKGGHAAICNSLEGKRRCSHQGESMP

SEQ ID NO: 205777 - protein, 153 aa, Triticum aestivum
  Clone ID: PAT_TA_100195.pep
HEASSVLTASSQSLASFPRRHPPRKGGCLAAAATAGAAPAASAATAAAGARCSPTWRPPPAPPPWSCPPPPTRGAPAGSRRPGRPAAATAPPASAAPRAAAPAAAATEPAPRRPAGRGEHEDEEDKQASTITTSSPPPSVSSPAAACARGRAR

SEQ ID NO: 205778 - protein, 97 aa, Triticum aestivum
  Clone ID: PAT_TA_100196.pep
MLEGKATVEDTDMPAKMQLQATSAASRALDRFDVLDCRSIAAHIKKEFDTIHGPGWQCVVGCSFGCYFTHSKGSFIYFKLESLRFLVFKGMAEEQPC

SEQ ID NO: 205779 - protein, 152 aa, Triticum aestivum
  unsure (1)..(152): unsure at all Xaa locations
  Clone ID: PAT_TA_100197.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDXXAAHLKGGAKKVVISAPSKDAPMFVVGVNXXKYTSXXNIVSNA

SEQ ID NO: 205780 - protein, 68 aa, Triticum aestivum
  unsure (1)..(68): unsure at all Xaa locations
  Clone ID: PAT_TA_100198.pep
XXXXXXSSSSPRXXARQPSAARTARLRCRARRKGPCRARRKEGGRRGRPLEWAKEREQITRKRREPRA

SEQ ID NO: 205781 - protein, 128 aa, Triticum aestivum
  Clone ID: PAT_TA_100199.pep
MDGDYVSGLLMGSAGLDFGVPGLDAGFFETLCGAGGAGLAAMFGDRAAGMPGFGGPFGPAEGGGGGGELGAASREGSSVSDPAWAHGANARKRKAPAAGAGKGKEAASCFAKMGEPTGPDSKKCKETV

SEQ ID NO: 205782 - protein, 68 aa, Triticum aestivum
  unsure (1)..(68): unsure at all Xaa locations
  Clone ID: PAT_TA_100200.pep
KKPTGTGNRNRQNLGPFLXAFYQPNRETLKGFPPPPSQHKKFAAFGWVPTPLKPYLKKGSQTNKPLST

SEQ ID NO: 205783 - protein, 176 aa, Triticum aestivum
  unsure (1)..(176): unsure at all Xaa locations
  Clone ID: PAT_TA_100201.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGXXDYLGNPSLVHAQSILAIWAXXXVLMGAVXXYR

SEQ ID NO: 205784 - protein, 200 aa, Triticum aestivum
  Clone ID: PAT_TA_100202.pep
ARGRDEQRQHPLPLHILFLPFFAPGHLIPVVDMAAIFSARGARCTILTTPVNADIIRPAVDRANDSNCHGTDSPSPAVDVSVVPFPDVGLPPGMENLMSLTPAHGAEYPLKFIQAVQLLREPFDRFMAANRPDAVVSDSFFSWSADAAAEHGVPRLVFLGSSVFARCCSETMLRNNPLETTTNPDDDPDDDARLVSLPGL

SEQ ID NO: 205785 - protein, 200 aa, Triticum aestivum
  unsure (1)..(200): unsure at all Xaa locations
  Clone ID: PAT_TA_100203.pep
ARGVEQTVSAPRVYPAAGASSNAHSAQITYPATAGGYLPEPDAPEGATMYVGNLPYHIDNERLKLSFQGAGVVLFSKVIYDRETGQSRGFGFVTMSTVQEAEKAVRIYHGSGMYGRPLTVKIAAPRGGARVDAPRRQSGSPLRIFVCNLPSQVDNSRLEELFSKHGKVVDARVVYERREGASCSXGFGFVTMATXXXSYI

SEQ ID NO: 205786 - protein, 54 aa, Triticum aestivum
  unsure (1)..(54): unsure at all Xaa locations
  Clone ID: PAT_TA_100204.pep
EKXXXEAAKFARYNKKPTIXSREIQTSVRXXLPGELAKHAXXEGTKAVTKFTSS

SEQ ID NO: 205787 - protein, 204 aa, Triticum aestivum
  unsure (1)..(204): unsure at all Xaa locations
  Clone ID: PAT_TA_100205.pep
EALAELLPELEALFSGDARDFIKEEAEGILVRLGDAVRGTVAEFANAIRGETSRRSLPGGEIHPLTRYVMNYVRLLADYSRWLNHLLDGCETELENGGDNADMTPLGHCLLILITHLLDKIEDKAKLYDDEALQNIFLMNNLWYVVQKIKDSELKSLLGDNWIRKRRGQIRRYSTGYLRSSWTXVLACLXDDGLPQTTGSSSAL

SEQ ID NO: 205788 - protein, 66 aa, Triticum aestivum
  unsure (1)..(66): unsure at all Xaa locations
  Clone ID: PAT_TA_100206.pep
XXXWXRXXCPALVTQQHGCACRQSRCSNLRKRTAQAGAWSLGXSSAIDVSPQIFSVCKEDKAILMN

SEQ ID NO: 205789 - protein, 140 aa, Triticum aestivum
  Clone ID: PAT_TA_100207.pep
APHASPSTCPPCTDQASARARDSRRRRFPGHLQPPSSSRSASPSSPSSAASTTSPTQTPSSAPGSSSASSTSRTAASPGSELVCVAAGSTPSMYTCPWSRETSTCTRNLLSTLTRIKPSTTLRTLQMQVPRILAQMAQLS

SEQ ID NO: 205790 - protein, 154 aa, Triticum aestivum; identical to SEQ ID NO: 125480
  Clone ID: PAT_TA_100208.pep

SEQ ID NO: 205791 - protein, 124 aa, Triticum aestivum
  unsure (1)..(124): unsure at all Xaa locations
  Clone ID: PAT_TA_100209.pep
XXXAAPSALLAPLHLPRRQGXGPSRRRAAAXXGAXGYPPSCSLAGARQGEIKPRCSAPTEASLLQHGENGGGRRHREKGGGRRHGEERRRLRQAGRGGGGVGEDGAGRRRGEGDAGLGTRRFGG

SEQ ID NO: 205792 - protein, 203 aa, Triticum aestivum
  unsure (1)..(203): unsure at all Xaa locations
  Clone ID: PAT_TA_100210.pep
HWLTQHHAVPRRSTRPPPSTLTQPAPPPRALALHTLTXPPRPRLPPPVLPQQQRERPARPRQQAPPLPSPPRPPPALPQPRPPWSLSRPRRAPRPPVRPQLLARAPSSPLPQLLPAPPPWSPQPRRGQAPRLRPPPARGLPPSSRPPRRRPASPPRAPPPSARPMGSGHQRWPLPSWMQENDRSGRGWLAEASATLIRECASC

SEQ ID NO: 205793 - protein, 63 aa, Triticum aestivum
  Clone ID: PAT_TA_100211.pep
IILIHTNALSYVTKRTKHRLWYNNTCEYNEKIRKSAGSYILKNQNVGRLKKINQNSRLVLSLV

SEQ ID NO: 205794 - protein, 88 aa, Triticum aestivum
  unsure (1)..(88): unsure at all Xaa locations
  Clone ID: PAT_TA_100212.pep
AFAGXXAPAPPPAAACVRRHHTCYGQCSPHPRWPTGTREEVRRGVGACYQFASLTPDRKPGRKQGDEERWRTRRDAPQRMWLLPRGRA

SEQ ID NO: 205795 - protein, 200 aa, Triticum aestivum
  Clone ID: PAT_TA_100213.pep
ARGSSHHPSYHLLQHAGAPPEQPCCRPPYPTRRHPTLCAAPSSPLPTSQSATRDPPPPALAPALLSCDAPPAFGSGQLRPPVTRRRRREIHPAAATPPHVLTFSAPDPKEHMAQRPPPPPWIHGAPNPPSICGLLLPLPGLLLVGIRRTSRPRILLFCSFSEPPRHTCVVGLRLLYLVVVPVQLAGDTWSSADPPSGSSF

SEQ ID NO: 205796 - protein, 170 aa, Triticum aestivum
  unsure (1)..(170): unsure at all Xaa locations
  Clone ID: PAT_TA_100214.pep
TRADLAFLDLSMNDFSGSIPPEVFALPSASSLLLSRNNFTGSLAVPAAPASATPPWSVVDVSHNGLTGEVPEALAAAGSLYVNNNKISGEVPEAVARSVFDGRMTTFYAQHNFLTGFPVPPTPLPDSAALCLSYNCMDLPSASAADGCPTIGGPLESRPADXCRSSGGDG

SEQ ID NO: 205797 - protein, 100 aa, Triticum aestivum
  unsure (1)..(100): unsure at all Xaa locations
  Clone ID: PAT_TA_100215.pep
FLFFFFIFFFFFFFFFFFFFFFFFFFYFFLNFFLPLAHPPEMLRVPAVPLGTLLSTPYPISFRAPYILALLPSQIXXKDLKDPELLSKLILNNFCTVPTK

SEQ ID NO: 205798 - protein, 196 aa, Triticum aestivum
  unsure (1)..(196): unsure at all Xaa locations
  Clone ID: PAT_TA_100216.pep
LHLSPPLTTPSPPPAASTARPAWWCASAAHPPTSTNXPAPPSPPAASATSSTSPPHLTRTTNQIPPSPTISTTSASTAPPAHAGVPDQTRARQCLVLRATTLCSLLSSSPLNSSSLLLLLLSIPLSISLRPPRPCCSSQSMVLASASLNLLLIPLPRCSLNPPHCCCSLSPCYCCSSPAPPAAALSQAPLFASPLA

SEQ ID NO: 205799 - protein, 169 aa, Triticum aestivum
  unsure (1)..(169): unsure at all Xaa locations
  Clone ID: PAT_TA_100217.pep
MQEALISPANADRLRSAFELKPYGFGDQRLSSSPRYLPGGDDGLYRCSSPFSPSLGFSSPSPLATSVSLSPSSSASLVDDGDYDGAAAAAATGHRLQLARLALQYQEVADRYELCLSHLAEAVDEAAILRRENAELRVXNSDLARRVALLGGKEXXXVVIADEIRRFRL

SEQ ID NO: 205800 - protein, 170 aa, Triticum aestivum
  unsure (1)..(170): unsure at all Xaa locations
  Clone ID: PAT_TA_100218.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGKKSKLGFX

SEQ ID NO: 205801 - protein, 78 aa, Triticum aestivum
  Clone ID: PAT_TA_100219.pep
RAEALVCRSLGIVQNGEDITVQAMDNFAKKFKDRLPDDVIGAMRALFKLDDDRIYAAEAGLIAHGGPNALDHVDEATA

SEQ ID NO: 205802 - protein, 168 aa, Triticum aestivum
  unsure (1)..(168): unsure at all Xaa locations
  Clone ID: PAT_TA_100220.pep
MQIFVKTLTGKTITLEVESSDTTDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXXTLADYNIQKESTLHLVLRLRXXMQIFVXTLTGKXXTLX

SEQ ID NO: 205803 - protein, 106 aa, Triticum aestivum
  Clone ID: PAT_TA_100221.pep
MGNCLKLQRASESWVDDDEWEVDVVEGKTAAGENEKTERVEVKIRVTKRQVQELLQQAALDGKGKRATEKVLTDLINSGTVCYHDDHETRGHWRPSLQSITEAEEP

SEQ ID NO: 205804 - protein, 187 aa, Triticum aestivum
  unsure (1)..(187): unsure at all Xaa locations
  Clone ID: PAT_TA_100222.pep
HEVKLFFRHLDDPHHKVAQAAFSTLAEIIPACKKPFESYVERILPHVFSRLIDPKELVKKPCSLTLEIVGRLYAIDMLLPALVRSLDEQRSPKAKLAVIEFANRSFSNYTVDSEGYSNSGFLKLWLSKLAPLVNEKNAKLKEASIAGIISVYSQFDSTAVLNFILSLSVEEQNLLRRALKQKTPRIX

SEQ ID NO: 205805 - protein, 83 aa, Triticum aestivum
  Clone ID: PAT_TA_100223.pep
SWSWEKLSRILRPAAAAGQLLPPAACPTPRPPRSAVALLTLLLVAWWPHLPGRPSHLHPATALPPSSCRSSCSSEATKQSTTV

SEQ ID NO: 205806 - protein, 56 aa, Triticum aestivum
  Clone ID: PAT_TA_100224.pep
KKRNLSWQKKKPTFSKGAPWPWVFRSLVTHTWDWASTPQPFYLTHVTRTPRKAPHP

SEQ ID NO: 205807 - protein, 66 aa, Triticum aestivum
  Clone ID: PAT_TA_100225.pep
ARGSSGLKVLRLHIDNSDSSSEVKKQLPELVPLQKSQLMPAHYGLMAGAIALTGVVLVVYLKRSKV

SEQ ID NO: 205808 - protein, 186 aa, Triticum aestivum
  unsure (1)..(186): unsure at all Xaa locations
  Clone ID: PAT_TA_100226.pep
MATSWLLRHPCPLARPWTRTRNDIGLQVTGITYCYWRCSRASAGGRIMADMSMNTTNCTAEPALLPQADAADPPPRVSKRSPRTGRGAAVAARHEEEGTDDEWLMYLEPAKLEVFDHLEPWAEANVVPLLKPAEVAWQPTDLLPDLASLGADGFHAACFDISARAAGLPDXXLVCLVGNMVTXXXX

SEQ ID NO: 205809 - protein, 161 aa, Triticum aestivum
  unsure (1)..(161): unsure at all Xaa locations
  Clone ID: PAT_TA_100227.pep
ENTAEEADTVATPLGLRRRLGGSSLLEEADRVAISIGEKVLLGDSSLPEEANRMAIPSGEGLQLVHSPQPQQQEITIDHSPHMSIDELLKVIKGANGMPVLFVPSSNGRLAAVAVDGLQSLVPANRSNEESAEKKHEAFCSWLMLLMSLVATVTXXAXXHP

SEQ ID NO: 205810 - protein, 192 aa, Triticum aestivum
  unsure (1)..(192): unsure at all Xaa locations
  Clone ID: PAT_TA_100228.pep
MGRPSHDTATSTSPSGSCRSSKRGPRLDRRNAYKSIGYEYDPAKLFCSYPPSPSRASSASASAAPSVASSVDLSSFRIGGSGDGGGDVQLLCRNLGLSGPEDFAISLTDWEAHKAFRSSAXSSASSSPSARSQPDRPVRESPLRHEAVEEPTLPADADFELPAKETARDPPVEAPVRPAWLDPPEPARPDVX

SEQ ID NO: 205811 - protein, 206 aa, Triticum aestivum
  Clone ID: PAT_TA_100229.pep
ARGQNPRKFGPSPGRSIHRSPVPSPPPVPMDSAPPAAGAGYPESTDSSPRSRGGDSWDEPFPSSAAAAAAGGGGGRLRLMCSFGGRIVPRPTDKSLCYLGGETRIVAVDRNASLADVHGRLSRSLLAGQPFTLKYQLPNEDLDSLISVSTDEDLDNLVDEYDRVAATSSSGGASSRTSRIRLFLFPAKPESSSSLGSLLDDSSKSE

SEQ ID NO: 205812 - protein, 117 aa, Triticum aestivum
  unsure (1)..(117): unsure at all Xaa locations
  Clone ID: PAT_TA_100230.pep
PIHLFRRHGHGEPQAATPPVPRPALRRRGSGTGRGSPAAVHVHRAPRARPPGAVPDPRARRTQRAARPTPRPPAPPXARRGXACSTPTRAXXRAWPRGSRTRXXRTSXXSRACWPRR

SEQ ID NO: 205813 - protein, 181 aa, Triticum aestivum
  unsure (1)..(181): unsure at all Xaa locations
  Clone ID: PAT_TA_100231.pep
MEVAVSSSDGVMGPLLGKLADLLAGKYGRIRGVRGEILSLQAELTSMHAALKNYTMLEDPDVQVMSWISLLRELAYDTEDCIDKFIRRLGKRGRRGGFKELLRDTTRFLKSLNSRCGIADHIDELKARIKHVKELKDCYKLSEILCSKTEHAAVDPRLCALFAEEAHLVGVEGPXXDLVKW

SEQ ID NO: 205814 - protein, 154 aa, Triticum aestivum
  unsure (1)..(154): unsure at all Xaa locations
  Clone ID: PAT_TA_100232.pep
MARLGAVVVVFLAAALAAEGILDPVDFLALQAVRRSLDDMPGSAFFDAWDFTADPCGFPGVYCDGNRVSALALGDPRAGSPGXXXXXDPALXXMSALTELSLVPGRVQGELPASLASCSNLRFLAVSKNLLSGGIPDGIGALSNLRTLDVSFXQ

SEQ ID NO: 205815 - protein, 81 aa, Triticum aestivum
  Clone ID: PAT_TA_100233.pep
FFFSVTISNHPYIQDLKYTYAGLENGANHGSSPSIVMRSCRPSHSWSPAPPAPSCHSPGVLWPASVLHGDGVARVSFCPRA

SEQ ID NO: 205816 - protein, 150 aa, Triticum aestivum
  Clone ID: PAT_TA_100234.pep
MPREYIYPDTIEDAVQTIIPYLEDTISTAHKAIYFDGWQGLGASAVLRAIAKDPPSSLLKKFNKIVHVDCSRWKSRRALQRTIAQELQLPQRVMDMFYRQDEEDDFKGVDESSRDEIQDVGAEIHHALGQHFCLLVFHNGSDNTVDFSDF

SEQ ID NO: 205817 - protein, 114 aa, Triticum aestivum
  unsure (1)..(114): unsure at all Xaa locations
  Clone ID: PAT_TA_100235.pep
XLTXXGPXXPRAPPIAAAPXXGDSGTTDEPERSTRRGDRSGSHAGSRGGGGGGVGNPRGRHRQGVXSXXXSPDXXXFWCLWPPHRXXAXXXLWSPDXXRTGGGGGGHVRLPPRA

SEQ ID NO: 205818 - protein, 55 aa, Triticum aestivum
  Clone ID: PAT_TA_100236.pep
LWMRGRPISQTYIGCTEIGKLLLSGKSCLNFRKNDNSINMNNSKRKMKTQYLGLF

SEQ ID NO: 205819 - protein, 67 aa, Triticum aestivum
  Clone ID: PAT_TA_100237.pep
MVECSCETRFFFLVNLKICRIILAKKMLRSSLTSCVHTTTSADGYKRRSSITMYVNRRRHVSCHPRA

SEQ ID NO: 205820 - protein, 123 aa, Triticum aestivum
  unsure (1)..(123): unsure at all Xaa locations
  Clone ID: PAT_TA_100238.pep
RREVPPPPAPCHRPXQPQCRDDTDDLCNHRANQPEATESPTRNRNLPPEEIPSQVQPPPWEKSRAPPRSRRPDLVIPDRDQTAAPPLRCIHAQQRSCSTHAPPPLRRVASWRTPARASLQQLR

SEQ ID NO: 205821 - protein, 153 aa, Triticum aestivum
  Clone ID: PAT_TA_100239.pep
MPLLLLLLLLGLAGPRRAAAADEQFVFDGFTGANLTMDGMATVTPNGLLQLSNATSQLKGHAFFPTPLQFHRAPNSTAMRSFSTAFVIGIIGAYDTLSSHGMAFVVAKSANFSSALPGQFLGLVGSANNGNATNHLFAVEFDTILNSEFNDMS

SEQ ID NO: 205822 - protein, 83 aa, Triticum aestivum
  unsure (1)..(83): unsure at all Xaa locations
  Clone ID: PAT_TA_100240.pep
HEALSLTLLLHLRPPPRTGRRGGAPPAYRLITXXXTPLXXPSIHQRHQLHHHTTERRHTYRHLPTDAALQPSYPNXXLXXTFY

SEQ ID NO: 205823 - protein, 94 aa, Triticum aestivum
  unsure (1)..(94): unsure at all Xaa locations
  Clone ID: PAT_TA_100241.pep
HEALLPPPLSLAEGIFLVPGFLPVLELLYSSSSSSSSSSSSSSSLTCLPPPHLCFFPFPPALLLSPCSFWLSWPPIFFTXLSCTDHSIXXIPYX

SEQ ID NO: 205824 - protein, 142 aa, Triticum aestivum
  unsure (1)..(142): unsure at all Xaa locations
  Clone ID: PAT_TA_100242.pep
MNAPSSWLFADNSKYSTRARLIFMGLSFAIGILTFLVYLAIWYTCSRRGRRSRDAGAGAGDLEAGLAAAAAERGMSDAAIAALPTFLYEEADDVDCAVCLGQLEAGEXXRRLPKCAHLFHAECVDAXXRAHXTCXMCRAPXP

SEQ ID NO: 205825 - protein, 201 aa, Triticum aestivum
  Clone ID: PAT_TA_100243.pep
MSAMSGAMEWHAWLSSARLEPALVHEYALVLARNELEAGDAAYFDHDFLRSMGIDVAKHRLEILKLARPGPGERGRRSTSSSAAPLSGLVAAVGRVARYVRALVRLRGESSSSSTALVLVPSQQQQPDGHVDVGRSSFGRCKAPKRTRSMPKAPGTTCARSSAARATRAAGGCRGAATVHAMRDAESGGGGGDTVQWECLF

SEQ ID NO: 205826 - protein, 60 aa, Triticum aestivum
  unsure (1)..(60): unsure at all Xaa locations
  Clone ID: PAT_TA_100244.pep
LIRLDDFPLNSCCDLFLNPPLFIQFHQLNFLKICFSMFLFSQNTPLVSLLIFCXRCHMGW

SEQ ID NO: 205827 - protein, 161 aa, Triticum aestivum
  Clone ID: PAT_TA_100245.pep
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERAAAPAIRVSSSVENSGVSECASCHVR

SEQ ID NO: 205828 - protein, 177 aa, Triticum aestivum
  unsure (1)..(177): unsure at all Xaa locations
  Clone ID: PAT_TA_100246.pep
MQIFVKTLTGKTITLEVESSDTIDNVKAKIQDKEGIPPDQQRLIFAGKQLEDGRTLADYNIQKESTLHLVLKLRGGMQIFVKTLTGKTITLEVESSDTIDNVKAKIQDKEGIPPDQQRLIFAGKQLEDGRTLADYNIQKESTLHLVLXLRGGMQIFVKTLTGKTITLXXESSDTXXH

SEQ ID NO: 205829 - protein, 153 aa, Triticum aestivum
  unsure (1)..(153): unsure at all Xaa locations
  Clone ID: PAT_TA_100247.pep
RFLATTDLSLSLXXGQATARRFVRSLRPAPSPHSATREASDQARIIARRPPSHRRRTNGSVNVQRGMQPRPIPTGMGGVEAAEQSRAERTRAQTSQRAARQERWRQGSGREAVSTCSQRQVQQVCGMEQGQPWTGELPLLLASGGGVVETSLV

SEQ ID NO: 205830 - protein, 157 aa, Triticum aestivum
  unsure (1)..(157): unsure at all Xaa locations
  Clone ID: PAT_TA_100248.pep
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHXXVIPNINPVLLPKKTAEKEGKAPKSPKKAAKSPKXXATPA

SEQ ID NO: 205831 - protein, 111 aa, Triticum aestivum
  unsure (1)..(111): unsure at all Xaa locations
  Clone ID: PAT_TA_100249.pep
VFVLTSRRRDANGKNLRCINIKALKDLLEAKMSSRHTYGKNLQRLSSFQLLFRYILAHXSQLMKLLLLVLILKYMCHKSRLMKLLPFGESLNIIKVLAEXLTFRXVLVCID

SEQ ID NO: 205832 - protein, 56 aa, Triticum aestivum
  unsure (1)..(56): unsure at all Xaa locations
  Clone ID: PAT_TA_100250.pep
KHIAFGTTRDKMGIRVSCYVNYVRRAPTTHXXDSDDYSWFICLDRRFKQTKLISLV

SEQ ID NO: 205833 - protein, 97 aa, Triticum aestivum
  unsure (1)..(97): unsure at all Xaa locations
  Clone ID: PAT_TA_100251.pep
GFMSXDYXGGPRPFPKTPNQLGFNQGPLKTFWGGGGRSNFTPXXXWGVGGSRVGPPPWGYPNWGGVPLRGAPSHPFXEGIFRGPYPSPGLFCPWAAR

SEQ ID NO: 205834 - protein, 124 aa, Triticum aestivum
  unsure (1)..(124): unsure at all Xaa locations
  Clone ID: PAT_TA_100252.pep
MPEAPMAAGAGAGGGVSWEEAHRQVLDLIERVTRCAGEIQRQVLVEILAQNAPAEYLRRVGVPGAAPGADDAFHRLAPLTTYEDILPDVIRIANGDSSPILSGKPIREFLTSSGTSGGXRKLMP

SEQ ID NO: 205835 - protein, 175 aa, Triticum aestivum
  unsure (1)..(175): unsure at all Xaa locations
  Clone ID: PAT_TA_100253.pep
ARGPNSPIKPTLVRPSVRRLRLRLRRRHPAMSVDDCFVPFHSPLREPTAYDRWGKGPQPCWSQLDLDKCAAGGSQGQGGADRRILQFLNRPLAVPPRRLPPPLGPLPKLSEPPSQXQHKENLPEEPKQRHPAQPAVSSAASRGRYARSRAGWASKDRSTPCIXXRAACAXXRGAL

SEQ ID NO: 205836 - protein, 78 aa, Triticum aestivum
  Clone ID: PAT_TA_100254.pep
DPTGGGLRVHVNRKSDEIKSHDSISSRSSADGVSGGMSVKLKTPFNGAVYDACDEVLLLMMPCTTFCLHNPSPSMYLL

SEQ ID NO: 205837 - protein, 80 aa, Triticum aestivum
  unsure (1)..(80): unsure at all Xaa locations
  Clone ID: PAT_TA_100255.pep
PPRPRVGGPFPPSPLLGRFXGGDMKQRVVVGVIKGXEKKAPPGPRVPRXPFKKKRGGFLAKGFCSGPWLWWFQIFIPRDQ

SEQ ID NO: 205838 - protein, 190 aa, Triticum aestivum
  Clone ID: PAT_TA_100256.pep
ARGFFPASKEACSACGMDGCLGCEFFGAEATGAIAASDAPRAATAGGPQRRRRNKKNQYRGVRQRPWGKWAAEIRDPRRAVRVWLGTFDTAEDAARAYDRAAVEFRGPRAKLNFSLPEQQQQQLGGSGNAAAKSDACSPSPSPRSADAETGDLLWDGLVDLMKLDESELCLLLPVDNTLDKFHTQGKRLP

SEQ ID NO: 205839 - protein, 199 aa, Triticum aestivum
  unsure (1)..(199): unsure at all Xaa locations
  Clone ID: PAT_TA_100257.pep
TRHTKPSRPTMADGAASLLPTAGCDGEDRISALHDDLLCAIISRLSVTDAAGTTALSPRWRHLWHSTPLVLDDVDLHESARDAIVSWVLADHPGPFRAVRLAGCRFASLDHDLAEWPRLLVTKGIQKLVLVNKHIQPQHASPRLPAEILRCDSLQRLLLGFWTFPADVXXGADVFLPHLHSLNMIRIDMSDHDLECLIA

SEQ ID NO: 205840 - protein, 145 aa, Triticum aestivum
  Clone ID: PAT_TA_100258.pep
ARGRVPNWIEELHNLQSLHITVDKLNNDDVGILAGLPALMDLELTFSRALEETIVIYGTAFAILKRFVVYWTIMPQLTFEAGAMPKLQSLSLPLNARGWKKDESATPTEILSSAIRVDFPRSFSTSGSAPSIHPSTLLLLLPSTI

SEQ ID NO: 205841 - protein, 129 aa, Triticum aestivum
  Clone ID: PAT_TA_100259.pep
ARGPNPLKPTATPTPCPSTSFVADALLPNRQQCLPFLQRRLLLLREHVDLTWMVQTTWPPLPLARVDQDECNAMWRSRVRRPSTNQGLTPAPASRPQRIDRRRPAPLTSFSSLHLPSKVESDPVVSHCR

SEQ ID NO: 205842 - protein, 125 aa, Triticum aestivum
  Clone ID: PAT_TA_100260.pep
MSTRASVLGRGMSTSSRTVTTRSFQCSFPSGALDGEGRRRRRGASGDGGGGAAPRAGRARRPCNGGRRLRPPGRAKEERQTSSGRRGGAGGGARARAAGSDLNREGWDRRGGGGDVGDEGRDGPR

SEQ ID NO: 205843 - protein, 44 aa, Triticum aestivum
  unsure (1)..(44): unsure at all Xaa locations
  Clone ID: PAT_TA_100261.pep
MAAAAEGVEAFLATCAASGDAAYGAXKAVLERLDTPATHAKARX

SEQ ID NO: 205844 - protein, 110 aa, Triticum aestivum
  Clone ID: PAT_TA_100262.pep
HEGRRPVKPPAAEPAREQKKKKPLERATPLPPAPAVTEALDDLEQELARSCLQDLLHALAPPPSSLPLPRFSLVVKASPHSATAGKVVPAAPSCNAEAATADGLRRLLRL

SEQ ID NO: 205845 - protein, 163 aa, Triticum aestivum
  unsure (1)..(163): unsure at all Xaa locations
  Clone ID: PAT_TA_100263.pep
MVSGSGVCAKRVVVDARHHMLGRLASIVAKELLNGQRVVVVRCEEICMSGGLVRQKMKYLRFLRKRMNTKPSHGPIHFRAPAKILWRTIRGMIPHKTARGEAALARLKAYDGVPPPYDRTKRMVIPDALKVLRLQPGHRYCLLGQLSKEVGWNYADTIXELEE

SEQ ID NO: 205846 - protein, 152 aa, Triticum aestivum
  Clone ID: PAT_TA_100264.pep
SRSDRGHHRAPRAPPPSSSPSRTPPHRSSSASPQHLLLPAFSFFLSSPPASQSFRFPLVMSRGSIQEASPLPPPRPSCRHRLRVLRLLANIFPATGAAALCLASIIREDDDDSAVIDPSRSVPRLARVGCTCAWTAGQASRPSPAGALVPLA

SEQ ID NO: 205847 - protein, 136 aa, Triticum aestivum
  unsure (1)..(136): unsure at all Xaa locations
  Clone ID: PAT_TA_100265.pep
MARTKQTARKSTGGKAPRKQLATKAARKSAPATGGVKKPHRFRPGTVALREIRKYQKSTELLIRKLPFQRLVREIAQDFKTDLRFQSSAVSXXXXXXXXYLVXXFEDTNLCAIHAKRVTIMPKDIQLARRIRGERA

SEQ ID NO: 205848 - protein, 138 aa, Triticum aestivum
  Clone ID: PAT_TA_100266.pep
TRVNFHLDDSDLEISPRPSECENRDRRNGATVRVQHIPSGVTAESSGERSYFANKLKAVSRLKAKLLIITRELRLPDPKMIGKQAVEEGCNRETRRYTFGPQELVHDLNTGIQLSDLNSVLEGDIEPFIRGRIVSRHG

SEQ ID NO: 205849 - protein, 198 aa, Triticum aestivum
  unsure (1)..(198): unsure at all Xaa locations
  Clone ID: PAT_TA_100267.pep
TRGRRSPRCSRWPWRPWPRSGEAEGRRRAAGPGPGSSPRPQPQPQPQQVDQHLALFWTTVMENLKDQDREGIKFYEFLQKSALVDPMELMKFGISDGLAAQRPEEVIKLRSVTDVFNNMMPIRQRYLYKYIHGERGSGEITKMEKRLRKGVELSDQKIQDIXXGNAFCPQRPKLFXXTXXPLRTNKCVLQDXXNHGVF

SEQ ID NO: 205850 - protein, 197 aa, Triticum aestivum
  unsure (1)..(197): unsure at all Xaa locations
  Clone ID: PAT_TA_100268.pep
TRSRARIGEEMSSPRSRRSSAAPPEDEDLLSEILVRLHPLPSSLPRAFLVCERWRGIVSDARFLRRFRLHHRRNPPLLGCFVQGISPIRFEPTLEAPNRVPEARFSFPIDAAHTYVILGCRHGLMLIFLWRRNQLLVWDPVTGDRHHLDVPPGFDNEETRIKGGVLRXXGVAHHFQVVLVGNSDIQLTQAXXSVYSS

SEQ ID NO: 205851 - protein, 136 aa, Triticum aestivum
  unsure (1)..(136): unsure at all Xaa locations
  Clone ID: PAT_TA_100269.pep
ARGPIPTSTSSLLTHTPPAPLSSTTLVPRASQVSMDAVESSSPYSPPSLRHKLRTTVCGCFGSPSSPGSGGRARWRRRVAAAGDFRYDPLSYALNFDDGGGDDGDADAEDAAFRHRNFSSRLXXSPVPASRAVAIA

SEQ ID NO: 205852 - protein, 92 aa, Triticum aestivum
  unsure (1)..(92): unsure at all Xaa locations
  Clone ID: PAT_TA_100270.pep
XXXXAXXNHEKRKAELXMKKIEMKXEQMKARAQEKLASKLATARRVAEEKRAVAEATLNEGAARTSEKADYIRRTGHLPSSFFSFRIPSLCG

SEQ ID NO: 205853 - protein, 137 aa, Triticum aestivum
  unsure (1)..(137): unsure at all Xaa locations
  Clone ID: PAT_TA_100271.pep
RSSASHRSAAGMPPGKRHGSAPPPVRGADRIGALPDPILQHVLSFLPAQAAVRTCVLARRWRHLWRSTRGLRFVGLDGADAVQGLRKFMDHLLVLRDRAADLDAVEIXFDRFSXXDDEAYVNLWTRFAVTXXXRXXT

SEQ ID NO: 205854 - protein, 157 aa, Triticum aestivum
  unsure (1)..(157): unsure at all Xaa locations
  Clone ID: PAT_TA_100272.pep
MVDPVLEVLQFEKCTSSNYMRENLVSGLPNGYEDPCQELLSWLLPLDRTLPPPRSLSPPTLNPSISHKQSFSASGSQIFSLSHFRSYSMPSSSFALAQLPNLRSPPISENQEFVPEKPAKTPDVINDGQLSFXXVPLEPERYSVRCGXXXVYLPXKR

SEQ ID NO: 205855 - protein, 111 aa, Triticum aestivum
  unsure (1)..(111): unsure at all Xaa locations
  Clone ID: PAT_TA_100273.pep
AELVLXAHWIHHPSTATLTLCVFALLCPSRRTSACRPFDLPPSTATLTFRLLTLLCPSRRASAALLLDLAPSMAVKTQSYSELFQSQQARNCCHRCIVRDSLLVIIWRCIH

SEQ ID NO: 205856 - protein, 104 aa, Triticum aestivum
  unsure (1)..(104): unsure at all Xaa locations
  Clone ID: PAT_TA_100274.pep
GGDWXXGPKILAPPPGXGVPXRGQGAPKRAKREGXPKXLRFLXXLRGGPILGPPKVRTXFWAKFFLGGGGQTPKKKNGVGLGGGSKRVXXGLFKPFNLGFGPRF

SEQ ID NO: 205857 - protein, 174 aa, Triticum aestivum
  unsure (1)..(174): unsure at all Xaa locations
  Clone ID: PAT_TA_100275.pep
DLARDVSAVLLQANGEQEGAAMDMQICMLRERVREQMDELVQSLISADREQEKRQAIPKLQSIADTIGRLCVAHGQPPAIEELDDEKVEVTDSGNQLKEKEEKEEDDETDMSGGEGGVAEESAVGGDNAAAETNASTETNRAXXXVDYAEYXXEAFARFRXGXXHLYGNTKNSF

SEQ ID NO: 205858 - protein, 210 aa, Triticum aestivum
  unsure (1)..(210): unsure at all Xaa locations
  Clone ID: PAT_TA_100276.pep
LLRKKRKEKSRLALRHGRRLPPRARPLPLPAPPALAPAPAPPRPAPPPPLATSRPRPLPAPPRPPASPHPPXPVAAEPAARPPPPHPLLDALKRSLLDSLAALKKPALALLLAGALLAAAAPHHAALAASGGRIGGSAFSSRSSRSSPSPSYGYTAPAPRMGGGYSSAPFYSPSPFVSVGPAFGIGFGGSGFLLTLVGFAAFLYLXXXLT

SEQ ID NO: 205859 - protein, 165 aa, Triticum aestivum
  Clone ID: PAT_TA_100277.pep
TRLESILLLGYFSLFHPGNQAVLRWGKSPTILHKVCDLPFAFFSDPELMPILTTALIAVCYGCDQNRSVVLQEISSDMISTLLRSCRASVLATSDSVAADGSGANNSGDSTHILPDIRNSLSDMSIRSSRKGVRPVLGKGVSGPVKLNRNKNQKDGRGARAGGPL

SEQ ID NO: 205860 - protein, 127 aa, Triticum aestivum
  Clone ID: PAT_TA_100278.pep
PLSRPSRRRRPTTSPASSLPSPPSDALTSTSCRWTTPPSPRLTPSSYGGRPCAAQPISSAHSSPAPRRARQPSSRMSPWLPTSSPWPRTSCRFHATYSSSPAQPCCPSSPTSPPTSTAPTRTTSSAS

SEQ ID NO: 205861 - protein, 67 aa, Triticum aestivum
  Clone ID: PAT_TA_100279.pep
RGKKQVKQPKKEVVDLETLLIHCAQSVSIDDRRSATDLLKQIRQHASANGDGDQRLAHCITSKPPSC

SEQ ID NO: 205862 - protein, 193 aa, Triticum aestivum
  unsure (1)..(193): unsure at all Xaa locations
  Clone ID: PAT_TA_100280.pep
MASPKLAAGDGSYDFHLRSLSAASRDSAAAADPASDPNLLQSVRMVFEMCKEAKGANDEMVARAFPVMNKLFQRCAAAPTLSTASTGVLLLTILQFFLDFGEAVLHDADGSLKTFFRSCLSREFSDPIVAERTLEFLIANKTKILNCFPTLXXQFFPLLLKLIASNGDRLXXKFSEVLPLMMSXXSFLPLFLS

SEQ ID NO: 205863 - protein, 127 aa, Triticum aestivum
  unsure (1)..(127): unsure at all Xaa locations
  Clone ID: PAT_TA_100281.pep
MADSSGTTVFDNLPEWLVVDEILVRLPPKDILRCRAVRKSWLSGTSTNTFILDHHRRQPSLPIIKHHKGICXXTGASNERKIRPVLQYARHFSSNNVTLHAACDGFLIMSQQRSDFRICNPXXPQCA

SEQ ID NO: 205864 - protein, 50 aa, Triticum aestivum
  Clone ID: PAT_TA_100282.pep
KILSTMTPLEMLRLPTPQYRHIKSNWPWIDLNISLSRSSNFHMVVVGEGG

SEQ ID NO: 205865 - protein, 124 aa, Triticum aestivum
  unsure (1)..(124): unsure at all Xaa locations
  Clone ID: PAT_TA_100283.pep
ARGPVVAAAAAALPRRPSAAKWTESSRSSTGRSPLHPPFPSASAVARAGAGAPPAAVAIPLLPCPWPPPPQFRTLFRSAGAAAPCSSRRCSGHPGAGAAAPLCXXDARSSPLFLXXKLSYVLTS

SEQ ID NO: 205866 - protein, 152 aa, Triticum aestivum
  unsure (1)..(152): unsure at all Xaa locations
  Clone ID: PAT_TA_100284.pep
MILTTMRCNATLTDQSQGCPGAYSEAAARKAYPSCETVPCEYFETAFQAVEKWAADRAVLPLENSLGGSIHRNYDLLLRHRLHIVGEVRLAVRHCLLANRGVKIENLRSAMSHPQALAQCEQTLTQLGIEHREAVDDTAGAAXQIAEXXLQD

SEQ ID NO: 205867 - protein, 75 aa, Triticum aestivum
  Clone ID: PAT_TA_100285.pep
SHQAPCVSWLVLLQPLANVKRSDLRPCQTSDHILIQPSTNSNLFLLPVSRFDTESGHVLDHFSSHFIKITVKKTA

SEQ ID NO: 205868 - protein, 141 aa, Triticum aestivum
  Clone ID: PAT_TA_100286.pep
MFSSKLRPAASSSGDLPVDALCEVLLLLPAKELCRLRAVCPAWRALTSDPLFVAAHKSRHRTALPLLAMGYCDGSGVNGVAISDLSGNVVRRIPSTGYEVVRVNTASGDAIGRFTSKDHLCCAHAARPRLFQLEFLFWSGC

SEQ ID NO: 205869 - protein, 79 aa, Triticum aestivum
  unsure (1)..(79): unsure at all Xaa locations
  Clone ID: PAT_TA_100287.pep
GKKKFSFIGPSPIGAKKNFQLYKAFLKDSPPFFPPPGKRGFIKKNFSLWAKNXXSHPTPXKWLXRLNGGEKPAGGENFS

SEQ ID NO: 205870 - protein, 166 aa, Triticum aestivum
  unsure (1)..(166): unsure at all Xaa locations
  Clone ID: PAT_TA_100288.pep
ARGFSPDPDLRCRLFSPSPPPPPSPPMSRPPPPFTPQNPTPAPNPGGPASTLPASFSNLQISRAPPPSASAGPPPGDGPVPSSIRGPQAPPPGARPFPGSPPPPLQPGSLFARPAAPVQQSPPFGGPPAASLQQSPXXXRPTRCAAVAAAAEISLQAVRAAAGAAS

SEQ ID NO: 205871 - protein, 140 aa, Triticum aestivum
  unsure (1)..(140): unsure at all Xaa locations
  Clone ID: PAT_TA_100289.pep
RRTHGKGSTAALHLSCPTRKRTLRSIXXVAESRSFSDRTAQMATDLVYHRTARSTMSIWSKFRVENFERVKACAQQDTPRPPAIKTSAGRAFNAPLLLPPSLSTQRRPTTTTAARKDSARHRQRRGHHRRSRRWEVFSSC

SEQ ID NO: 205872 - protein, 142 aa, Triticum aestivum
  Clone ID: PAT_TA_100290.pep
TRPLTGRERSRALAPPLPYASPAASSATPATPLTALPPSPHPFSSPTYPRPPPHLPSVASSPAPPPDVASVRATATTAAPSPMPSRARLRPDSSPPPSFVPPRGSPRRTSPSRSSASPAPRQPVPSAAPPGLLAPIRPASIA

SEQ ID NO: 205873 - protein, 136 aa, Triticum aestivum; identical to SEQ ID NO: 116005
  Clone ID: PAT_TA_100291.pep

SEQ ID NO: 205874 - protein, 84 aa, Triticum aestivum
  Clone ID: PAT_TA_100292.pep
MATDRRIQPARSGGGGGSSPGGGGVEPGLGRRLLHVLRAVYHMLRRGLCRKRLMMDLHLLLGRGKLAGRQFRDLLAHQPLAGGH

SEQ ID NO: 205875 - protein, 78 aa, Triticum aestivum; identical to SEQ ID NO: 106980
  Clone ID: PAT_TA_100293.pep

SEQ ID NO: 205876 - protein, 116 aa, Triticum aestivum
  Clone ID: PAT_TA_100294.pep
MRSKANGDTAFKASGKNKTATGGVAKPKRAPTPFFAFLAEFRPQYMEKHPEAKGVAAVTKAAGEKWRSMSDEEKAKYGGKKADAPASKAVNKKESTSSKKAKTDADSDVDGEEDEE

SEQ ID NO: 205877 - protein, 113 aa, Triticum aestivum
  unsure (1)..(113): unsure at all Xaa locations
  Clone ID: PAT_TA_100295.pep
MVRGAHYGGACAVLLAAAVALGLGVRGGAAQLDDKFYDGSCPGVHKIVRRVXXXXHKADARIYASLTRLHFHDCFVQGCDGSILLDNSTSIVSEKYAKPNNNSARGFTVVDDX

SEQ ID NO: 205878 - protein, 146 aa, Triticum aestivum
  unsure (1)..(146): unsure at all Xaa locations
  Clone ID: PAT_TA_100296.pep
TRAILSLPALTQLNLAENRLSGRIPPAIAKSGKLQLLFLEGNLFTKELPNVDIPSLLSFNVSFNDLTGEVPKGFGGMPATSFLGTTLCGKPLPPCRTPSTQPPSQPPTVAPEAAVAGNSRGRGRRHLAGGAIAGIVIGCXXGFLLI

SEQ ID NO: 205879 - protein, 125 aa, Triticum aestivum
  unsure (1)..(125): unsure at all Xaa locations
  Clone ID: PAT_TA_100297.pep
APTKPRQNRNRRHPNHTQTLEPLPNPQLPTAPLPPMADAAFPSPAMLPPSDSDLLLPXPTPRPPKPXXGPPTSPTPPPPPRIQRPPSPTPTPPPTPTFPPSPRSTRRPWMTPXTTGSTTPRAGST

SEQ ID NO: 205880 - protein, 203 aa, Triticum aestivum
  unsure (1)..(203): unsure at all Xaa locations
  Clone ID: PAT_TA_100298.pep
HEAAAPELAASAAVKAIAEWGRPATDITHLVVSTNSAAHAPSVDFRLASLLGLRSSVCRTMLHLNGCSGGCAALRLAKDLAENNRGARVLVACVELTITSFRGPDKEDCFDTLISQGLFSXXXXAVIVGADTVRSVEHPLFEMVSXXXXVIPESEHLLNMRLGNSGICGNISTELPRLTGDNIEXXLLDALEPLGIHVKWNDL

SEQ ID NO: 205881 - protein, 194 aa, Triticum aestivum
  unsure (1)..(194): unsure at all Xaa locations
  Clone ID: PAT_TA_100299.pep
HEANFLNSLPLPSSSAPPAPQPNKHLAARRPPPADRGLGSGPPLPAPSRPPDRARHGQRRRGDARRLLLLLLRRRRRRRRGVRGGGGRREGRGDGDGGPVVRGGPRLRVRRAALVRPRAGRGPRRGRRRRALVRHRPQLPALXLIAMMLAEDLGLPNLRSITVADIEAVRCPKPSQRCSGATEQSIYRSHVPNX

SEQ ID NO: 205882 - protein, 103 aa, Triticum aestivum
  unsure (1)..(103): unsure at all Xaa locations
  Clone ID: PAT_TA_100300.pep
MAARRAHAVEDLALLVAALVLCAAPAPGEGAGANCSQVVSYLTPCISYSMGKVNVPGXXXCSGVRGLNAXAATXXDXKTTCTCLKQQASGMGGIKPNXXXGIR

SEQ ID NO: 205883 - protein, 191 aa, Triticum aestivum
  unsure (1)..(191): unsure at all Xaa locations
  Clone ID: PAT_TA_100301.pep
KLVRPSFGVNNTTGTSGNDLQGNAIVEVRPSHEENNTTGNSGSDLQGNAITERNQSPASIVERNQSSASMVEMNHSPAAITERNQSPAAIVERNQSLASIVERNQSPAAIIERNHSPVETDGNKFIIDLNEPASVESDLAEDGSIAPCPVATNTQTEKSCEVDVKKQNCSNSXGVITKQDVQXXQWCTYRX

SEQ ID NO: 205884 - protein, 154 aa, Triticum aestivum
  Clone ID: PAT_TA_100302.pep
LVVLLAWPRSSPPRPPWTASRSLAWPRSSPPWTPWTAAWPRAWPRCLPPRTPWTAARPRAWPRSLPPRTPWTAEWPRAWPRSLPPRTAAHPRAWPRTSSPRPPWTAAAPSSRPTPPWTAAPSLTPAPPWICPPFAGAMRRRRLEVDRHANSRPI

SEQ ID NO: 205885 - protein, 133 aa, Triticum aestivum
  Clone ID: PAT_TA_100303.pep
MAALTQGAIDGLLGVPAKAITDEAQLIGGVPGDMQFIKDEMNSMNGFLLHLTKTEGQHDDQVRAWMKQVREIAYVAEDCVQRYIHDMVPNEAACCRSLGALAAMAHLLLLHPKKFRRLHTGPSKPGTKIEIGL

SEQ ID NO: 205886 - protein, 76 aa, Triticum aestivum
  Clone ID: PAT_TA_100304.pep
ARGSLDRTLPPPPPPPPTPTAGRRSPSPRDPALPGPSPLVPVQDVTPTQHPHPDGPTARSTPPPAGAHLDGSRLNL

SEQ ID NO: 205887 - protein, 92 aa, Triticum aestivum
  unsure (1)..(92): unsure at all Xaa locations
  Clone ID: PAT_TA_100305.pep
HEAPGIIGDRSXXRNMHGRXIRIWLXSAGDQRNDATGIVLGHAREHRTAAPSEHPAADPPGLPALARRPGHAHXXXAELRQASRPHRRXLRV

SEQ ID NO: 205888 - protein, 128 aa, Triticum aestivum
  Clone ID: PAT_TA_100306.pep
MDHKTWLWRKKASERTVLVKNKPNISDKEQEEKIARLERSLQGLNEQLSFAHAECFEKDAILSKQAKVAEEAILGWEKAEAEAIAIKTELDDTLHQKAMVEQRICQLDEALNVAAEVVDKGYCSNNFL

SEQ ID NO: 205889 - protein, 198 aa, Triticum aestivum
  Clone ID: PAT_TA_100307.pep
TRLVTVGDLIINMYVRYLFSEGQEELVGVYASQLERDVCIDLFVDMMELRLNSSLHTMYKLFLSAVEYLPFSSGDASKACFEEIIERVLSRSRETKPHQYSEDFSDVVEQHHLQALQKAMIIQWLCFTPPSSIPGFEMITGKLLIRALMHSNTLFREFSLISMRRVPELPVGPHKLLAILAEPLKQKENLFSLEKCLI

SEQ ID NO: 205890 - protein, 78 aa, Triticum aestivum
  Clone ID: PAT_TA_100308.pep
MSCCGGSCGCGSACKCGNGCGGCNMYPEVEAAGATLLVAATATHKASSGRMEMAAENGGCGCTQCKCGTSCGCSCCSC

SEQ ID NO: 205891 - protein, 170 aa, Triticum aestivum
  unsure (1)..(170): unsure at all Xaa locations
  Clone ID: PAT_TA_100309.pep
ARGSLSLSLSLSLSHSPNSSAQQQTDPSPSIPRARTKQTARKRTGGRAPRKQRATKGARKXAPATGGEKKPQRLRPGTVALREIRKYQKSTELLMRKLPFQRLVRESAQDXXTDLRLQTSAVSALQEAAEAYLVGLCEDTNLCAIHAKRVTIMPXXIQLARXIRGERAWR

SEQ ID NO: 205892 - protein, 106 aa, Triticum aestivum
  Clone ID: PAT_TA_100310.pep
QAQYYSVKHHNQNTNIKAYNGQYIHNISSSVATNTASRRWYWHLHGGPSPSAPPPPPPSALRAQQPLARHRRPTAPAQHPPSHRACPTVRGRAPWPQTSGSNVLRW

SEQ ID NO: 205893 - protein, 155 aa, Triticum aestivum
  unsure (1)..(155): unsure at all Xaa locations
  Clone ID: PAT_TA_100311.pep
MMSGGRMNPAASDDFPFAAMQPPPYVGFDHAGGGGQRHQGAMMYDNFDYAATFGQFQXRAEPPDAGRCRPAATAPAXLVPMAPPPMPGMQLQMPPMPHGMHGHGDVYPAXGMVKREGGAGDAGRIGLNLXRRTYFSPDDMMXAVDRXXMRSRLXX

SEQ ID NO: 205894 - protein, 160 aa, Triticum aestivum
  unsure (1)..(160): unsure at all Xaa locations
  Clone ID: PAT_TA_100312.pep
MGSSHRHLMRLLDDPFFPFPPPPPTSSLSLTSCPFLPPPPPSPFAFPHHPDLLDLYLPADPFFAPPSPHAFLLHDLTDRVAALELAARAAAPQPARRKYTYAATEPGGRKVKWTAEEKPRGGGRALKWEAELASPNDDGFXRKWRWEAKSKGAGGKTKTK

SEQ ID NO: 205895 - protein, 148 aa, Triticum aestivum
  unsure (1)..(148): unsure at all Xaa locations
  Clone ID: PAT_TA_100313.pep
TRAGSEIARQREEEALGAAERFLAVHVDSGIPHQWSLISLSFLFDSPLLLLEFLNVFFIEVCMPGVFFCCTFFGWCSFSFISSNVCRIVLKLRGGEGFPFLFRAWQVDGKQGSCGQLLAVVQRGFGGAGLLETGSXVLPDPFLPKYRK

SEQ ID NO: 205896 - protein, 194 aa, Triticum aestivum
  unsure (1)..(194): unsure at all Xaa locations
  Clone ID: PAT_TA_100314.pep
ARGLRNSQVLSASSSSKSRSSQKQLPVTSSRSSQNPIFMDSFPKLKLWYRQHQACLASPLSGLAHGTPVHNIVDSLLNLMFRKANKGSTSIGSVSGSSSISNSSGPGGDGSHLWPQLPAWEILEAVPFVVDAALTACSHGRLFPRELATGLKDLADFLPASTATIVSYFSAEVTRGVWKPAFMNGTDWPSPAXX

SEQ ID NO: 205897 - protein, 80 aa, Triticum aestivum
  Clone ID: PAT_TA_100315.pep
NHSYKLLLSMVPWWCTMSLDFSELKVHSRLTNDSYSHIQRRDTQVKLAWSLFVVAADMVDAELELTLVPAYLNYYYYNMS

SEQ ID NO: 205898 - protein, 81 aa, Triticum aestivum
  unsure (1)..(81): unsure at all Xaa locations
  Clone ID: PAT_TA_100316.pep
LFCSMVKGHGIFFRANEQCLFCHSKTRAFLFLWFFFFGKPLLLNDLVRRGLPIVPNSSFGLGXHQXERSVLIDVLLXLQLX

SEQ ID NO: 205899 - protein, 138 aa, Triticum aestivum
  Clone ID: PAT_TA_100317.pep
ARGLSSFPVGGGGAKPSPLSQAAKARRRAADTVPSPGRGGGRRAAGGANPGGQDHDVGRQRHKTRAAKGRRRAADTAPSPGSGGGTREEEIPTAAQILAWRHHLRRRHSVHLASIPWRQVYLICFYVILIIFMVYRSD

SEQ ID NO: 205900 - protein, 89 aa, Triticum aestivum
  Clone ID: PAT_TA_100318.pep
TRSPSKIIHAIAWHRSPSSVSSSSYRSELGASSNSLSWTEKSETNKSDIFDDYGGMKSGSHSQTLGRLYAWEKKLYEEVKVGYISAGVI

SEQ ID NO: 205901 - protein, 160 aa, Triticum aestivum
  unsure (1)..(160): unsure at all Xaa locations
  Clone ID: PAT_TA_100319.pep
MATETETFAFQAEINQLLSLIINTFYSNKEIFLRELISNSSDALDKIRFESLTDKSKLDAQPELFIHIIPDKATNTLTIVDSGIGMTKSDLVNNLGTIARSGTKEFMEALAXGADVSMIGQFGVGFYSAYLVAERXVVTTKHNDDEQYVWESXXXXSFTV

SEQ ID NO: 205902 - protein, 181 aa, Triticum aestivum
  unsure (1)..(181): unsure at all Xaa locations
  Clone ID: PAT_TA_100320.pep
MAELRHSTAAAAARASNSPAKRDSDASSASSPFASTSAARGRDDDGKDAHRSSPLLPHHHHHKQLLPSPLRSLLALDEPRPPTASLSYRILLAVLALLLLAALFSAPSLWSRFNVPYLCQKEGITLHCPQTKEPLSLWENPRAXTAXXXPCAERRSDEPSDVPPXXXTSGYIFIHAXXXLN

SEQ ID NO: 205903 - protein, 103 aa, Triticum aestivum
  unsure (1)..(103): unsure at all Xaa locations
  Clone ID: PAT_TA_100321.pep
YIFSSCVPHSLKHVSVVYWLVVTMHVFEAVVGSPLLYICLATLLFKLFLGNYLNSSEGHLFLMFLFFISISIMALSTXXKHQGQRSSFCSXXISSLNXXWXXM

SEQ ID NO: 205904 - protein, 115 aa, Triticum aestivum
  Clone ID: PAT_TA_100322.pep
RPPISPRPQPPPASSDPPAGAPCYSAPTRLPLLLESSPPGRRSSTPPRPGRPPSVPCGRTRPGAGLDRPPACPALSALRPAAGGARTPGPPFHSLVTTLLKLFHLFTRKKTELNC

SEQ ID NO: 205905 - protein, 123 aa, Triticum aestivum
  unsure (1)..(123): unsure at all Xaa locations
  Clone ID: PAT_TA_100323.pep
SASTRPPLPPAPQLNASTSSTVTGGGYFDLPPSVDSSCSTYALRPIPSPAVAPADLSADSVVRDPKRMRTGGSSTSSSSSSSSLGGGGARSSVVEAAPPVAAAAGAPAXXVVVVDTXXXGIRL

SEQ ID NO: 205906 - protein, 173 aa, Triticum aestivum
  Clone ID: PAT_TA_100324.pep
MDGAVHNLIATTFLENSSYHLATNHHGKLDVPYGKYIRALRCVGCSNVEFKGGSFPHEKWLRVLELTESSVLKLPDYILQLKHLGYLKISKFTGLVTLPESVGHLKNLFHIDLSGCSRLAALPESFGDLVNLTHVNLSRCHGLTELPEPLQKLGKLVHLDLSFWSCFIGERLG

SEQ ID NO: 205907 - protein, 195 aa, Triticum aestivum
  unsure (1)..(195): unsure at all Xaa locations
  Clone ID: PAT_TA_100325.pep
MASNTALAPAPAPAADELLHEFGPLLRVYKSGRIERPLVLPPVAPGPDPSTGVQSKDVDLGAYSARLYLPPSAAAGTAAKLPVIVYVHGGGFVAESAKSPNYHRFLNDLTSACPALGVSLDYRLAPEHPLPAAYDDCLDALRWVLSAADPWVAAHGDLXXVFVXGDSAGANICHHVAIQPGAARLGGXXLIHPWF

SEQ ID NO: 205908 - protein, 151 aa, Triticum aestivum
  unsure (1)..(151): unsure at all Xaa locations
  Clone ID: PAT_TA_100326.pep
MAPPLLLALLLAAAAVALASSAATVVFPKEALPTSSGYLSVDPSANASLFYAFYEASAPLAAAPADTPLLLWLQGGPGCSGLVGDLFELGPYLAAPDGASLSRNPFAWNRRFGLLFLDSPLGTGFSAAPTPALIPTNQTADAAHILAALQX

SEQ ID NO: 205909 - protein, 75 aa, Triticum aestivum
  unsure (1)..(75): unsure at all Xaa locations
  Clone ID: PAT_TA_100327.pep
KHKKNPSNKNISYNXHPYLSLFFFSIAAYLLLYVAYYPVLPNLNXLNTFNQPKKKKKKKKIXWGGGGAPPPPXXP

SEQ ID NO: 205910 - protein, 68 aa, Triticum aestivum
  unsure (1)..(68): unsure at all Xaa locations
  Clone ID: PAT_TA_100328.pep
GLAPQRGXWCFRXXVGMGCLKLFVAGFCVGFLFSYRVFAGARCLRRSRLCLSRPVPLFFCLKAXVCCP

SEQ ID NO: 205911 - protein, 86 aa, Triticum aestivum
  Clone ID: PAT_TA_100329.pep
GWLPGVLLPECEGAEDRICFHGHPSFTPFSAEEAHAKVKYCYRNKASKSCHMVVRGSTGPSGGEVWRFKDGADFSFHDPFSQVLVR

SEQ ID NO: 205912 - protein, 191 aa, Triticum aestivum
  unsure (1)..(191): unsure at all Xaa locations
  Clone ID: PAT_TA_100330.pep
ARGNLAIVGHVDSGKSTLCGRLLHALGRISKKQMHKNEKEAKEKGKGSFAYAWTMDESADERARGITMNVGVAYFDTKNYQVVMLDSPGHKDFVPNMISGVTQADAAVLVVDASXXSFESGMGVNGVGQTKEHSQLIRSFGVENLIVAVNKMDSVGYSVERFNYVKSQLGIFLRSCGXKESAITXXPLSXM

SEQ ID NO: 205913 - protein, 190 aa, Triticum aestivum
  unsure (1)..(190): unsure at all Xaa locations
  Clone ID: PAT_TA_100331.pep
PFVPAPLLPRSGPPSFPAXGXTPRLPLFPCLPFCSHGGFAGGPRRRQTVXSGPRRRARASSKGRQAPAEMEDGSXLTPAPAWSGSCTSTTAHFVDVDDGSRSSLVGSLNPRSRDSSPMDEARSNRPTGTSRAGRGDAGSEAPDNGESPEERAAGAGRSARAEGMGGVAIWARRAGGEGTGGDRDSGISCR

SEQ ID NO: 205914 - protein, 131 aa, Triticum aestivum
  unsure (1)..(131): unsure at all Xaa locations
  Clone ID: PAT_TA_100332.pep
DLHTWRPLWGSLEAACGRSTLELASVCICRCYKCGIEQITSCVCQGLPALVDETCLFHHDSKCCCRVLLGHRGDLHMSPVTALLGTRSAADQVWVVKRATSGRWMTNYVWSEILXTQCFMLMFWRSGNCRD

SEQ ID NO: 205915 - protein, 119 aa, Triticum aestivum
  unsure (1)..(119): unsure at all Xaa locations
  Clone ID: PAT_TA_100333.pep
GFQPANSVRNRIRLKRSNLLHRRGLPQAAKTHITKCAHLLPTXSMGLNCVRTKWMPFPSXCWKKSFCAXTILQNTRKGNQICKDXVPPXKVRLRAQNKGGLKSXGXXWXFPQTXPLXKL

SEQ ID NO: 205916 - protein, 139 aa, Triticum aestivum
  unsure (1)..(139): unsure at all Xaa locations
  Clone ID: PAT_TA_100334.pep
MHASILPLYNITCIVSGCQDSSYIVRKSFIHKLFGLLKKHAIPVRYACAFALASTDCAGDVRTESLRYLTEVVKEQRGVSVHQEQNQAMTPIVEHPAYAVLFLIHTLHMNEEVPFNXXEXXXGSAEFWGPLIGMFXPSL

SEQ ID NO: 205917 - protein, 134 aa, Triticum aestivum
  unsure (1)..(134): unsure at all Xaa locations
  Clone ID: PAT_TA_100335.pep
AKGVLFPRIYLVDLTAMKRCRXRDPXTXTSXLELQXFKSXIVFPDLSPADPGTQNFRXSKXAPEGDGARXVXSGXPARPDRFHXGXSHERPQKTGDGRVPSPPETFXXGRGGGAGRRRDMGGAGGGGDHRQWDG

SEQ ID NO: 205918 - protein, 131 aa, Triticum aestivum
  Clone ID: PAT_TA_100336.pep
GDHCHATDKDTKWETLRQSFKRKIACKDFPHPRHLCSELPFSTTPHPKHCKMCYCYVCDAPAPCKSWGKGLLNGDHCHATDKDTKWETLRQSFKRNFELGKEATVSAGNLTYGFDTERLRQLFYARTLTFS

SEQ ID NO: 205919 - protein, 65 aa, Triticum aestivum
  Clone ID: PAT_TA_100337.pep
WQLRNHRAGLRQLPLNPEVVKLVLDKVKDNYHRNFVVDADQRWLLHRWKGRVLYAWSSWVAADAT

SEQ ID NO: 205920 - protein, 105 aa, Triticum aestivum
  unsure (1)..(105): unsure at all Xaa locations
  Clone ID: PAT_TA_100338.pep
MRPEARLDSAAFQLXPTRNKCDLVVVSNGRKEKXASGLLKPFVAQLKVPQGANXQGKVQQPAPXRIRVPTRQWVNKGEQXKRFVRVREQPREVLERVNNNQVRKY

SEQ ID NO: 205921 - protein, 143 aa, Triticum aestivum
  unsure (1)..(143): unsure at all Xaa locations
  Clone ID: PAT_TA_100339.pep
MSCCGGNCGCGAGCKCGNGCGGCKMFPDVEATAGAAAMVMPTASHKGSSGGFETAGXTGGCDCTTCKCGNRVRLLLLQLQTEPAPKEGRPAKGEAXXLRRTSKQATSNKFNPVNTKPQRASRGPRALKKKTVRGSVNLLPPFP

SEQ ID NO: 205922 - protein, 148 aa, Triticum aestivum
  unsure (1)..(148): unsure at all Xaa locations
  Clone ID: PAT_TA_100340.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVXSLLTESGNTKDDLKLPTDYFCLGKLKLDLLMXKDLILSVKSAMG

SEQ ID NO: 205923 - protein, 116 aa, Triticum aestivum
  unsure (1)..(116): unsure at all Xaa locations
  Clone ID: PAT_TA_100341.pep
KRSSSQLLHVPVPAVPRSRRARAQLGVQYTSXLAHAPTPXLLPPPRLFRGSSFFPARRGTXXGGVXGGQMXSRSEGVRHDGGAGISXXGXRAVRCSPVGRCSXXGKPXXPDXSAXG

SEQ ID NO: 205924 - protein, 101 aa, Triticum aestivum
  unsure (1)..(101): unsure at all Xaa locations
  Clone ID: PAT_TA_100342.pep
MLPPDRAMPFLLLFLFLGLAAPRPAAAADEQFVFDGFTGANLTLDGMATVTPNGLLQAVQRHQAKLKGXAFFPTPXQFQRAPKXKGMQSFSTGFVIXIIGX

SEQ ID NO: 205925 - protein, 185 aa, Triticum aestivum
  unsure (1)..(185): unsure at all Xaa locations
  Clone ID: PAT_TA_100343.pep
MAFSPRSPWSRSKKPDIYSTVVVHDDEDDARGGGAARAEDDDDDDPSALPPLLQXRLPKDFXXASFXDEXQPYSSDLEEASLSGNXVXKAAGAPPXNXXSSRFPFLDLXXXSSPXAAKGEPXXNXLVQGNXRXGGGPXNPXNSXPGXLXPXXXGPPNPXSPFSGKIXRQXRGFSKPQKXXSGKXN

SEQ ID NO: 205926 - protein, 117 aa, Triticum aestivum
  Clone ID: PAT_TA_100344.pep
DGYFPFPSLALTLTSSSLLWNNDVPPQNISLLREKGAEKISGSRLSKERQGREELLGLSRKKATGSAAMGGRQGGPAVAPGGQAGPARRRRDGWAGGGSKWEQSQVGQGARPARERH

SEQ ID NO: 205927 - protein, 69 aa, Triticum aestivum
  unsure (1)..(69): unsure at all Xaa locations
  Clone ID: PAT_TA_100345.pep
PGIGVGXNLPXGGXXKXPASXXSECDXHYPTRGGREGEKAMATATXARPERWVXWCGVRGRGGGRWSGA

SEQ ID NO: 205928 - protein, 92 aa, Triticum aestivum
  unsure (1)..(92): unsure at all Xaa locations
  Clone ID: PAT_TA_100346.pep
GRPPLFPGQRTSPEHVAGKPGPRRRFFPLPPPXRTPNSSAQAAAAAAXAPVACRGKGSAAWAPGARPAPSRRKPTAPPPRGPPPPPPRLRRP

SEQ ID NO: 205929 - protein, 54 aa, Triticum aestivum
  unsure (1)..(54): unsure at all Xaa locations
  Clone ID: PAT_TA_100347.pep
MASGSGEHFLRQLSSSNGLQAAQDGYGGGGGRXXGXRXWXNKRAGXGXGGPRES

SEQ ID NO: 205930 - protein, 210 aa, Triticum aestivum
  unsure (1)..(210): unsure at all Xaa locations
  Clone ID: PAT_TA_100348.pep
LQPTHTHTSSATPKRWRRPLALAAVGYHYQYHRCRPFHPASSTGGATTRCPCALSLPASPTRPNRACWAGSGPACCPGRSDGNAXQGSEEISKHICSCSGTLAAKRCWLSKRAGXFWAKGEXLXATKAGCFPGFFGPILXFPSALXVTXAQXLKXLKDSPNNKXTPXLGPPXGXSSGNNFPMXSRXTGGGXQXKPGNEGNXWXGXLEKKX

SEQ ID NO: 205931 - protein, 65 aa, Triticum aestivum
  unsure (1)..(65): unsure at all Xaa locations
  Clone ID: PAT_TA_100349.pep
LEFFFFFFILSKIFYMSCXLTHSIPDGNKEAXQNQLLXHYKXSLDQSXCXRSVCTSLYIPSGAEP

SEQ ID NO: 205932 - protein, 191 aa, Triticum aestivum
  unsure (1)..(191): unsure at all Xaa locations
  Clone ID: PAT_TA_100350.pep
TNPKFALSLSCVLPWLALALSLSFSPSSSSPPPPPTPSLRPPRPRLPPTPAPSPSPPLPPLRPPQAPQSLHRPKTPSPLPPPPPLPTPSTXSPPRQLPPSKANAPPTLAPPTPSPVKLPAAXICRAPGNXPARSSSPXXGPGLTAGAKNLPSTDWAQGFSWPPRFGPRGRGIWSVLPGAFPGGPVGPRAGP

SEQ ID NO: 205933 - protein, 152 aa, Triticum aestivum
  unsure (1)..(152): unsure at all Xaa locations
  Clone ID: PAT_TA_100351.pep
YLSSLSHPLSLLHPTSPSPSNLRRDPLPRRQPWPPPSAAYGTAKSGVGVASMGVMRPELVMKSIVPVVMAGVLGIYGLIIAVIISXTGSTPRXKPYFLFERANAATLLPGLAWRGLAGGSPAGQLGNRAIVPANARAFKGPNGAKQSLFRGK

SEQ ID NO: 205934 - protein, 90 aa, Triticum aestivum
  unsure (1)..(90): unsure at all Xaa locations
  Clone ID: PAT_TA_100352.pep
DAHFSRFVSSSIADPXPPXHRNNRRPARNRAALLXSVTYMKFPSXARPNNGGGATTNERIXLLLLFSSXKPARPRSPLPNPRSEGXPPMP

SEQ ID NO: 205935 - protein, 71 aa, Triticum aestivum
  Clone ID: PAT_TA_100353.pep
LVPNSARGLHVVWKSLFQLVKCISLLLENRTKWDLANKLNTRATQSLSMQLLLVKNSFPIVLSNNFTSLSL

SEQ ID NO: 205936 - protein, 85 aa, Triticum aestivum
  unsure (1)..(85): unsure at all Xaa locations
  Clone ID: PAT_TA_100354.pep
SYHPVLNTYKRGPPHTQXPRSTRXPPFPGAXRFRGCVPVXQAXXXKXNXQCSXKGPXCPXHNXLWXXXYXLAXGXTLXGKPSXFS

SEQ ID NO: 205937 - protein, 196 aa, Triticum aestivum
  unsure (1)..(196): unsure at all Xaa locations
  Clone ID: PAT_TA_100355.pep
RKTFXPGXFPGGGGGPPGXFPNXPEFLGAPSKRLKLXCFDGPRLTSFGXGRTFALXHXXPPPALGGREXSSSPATRAPLDFRGGLARCQVQQPEVLREAGGVVPGMLGRVHPVHRAVPARVAVPTRPRLPGLHRRRRIPALLQDPGTPSSSSAQRGLCSEEEEGRGGGGTTPRASLPASRPLRHLRIQPELSFQFS

SEQ ID NO: 205938 - protein, 136 aa, Triticum aestivum
  unsure (1)..(136): unsure at all Xaa locations
  Clone ID: PAT_TA_100356.pep
FGQRPXEXDXXXKXKXPFLRCPRFNGLGSLKEIXXFXFXRGVALSPFLLXLFLXFFXQRYCGGPVKNXSXISKVSSIPLETEADSAARPPLPSASPTHEASAPPLLPGCHPPSLALLRFXSPPAAPSRRRRRRRLS

SEQ ID NO: 205939 - protein, 138 aa, Triticum aestivum
  unsure (1)..(138): unsure at all Xaa locations
  Clone ID: PAT_TA_100357.pep
MCCSECGCYDAFCNCCCPCISHDARETILCCAACLAVLAGVVLFAVLLAAYGFIRHAEVAVTDASLTRLALATAPANAFAXXNLSLRLNRSGNKNWGMKQEQPTRLRRPTKSFRTGRLRSVKAPPDGPRNPGWGKVVT

SEQ ID NO: 205940 - protein, 173 aa, Triticum aestivum
  unsure (1)..(173): unsure at all Xaa locations
  Clone ID: PAT_TA_100358.pep
VISPAQPPQSGHFHTDEKCLPWSSXTSKLLKKIVTVQPRDQYAPFEYTFVHTLLELLTSVSVRRTRSLTRTQSTSSCQDPRPVLLRLAASLRAVNXXVLARQCPGATPAAAGXPPLLKWPALGTGRXTAKPAKGEXXPYRGVLGSXPXRGGQRXREPKLXXRGXNPAXPCXXR

SEQ ID NO: 205941 - protein, 186 aa, Triticum aestivum
  unsure (1)..(186): unsure at all Xaa locations
  Clone ID: PAT_TA_100359.pep
SAETSASFHHLHPIANTRHETRTRAPPLCQASQEYGHHERADAPPRPGGRRAAAAHVLRGGRRQEHDARAGAGWQAAGGAAADAALGGRLPLPARRGRGACRCRTTRRPRKGATAGPAANVPFRATFPPAVPQRTGSGLGAXPLPPAGRXAGGXTKLVQTXLXKQMXGXWXXALNKPPNXGTXXRG

SEQ ID NO: 205942 - protein, 119 aa, Triticum aestivum
  unsure (1)..(119): unsure at all Xaa locations
  Clone ID: PAT_TA_100360.pep
MARGLKKHLKRLNAPSHWMLDKLGGAFAPKPSSGPHKARECLPLILILRNRLKYALTYREVQSILMQRHIMVDGKVRTDKTYPAGFMDIISIXPKTGENYRXLLYDNKGRFPPSTPVKG

SEQ ID NO: 205943 - protein, 155 aa, Triticum aestivum
  unsure (1)..(155): unsure at all Xaa locations
  Clone ID: PAT_TA_100361.pep
VAASSQSSPSSPRHHPPRKGGCLAAAATADAAPAASAATAAAGARCSPTLRPPPAPPPWSCPPPPTRGAPAGSRRPAGRPAAATAPPASAARPAAAPAGXATEPAPKRPARRGEHEDXGGTTGTKQPTTTTTTSLARLQCPPARAAGIKNKNRCF

SEQ ID NO: 205944 - protein, 156 aa, Triticum aestivum
  unsure (1)..(156): unsure at all Xaa locations
  Clone ID: PAT_TA_100362.pep
APGNLRSERSEGSLVLLLKMQIFVKTLTGKTITLEVESSDTIDNVKAKXQDKEGIPPDQQRLIFAGKQLEDGRTLADYNIQKESTLHLVLXLRGGMQXFVKTLTGKTITLEVESSDTNXNVKGKIQGKGRXSPPDQQXRLXFAGEXNXEGWAATSG

SEQ ID NO: 205945 - protein, 180 aa, Triticum aestivum
  unsure (1)..(180): unsure at all Xaa locations
  Clone ID: PAT_TA_100363.pep
PQGPVNKTLAGPPXGEGTNXXXPPLPKILKPGWXGXAXXPXAAPMEAPXXTSFLRRLIRAXPXRRSPPCQICAXATSAARPAAKHLRAAVAPSPRIHIRAXPPGPRPXLRAPPRRPAAPPERAQQLRLXPRPPARASHLWTEGERGPAAAEPRGLCPATAAGGGEERRGWWVGCCWRRLG

SEQ ID NO: 205946 - protein, 37 aa, Triticum aestivum
  unsure (1)..(37): unsure at all Xaa locations
  Clone ID: PAT_TA_100364.pep
RTSLEFFFFFFFFFFFFFFFFFFFFFXRSTAFLGKTC

SEQ ID NO: 205947 - protein, 195 aa, Triticum aestivum
  unsure (1)..(195): unsure at all Xaa locations
  Clone ID: PAT_TA_100365.pep
LXQXWXSTADXXLEPRTMXSAVASAFLKSVMXRXFHVLXKEYNKQKGLRQDTLSIQAGRPHDRRRHGRTASKPLXSWGKRRXRPSPXLYKRRRCSXWXXRXSNLLESDXNRXNGPQPGKAPAXWXAAGXXGERNRQLYSAXGPPGRSPQXKLKVFFKTXXGGFALKDXXNSKGXXQSWGQXNAFFRESPXKTAXQ

SEQ ID NO: 205948 - protein, 129 aa, Triticum aestivum
  unsure (1)..(129): unsure at all Xaa locations
  Clone ID: PAT_TA_100366.pep
MSGRGKGGKGLGKGGAKRHRKVLRDNIQGITKPAIRRLARRGGVKRISGLIYEETRGVLKIFLENVIRDAVTYTEARPAARTFTAXDVVYALKRXGRNLYGFGGVLANVRLSLPPANSAKLDGNSFFFA

SEQ ID NO: 205949 - protein, 146 aa, Triticum aestivum
  unsure (1)..(146): unsure at all Xaa locations
  Clone ID: PAT_TA_100367.pep
SLTPTSEASYSFGAATAPSLRRRPPLQETEPIALRIYRPRTSEPSPSHEGSSDGPLQEDANPPDPALFPLRACCRSRPGSLDQPNPLPLRPSSFPARRSCSLLPVFVLQRDSLETLELKGVDMGCGRAQXRGCWEPNKVXGGKRWS

SEQ ID NO: 205950 - protein, 62 aa, Triticum aestivum
  unsure (1)..(62): unsure at all Xaa locations
  Clone ID: PAT_TA_100368.pep
DLPXKHFSLKGTFFPXNPLGTLLIFXIXTLPNAHQXRFXPEVFGMCVIPDHYQQIRRNPCGF

SEQ ID NO: 205951 - protein, 72 aa, Triticum aestivum
  unsure (1)..(72): unsure at all Xaa locations
  Clone ID: PAT_TA_100369.pep
ERERTXLEFFFFFFFSSKFTYSYLTVLXXXQLFXXNQYIXXLFXXNXHISHLFNPXPTHLTTGLXXXNTSHR

SEQ ID NO: 205952 - protein, 114 aa, Triticum aestivum
  Clone ID: PAT_TA_100370.pep
VIRGIVDLCLSGASAIVDHENQMYNKEKTKISHWKFKGTPLEFDFYDQSEINIEFLLLSYAASQVKRLFPWDPGEHDHLVKITAMILVGTAGQVISELISSKVITQMARRSTRE

SEQ ID NO: 205953 - protein, 135 aa, Triticum aestivum
  unsure (1)..(135): unsure at all Xaa locations
  Clone ID: PAT_TA_100371.pep
HIIEPKNNIYTYXDLQIANINTNHILNTQYAKNSKEQRMAHSIFLIYYFLDFNTKDKISCYFLHGHFCKKMVFLYRINSKCFRTLGRHCKMKIQRVRIKPKDKKMQKHKSFGCPKTMVASSATRNRSSLLKNSGI

SEQ ID NO: 205954 - protein, 91 aa, Triticum aestivum
  unsure (1)..(91): unsure at all Xaa locations
  Clone ID: PAT_TA_100372.pep
XRKGTXNIVXTIEEEEQDERSCARPHDHGTRRSERRVNAASLSQPXLKRPXXPPXYPQEYISXCWLCAWRSEDLSAGCANTNRGGRGRRRS

SEQ ID NO: 205955 - protein, 190 aa, Triticum aestivum
  unsure (1)..(190): unsure at all Xaa locations
  Clone ID: PAT_TA_100373.pep
LLXKKKXXSXQEKADQLGXXHWTXNKSXXXXGFXXNRXNPCNNXRWMXTXSXTQXXQAPXXLXDQXPKLNPXSLPTPIKPCXXXVLXRLARXYXNRLXVEMIXPGEQGRPXXVLSXXGGRVXRDDGGGERGRRVQHHGLRPRRRLHGVACAGAGAGGWGRSXPRGHLLEGSCCCFALALGIGMVVVRAFA

SEQ ID NO: 205956 - protein, 140 aa, Triticum aestivum
  Clone ID: PAT_TA_100374.pep
MPPPLRLLALLLLLHLPFALSSRHHHKAPAPPPRKAPPPAANYAAPLPVLLACNATRFRPACVATLSAANVTAASSPSDLLGGNALRRSGARLPAGAFPNGAASVLGFQRKRPAGQTNWLKRALLPSPKGGRPGLWPWGV

SEQ ID NO: 205957 - protein, 139 aa, Triticum aestivum
  Clone ID: PAT_TA_100375.pep
SGPSSAPRPSSTTGQASASFSPSTTTRLRGFWSPSGRCDDRACTAVTRRRPSVLDQYVLPRLQGQILVVLVPTQRHPLLGGQRAVGHLTLSVMIITMVGSSNILVTVLDMNSTPSQAAMCRRPACNNLASPTRLQYNTG

SEQ ID NO: 205958 - protein, 92 aa, Triticum aestivum
  unsure (1)..(92): unsure at all Xaa locations
  Clone ID: PAT_TA_100376.pep
DAYAIVVKRSFRTAGAVIILAXGDWVTGTLIFSAACGSAAITXXLSNDFRACSVNPCASFMNATAMAFLSWLARXXAFIGNLWTAVPRIQKS

SEQ ID NO: 205959 - protein, 71 aa, Triticum aestivum
  unsure (1)..(71): unsure at all Xaa locations
  Clone ID: PAT_TA_100377.pep
MSRCIHFSDKYFRTDGVLNTLFGCVCYVLXRTKLSGQSVECLXGYSDEHKGYQCWDLVSHRMHISRDVTSH

SEQ ID NO: 205960 - protein, 126 aa, Triticum aestivum
  unsure (1)..(126): unsure at all Xaa locations
  Clone ID: PAT_TA_100378.pep
AQQAGWHENVNTRQGRREPSDGRLMHGNARVRKKNSETEIRFGLAHPATISLARCPPPSSQLASPPYPTSPASPPPAAPMLHPVHRLPATPSRPXVHPHVXPAPPSLRXXRVAXXXXXXPXXCXXX

SEQ ID NO: 205961 - protein, 176 aa, Triticum aestivum
  Clone ID: PAT_TA_100379.pep
RSELQGCLESNKKLTREIADLHKELSTIKMTKREECQFEYGSNARAEVEDCCDEAFMDNTEDILNLQLELDILKAILAEERTVRGEVEERTTTLSDELKAANLRILQACKQSDAIESELNDARSVIEALESQQILLINELDELKKNNQKSFEILKRRGREISRLNTEIDNHRRQGG

SEQ ID NO: 205962 - protein, 181 aa, Triticum aestivum
  unsure (1)..(181): unsure at all Xaa locations
  Clone ID: PAT_TA_100380.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKXINDNFGIIXXLMTTVX

SEQ ID NO: 205963 - protein, 154 aa, Triticum aestivum
  unsure (1)..(154): unsure at all Xaa locations
  Clone ID: PAT_TA_100381.pep
MAPAVGIKRAAAAQAVTVQAPPPPPDARLVREAVRTSTIAEAVAPAALQAPAPALEGFLCLEEVEGRRWKYVVDAAPGKGRGRGRGGSAVPLGASVRAVPLQSPXXPAEEIMAFVRYVVPEGFPDSVTPSYVPYMTWRALKHFFGGAMGCVHNK

SEQ ID NO: 205964 - protein, 86 aa, Triticum aestivum
  Clone ID: PAT_TA_100382.pep
HEGITQQIGKILLTSSSSSRSTWPPRSIPHLLPITFPLHLQVCHYGIRRMSPLSPSHTRFGASPFYPSDGSAARVGSNTRRTCSYF

SEQ ID NO: 205965 - protein, 85 aa, Triticum aestivum
  unsure (1)..(85): unsure at all Xaa locations
  Clone ID: PAT_TA_100383.pep
LLAXXXGXLXXSAHAHPYPGDDGIRVGGFDPGMQPPLCPSALAHSFTIGENDGAVSPSTVEXXKAFMVTGLPAPXPPLPVPPTGX

SEQ ID NO: 205966 - protein, 60 aa, Triticum aestivum
  unsure (1)..(60): unsure at all Xaa locations
  Clone ID: PAT_TA_100384.pep
ALAPXFFVKKLNLPLESPFWVLKIQTPPPKVLRGPGSKLPNKGRGFPXXIKYPSKAPFGW

SEQ ID NO: 205967 - protein, 122 aa, Triticum aestivum
  Clone ID: PAT_TA_100385.pep
MAGLSVLLETQESNSIKAKIISKATLHSPKISSSPWSPAARPTASTGSFLQRCLLCHKDLAENNDIYMYRGDKAFCSVECRCRQIFIDEDAGSSFCAKGASTAAVRSGRRATATGGGVSFAY

SEQ ID NO: 205968 - protein, 114 aa, Triticum aestivum
  Clone ID: PAT_TA_100386.pep
ALNTCSWVKCLLYIVFGATVILCPFACTIHMQCLRQMSQSGCQCIVQRIKRIRKVHSTTDKTNTKHYASWRCSILEVALPASPNRDAPPAVDALRAAAAACSDGLLCLLPLKLR

SEQ ID NO: 205969 - protein, 138 aa, Triticum aestivum
  Clone ID: PAT_TA_100387.pep
HSLSTCESIVESDKRKWIRLTGQDNYSLNSQLYNWTLRNDCVVNGTAPDCSALIDLILCEAKLWMLAGAKPTLPCSAHPLYLESGSNSLEVLGLLLSFASPRLPFCVLLLVSICKPYDAFFYKMKLSHMCAREKKTLV

SEQ ID NO: 205970 - protein, 124 aa, Triticum aestivum
  unsure (1)..(124): unsure at all Xaa locations
  Clone ID: PAT_TA_100388.pep
LVPNSARGLVPNSARGCPPPSATSPPXPTRTTRLPPTPPPQARPGLARAGRPPARSPYTASRAATTPPPVRRLPHQPRPSKQLPSTPAPAAPPRLPVRHSTPSPATPCNSSRCSADLLPLHFLP

SEQ ID NO: 205971 - protein, 89 aa, Triticum aestivum
  Clone ID: PAT_TA_100389.pep
GFFLWPLRGKLFFARAPPPEKEGTPVQEKKKKKPPKMGPGYFISPILGAINPPVLNVKSGQFPVLNAPFFVQWAICKKFFCCSKIKNLP

SEQ ID NO: 205972 - protein, 201 aa, Triticum aestivum
  unsure (1)..(201): unsure at all Xaa locations
  Clone ID: PAT_TA_100390.pep
HEGIKQQQIQKQVWDIVKDVPNNILKHIVLENNEGKPVTNSRDTQDINLEQGIQMLKIFKEHVSKTSILEDFAFYENRQKLMQEKRIKQQQIQKQVWDSRAPNPVAGEKQQELANGKPKVSLPNGVNGEKQQDAVNGKPKSPVANGVNGDAKVPAEKAAAAAPPAVTYAAXVAQTAAAEKKPVATEXKPVVANGAVKGVAA

SEQ ID NO: 205973 - protein, 169 aa, Triticum aestivum
  unsure (1)..(169): unsure at all Xaa locations
  Clone ID: PAT_TA_100391.pep
GPKDXXLIEGCTEFTEFMNMHKTRPFIETRRLYGEKCGLDMKFLVLWNAVQAKVDVEILHAPVNGLNLNLYAKTSGFRDVIRLLSGVTESGCRMSSVVGVMRYSYLILCIEGSPKDGGFSQELPCCMWEGRFGSGYHGTVHEMVYLHDSTKISVKVTWKAVESLHDLEH

SEQ ID NO: 205974 - protein, 87 aa, Triticum aestivum
  unsure (1)..(87): unsure at all Xaa locations
  Clone ID: PAT_TA_100392.pep
HEGSHQPLPPSHPSSLVPISSPPPPPPPRPRHPPDPXPPSHSPRPNPPTRXAPTHPPTRAPLSLVSPSPPHHSSLPPPPPPTAPDPA

SEQ ID NO: 205975 - protein, 198 aa, Triticum aestivum
  unsure (1)..(198): unsure at all Xaa locations
  Clone ID: PAT_TA_100393.pep
HEARASSILVNSMDVDLTMDVVALTTAYQMWEHLRHRYESTGDAMYLSVVRQEQQLQQGDATVDDFYKEMSAVWRQLDSLGADVCRRCQCCVRQQAKLEVRRLYDFLTRLRPEFEQSRAQLLARHPRLSTLXXLAEVRSEEVRLRSTGLLPSSSAVLAARVPPPLPGVPSSTQVAATSTSAFCNYCKQDGHMIMECIK

SEQ ID NO: 205976 - protein, 126 aa, Triticum aestivum
  unsure (1)..(126): unsure at all Xaa locations
  Clone ID: PAT_TA_100394.pep
MAAAAKLTRSFSRQLSSGAARVWRQLSLEPHTPRRGAAAATGAVAAAGPTRFGLARQSSLDPTPAPDDGAVLAMPENLDATMRLLYAACQGDAAGVEELLGEGVDVDSIDFDXXTALHIAACXXRG

SEQ ID NO: 205977 - protein, 94 aa, Triticum aestivum
  unsure (1)..(94): unsure at all Xaa locations
  Clone ID: PAT_TA_100395.pep
QEEXXVGDHYESECFXYLCEGMNKLSVFEAEEKKKVGLPAFEGRHTRLVCNPHHEIVDRKEVDNAPAEHGALFRGLPAPEGKHPRFLPDDEEEE

SEQ ID NO: 205978 - protein, 210 aa, Triticum aestivum
  unsure (1)..(210): unsure at all Xaa locations
  Clone ID: PAT_TA_100396.pep
ARGLGFFALQQPREEPTEGSSTTSMPLFTPVPCSPHRFLAIPDQPRGSQAVVLASHRGLLVVRFVPLDAISMFEKIMILAVCDPIAGTSRPLPPLKCNRSFRIEGCTLLTGADCRPTKRRGASPSVYSSFKVLIISYDGRYNLHVSASNELSWRTSRNWFEPVEYAGRVVPQQINIVVCRGMAHWLFKYSSDFYTLNVCAXXMQMSIXXL

SEQ ID NO: 205979 - protein, 156 aa, Triticum aestivum
  unsure (1)..(156): unsure at all Xaa locations
  Clone ID: PAT_TA_100397.pep
MDPAQEELERRSRYLSSLVRRTRLDDPPQPEPEPEPKVERKPAAEPSGGEGKAAKPETKEREAAKVKGDAASGEGRAVRVRAADMPLALQRRAIWIAREVVLSTPRLESKRLALALKKEFDTTYGPAWHCIVGTSFGSYVTHSXXXXLYFSVDXXY

SEQ ID NO: 205980 - protein, 127 aa, Triticum aestivum
  unsure (1)..(127): unsure at all Xaa locations
  Clone ID: PAT_TA_100398.pep
EGSLYGERGTGAPRPPEPPRRHGGLELGEFKYSGLPLFQFLFRGGFLIVSRPANLRRGGGWVXVFSLCPCFGTGWVSGLPFSFYPRFLGFRASFGNPVPRTCGFVVRKVLLSWALAXIFSSXKLFCF

SEQ ID NO: 205981 - protein, 160 aa, Triticum aestivum
  unsure (1)..(160): unsure at all Xaa locations
  Clone ID: PAT_TA_100399.pep
MGLGGMRGGIGGGGAGSGERWRWILFLSLVSVSFLLSFLFLFLSAYSSPTRLRLPGLTTARAAAGVRRGPDALPCLAYLLIGGRGDGHRLLRLLLAVYHPRNRYILHLSADASHEERRDLAXXXXAAAAPAAVSFDNVALVGTPTAGXXXXXXXLAGTLR

SEQ ID NO: 205982 - protein, 168 aa, Triticum aestivum
  unsure (1)..(168): unsure at all Xaa locations
  Clone ID: PAT_TA_100400.pep
MPPPPLARAARRGLLLLLVLHCCWGTLLSTASAAHVHAAGDGVIISQADYQGLQAIKHDLSDPYGFLRSWNDTGIGACSGHWAGIKCVNGSVVAITLPWRGLGGRLSNRVGQLTALRRLSIHDNAIAGAIPAALGFLPDLRGLYLFNNRFSGAVPXXXXRCVALQSLX

SEQ ID NO: 205983 - protein, 113 aa, Triticum aestivum
  unsure (1)..(113): unsure at all Xaa locations
  Clone ID: PAT_TA_100401.pep
RFVYFVLSCVATYKFEANDDTVQTHPFLILSCHYEGLCICFCAAYKFEENDFMVQRDSLIIFELPACFSHVIPEPXXDSGQMTELVRNINSSSLDKHSIPHXXVPFACLHXXN

SEQ ID NO: 205984 - protein, 88 aa, Triticum aestivum
  Clone ID: PAT_TA_100402.pep
GGGIFDTYRTAWPRRRRLSSRRRARGPLLSAALLLVKTQPPFAHSFRPYHAMPCHRQQEERYLFLLTRLLLLLVSWSGLRLALSFSSC

SEQ ID NO: 205985 - protein, 79 aa, Triticum aestivum
  Clone ID: PAT_TA_100403.pep
IKKQVLVLQNILEKEPQFFILLDISKGFSSSIIIACLMKSEHCLDMIYLRSPTTHCICTMLMVSEMACPANLVLQRVRG

SEQ ID NO: 205986 - protein, 162 aa, Triticum aestivum
  unsure (1)..(162): unsure at all Xaa locations
  Clone ID: PAT_TA_100404.pep
MAPAMRPEQEASCKATEDHRSEFDAAKPPPFRIGDVRAAVPAHCWRKSPLRSLSYVARDVAVVAALAAAAWRADSWALWPLYWAVQGTMFWALFVLGHDCGHGSFSDSGTLNSVVGHLLHTFILVPYNGWRISHRTHHQNHGHIXXXESWHPITXXXYQXLX

SEQ ID NO: 205987 - protein, 96 aa, Triticum aestivum
  Clone ID: PAT_TA_100405.pep
FFFWKTTDAGADFTSPQHLCVLCCEYIFLFTSSQNTRPSFNKMSKNKIVTEKTRPKNEVRTSSLLCPARSFFTAHVISSCNLTSGKSPTIYLQCGQ

SEQ ID NO: 205988 - protein, 200 aa, Triticum aestivum
  unsure (1)..(200): unsure at all Xaa locations
  Clone ID: PAT_TA_100406.pep
HEAQAVVRGFLGDGDNTILSTAVLNFYASCREPDLARRVFDRMARRNAVTWNALIKGYAQAGRRDEALALFRCMRRQGGVAPDKYTFPALLSGIGRNHGGGCVQELGGAVHAQVVKSGLDKDPFVGASLVSMYAATGALEDVKVVFDDVDTLDPVVWSSMISAYINCKXXEAALLTFYKMLCQDIKPXQFVYSSLFAICG

SEQ ID NO: 205989 - protein, 207 aa, Triticum aestivum
  Clone ID: PAT_TA_100407.pep
ARGRLGQPSGGDGGGPDLISALPDDLLLLVLARLPCAGAAARTGILSRRWRDLWPHLRRIVFRDIAFDSIEPALGRISPVVSLLEIHARASTRRWSTDRVDTSRVNSLLRAAARLEPEELVFGLSSALIGDSPVVDLPCFNRATSIKLGLFSAIRVPAGVEVEFAALETLYLACRIDTLDSLLSSCPRLRTLYLSSTELKTSTRRHC

SEQ ID NO: 205990 - protein, 62 aa, Triticum aestivum
  unsure (1)..(62): unsure at all Xaa locations
  Clone ID: PAT_TA_100408.pep
PAPKPIWTTGPRRAPKKARARIPPQRNPQEEAKEELYPLVPXAEAPPKGFKGLGPKVVEEKD

SEQ ID NO: 205991 - protein, 205 aa, Triticum aestivum
  unsure (1)..(205): unsure at all Xaa locations
  Clone ID: PAT_TA_100409.pep
KISLPEDLVLHENLSELADILSEDDTILSTSISFISRNCHSVETRDEPAVVSVDSSSLFEHRKRHGIYYLPTGKAEDDANSYPRANDPLLSAENASAMEDKSETVQPVSAGKKLKAMRSRPKVVKLDGEDFLSSMMTSANILKAADKSEVMGKKMDTGESSSQWIQNIYADTGSLSTSSSRTSKQHDLTKEKSTIPPDSDXXXPX

SEQ ID NO: 205992 - protein, 43 aa, Triticum aestivum
  Clone ID: PAT_TA_100410.pep
ARGERERELVSSLFGFISHVLCVVSKLGRLGDRPIFLVYHVDN

SEQ ID NO: 205993 - protein, 172 aa, Triticum aestivum
  unsure (1)..(172): unsure at all Xaa locations
  Clone ID: PAT_TA_100411.pep
MAARMTRRPAVFLLLAAALLAVAVQPAAATLHPVDYLALQAVRRALSDLPGSGFFASWDFTGDPCGFAGVSCSGDGRVVTLALGDPRAGAPGLSGAFPSAALARLSALSSLSLVPGRVSGGLSSAVAALPSLRFLALSGNLISGNLPGAFSPALRXXDLSKNSFSGKIPSSX

SEQ ID NO: 205994 - protein, 134 aa, Triticum aestivum
  unsure (1)..(134): unsure at all Xaa locations
  Clone ID: PAT_TA_100412.pep
NVKGLKDDLALNLFKKINLKAEKLSQSFPEVVEPILKHIMSKCGGLPEVIVAAGKIAIPYSERISSLELFNAELMEILENSLSFPRLKGIFCWMQSYFDACSDELKPCIFYMSVFPMDQSIRQRRLLRRWIAEX

SEQ ID NO: 205995 - protein, 178 aa, Triticum aestivum
  unsure (1)..(178): unsure at all Xaa locations
  Clone ID: PAT_TA_100413.pep
MASRRQRRRPDQPGASTSPCLPPPPAALRAHWSPPRAHPGPEPPPPSRPSSPCGRAPDPACPRRLADPPSALVGXRAPPIVGDLQQASAPLPPSFPRSLPHALSAFLAGTLHGAPSSDLRPLPLSIVIPRRERGCPLGSSRPGLFLVGSGGSHPDPLAGARPRPPFASASTSCRRPAS

SEQ ID NO: 205996 - protein, 90 aa, Triticum aestivum
  unsure (1)..(90): unsure at all Xaa locations
  Clone ID: PAT_TA_100414.pep
GAXGPAPPGEXXAXPHFPGEWXLGQFCSPPPGVRAHEQILLGTPPPSCGPLREKRSFKKTXXGFQFRPGFGFSWEKLKRSFFGQXSRLNL

SEQ ID NO: 205997 - protein, 95 aa, Triticum aestivum
  Clone ID: PAT_TA_100415.pep
HSFEIHAGRPFLPMRDHYVKYATYKDNIKPFESRGPTSLEHVPTPPLAGCNLFAARPCPLPVLLACTSSEDSINTCHSIIQNPMAEGSGVKQHVA

SEQ ID NO: 205998 - protein, 167 aa, Triticum aestivum
  unsure (1)..(167): unsure at all Xaa locations
  Clone ID: PAT_TA_100416.pep
MQIFVKTLTGXTITLEVESSDTIDNXXXXIQDKEGIPPDQQRLIFAGKQLEDGRTLADYNIQKESTLHLVLRLRXXMQIFVKTLTGKTITLEXXSSDTIDNVKXKIQDKXXXPPDQQRLIFAGKQLEDXXTLADYNIXXXXTLHLVLRLRXXXQXFVKTLTXXXXTX

SEQ ID NO: 205999 - protein, 184 aa, Triticum aestivum
  unsure (1)..(184): unsure at all Xaa locations
  Clone ID: PAT_TA_100417.pep
CPIQRNPRPSSVRNTPSPHWQAAAAPVLLKIHSTTSPRASSGFVQTPHVDTIRSIVQPAIHPLPSSISALISTPPPSPSPTXPATPTAAPTATAQLSPARPPPDVPRTESXAAPSMAAEEPKKVEVEAAPEPXXVXPRSPXPPPRTSPRRRPSSRRPSRPPXXRSPPPMTXXPSSSSQMNLLLQ

SEQ ID NO: 206000 - protein, 206 aa, Triticum aestivum
  unsure (1)..(206): unsure at all Xaa locations
  Clone ID: PAT_TA_100418.pep
TRSATSKSSVTSSSKSKGTRIGDLAGTSKAIQQSLALPANGSVRAPAKAELSKLTLSGSFKILSREQNCTAQTPKDSPGNPASPPARVASMEPHKKPPLSQKPKVSTHDLPLVQGSSCGVSKSRLKFFQSLRTKSNGSSSAVESGCEPSPSSGVDAKHDSCLNSGMKCMGNGKCFCEEANSXXXSQRHHSXXEXKSLQSVDMAAGG

SEQ ID NO: 206001 - protein, 60 aa, Triticum aestivum
  unsure (1)..(60): unsure at all Xaa locations
  Clone ID: PAT_TA_100419.pep
AILLWFCKKDQISLPRKYHDLCRNCWHVSLYAXXTMTLXXXXXSTQANXXXXESAXXXXX

SEQ ID NO: 206002 - protein, 205 aa, Triticum aestivum
  unsure (1)..(205): unsure at all Xaa locations
  Clone ID: PAT_TA_100420.pep
HEGEAERRIRAGVTPARTSAAAAGSPWAASPLPDGIAPSPATSASTPRRFFRRPFPPPSPAKHIKASLARRLGHRSPAATSAQAPPAKPPQEAPIPEQGAGGGGGEEELDKSFGYDRHFAVKYELGKEVGRGHFGHTCLARARKGDMRGQVLAVXXISKAKMTTAISIEDVRTEVKILXXLSGHSNLVKXXDACXXALNVYIIME

SEQ ID NO: 206003 - protein, 127 aa, Triticum aestivum
  Clone ID: PAT_TA_100421.pep
HEETPSDTLEDFVVRLKKMVEENMYATPTCLAIQKLTCQMVTEFMKHDRNIQVIDKHNIVGTLLKASKTMAELESSMLFAAVIRDRYGVPLKPLSSVLSKNTEDLLTQRKQALGIYTVPASVPIPLP

SEQ ID NO: 206004 - protein, 76 aa, Triticum aestivum
  Clone ID: PAT_TA_100422.pep
TRLASNGWLAAQGTHPKISSGPLPGSSWQTKKGNKRPPHAHGPQGRICHDSNCCSVPDISADAPNPPSLLPSRPRA

SEQ ID NO: 206005 - protein, 147 aa, Triticum aestivum
  unsure (1)..(147): unsure at all Xaa locations
  Clone ID: PAT_TA_100423.pep
QHTGTXXLKHIHEXXVIREPRQXQSDYACGAXXAQNKLQPGRIDLPKHANMEFDKRVLFGLHAQGNYTFFSTTYKFQQRTNISFRLKARNLFDKLNLPSSCLLVHPLCLFWLVVMCPQLNQWSELCVCVGPLPPVALCMCVVRMLPC

SEQ ID NO: 206006 - protein, 94 aa, Triticum aestivum
  unsure (1)..(94): unsure at all Xaa locations
  Clone ID: PAT_TA_100424.pep
NKNYASTGPLQATLIHFETPKMKSNYNLSNFLNQQKPICNSKLKNLKNPGVLVGLPPVLAGRLFXRQQRMTTLKLLGKHKTQSGYMKSLSILHE

SEQ ID NO: 206007 - protein, 93 aa, Triticum aestivum
  unsure (1)..(93): unsure at all Xaa locations
  Clone ID: PAT_TA_100425.pep
MSLTAAAVAVGPPAFAVGAAPAAEMEMGPELAPPEPSRGVGGVGEDGGVEPERRASRFRRICVYCGSAKGRKASYXXAXVELGKEMVERGXXL

SEQ ID NO: 206008 - protein, 204 aa, Triticum aestivum
  unsure (1)..(204): unsure at all Xaa locations
  Clone ID: PAT_TA_100426.pep
ADTHSSPQSAPNFCIHLPPFSFLRTLNSRCARLPHLRPRPCMRSSSASITSQLLLSLFLPPSSLQLSFSVHHSSLALAPASFSPTFYPCSVIFSPRAFLGSPRNFHRTNHRPPAPYLSFSLSPHRNPEFSSRRHRPSHPSTALHFPSDQIQSSQPHCCGPASLLHPINFLFXXAPFPAPPCPASGRLXXTVRWSLXXDCXXPXX

SEQ ID NO: 206009 - protein, 135 aa, Triticum aestivum
  unsure (1)..(135): unsure at all Xaa locations
  Clone ID: PAT_TA_100427.pep
GXXXRARAVHXXXXRRLRGGGAHPAGVQEAEADDPGITKSSKNFSIINGQLMSESRRCVFFWIAYARLAGDTYSLRPEILVLKIKKMNVSITKISLDTSIFRTSISGRREYTRSPSCLPASQWSVEVDRAGHRLV

SEQ ID NO: 206010 - protein, 201 aa, Triticum aestivum
  unsure (1)..(201): unsure at all Xaa locations
  Clone ID: PAT_TA_100428.pep
TRGFLFLPSSVSWPRYRSDQGEPPRRAPDGDGAARREAPRRRRGADAPPRFSRGRRGLPRPAGQPAREGVPDGQRRQPLRQGRGPAPRGRGRGRPPPSAGGRGRRRLRPAPARPRRRNESGGAAGRPDGPHGPRRAEHRGRHGHRLRRRRRLLEPFGKGSGRQXXXRRRRRRRARRAXXXQRSAGSSRGGCAGTGPWWPRR

SEQ ID NO: 206011 - protein, 98 aa, Triticum aestivum
  Clone ID: PAT_TA_100429.pep
ERSVETTVAINQADLHVHAFVKTTASPAPCVRAGVTCYLRVLSARCELIMRLLIHPVPNCDDACVSFPWLDGSSAYWLALPCLAYTKIIYSNHAYCKN

SEQ ID NO: 206012 - protein, 132 aa, Triticum aestivum
  unsure (1)..(132): unsure at all Xaa locations
  Clone ID: PAT_TA_100430.pep
HTPXLLNSFKYQTGWRAKLLFCTAXRLTLTSFVFDSLATYFMSVFQLPKKVXEALDAIRRAFFWTVEETCTGAKCFIVXRDVCKPKKYGGLGIKDLQTQNNYLLMKFVLQCLASPTPLPWVSSWKWFVLLCI

SEQ ID NO: 206013 - protein, 63 aa, Triticum aestivum
  Clone ID: PAT_TA_100431.pep
YDYNEFSPRIKGSQTAEKNLNGSSTLFPMLLIFLVQGVKWRPCATTILAVMSLSGPPKKKTRD

SEQ ID NO: 206014 - protein, 72 aa, Triticum aestivum
  unsure (1)..(72): unsure at all Xaa locations
  Clone ID: PAT_TA_100432.pep
FFFFLEEDVGVWGGGLFPSFVPKYDVYTKGVWYRSSVLPTXXVERVLFPLLFVGGIFYNERKKVAPFFGVTP

SEQ ID NO: 206015 - protein, 68 aa, Triticum aestivum
  Clone ID: PAT_TA_100433.pep
FRFQDCNRASEILISFFLVMQQTNTSDMLDIAVDYIKVLQDQIEVCSVLTPVLYISHLQFQEALLKTH

SEQ ID NO: 206016 - protein, 123 aa, Triticum aestivum
  Clone ID: PAT_TA_100434.pep
TRRYSRIHPSSSIYIYHINIILSAFVQANKKMSTSQILVVALALLLLFLGGMPAKVSAGLAGTACDSYVLNPGEQCDPAKCQKDCEKTVHGGVGSCFNPPPPYYNRRCACQYCPPTLPRKLKN

SEQ ID NO: 206017 - protein, 159 aa, Triticum aestivum
  unsure (1)..(159): unsure at all Xaa locations
  Clone ID: PAT_TA_100435.pep
GICASSVRKINPYNQTNKRPRETASTQKKKKNGRGGPVPKWGYRERAHTRPLAATSQLGDRENPAANQPNRPAPHPPLANXRKSQQGRTYRTAQQXGRLKGQXHPPCIXXXSPGGEVDTHSETGXLASARSPGPFPFLPSFLGXLARFTPKGAPGLASR

SEQ ID NO: 206018 - protein, 108 aa, Triticum aestivum
  unsure (1)..(108): unsure at all Xaa locations
  Clone ID: PAT_TA_100436.pep
MAGPKFGSFKSENKGDSAASAAGAAAQRDPYEVLGVGRNATEQEIKSAFRRMALKYHPDKNADDPVASEKFQEATFSYNILSDXEKRRQYDSSGXXXXEADSHELELX

SEQ ID NO: 206019 - protein, 128 aa, Triticum aestivum
  unsure (1)..(128): unsure at all Xaa locations
  Clone ID: PAT_TA_100437.pep
RXXPDQGXXPTXNQEGTVKKGPPQKNRSGHKKNHPPXRLKPLPIKGEKNKREFKEWGFPPPGQKKKAPPPVKQPSGVKAPQKNPSGTKKINCPGKEGRKKIEPLKGFXLWGPLPKKKKKKKPKKKKKK

SEQ ID NO: 206020 - protein, 109 aa, Triticum aestivum
  Clone ID: PAT_TA_100438.pep
VISTLMVLARRMLFARRFDASTKRSDGHDGFLGDDFQDEDDHVSPVRRSSTGRITLMDLFSMTTLICISCLLYTTTTCSVNRCTTNKGVRSRENTMPKGQQGLPKLVVH

SEQ ID NO: 206021 - protein, 94 aa, Triticum aestivum
  unsure (1)..(94): unsure at all Xaa locations
  Clone ID: PAT_TA_100439.pep
NKNYASTGRLQATLIHSETPKMKSDYNISNFLNQQKPICNSKLKNLKNPGVLVGLPPVLAGRLVXRQQRVTTLKLLGKHKAQSGYMTSPSILHE

SEQ ID NO: 206022 - protein, 192 aa, Triticum aestivum
  unsure (1)..(192): unsure at all Xaa locations
  Clone ID: PAT_TA_100440.pep
MAPPFVFPASLRDLERDDDGDDEGEPSLRPHAPVAVTALRAADLEEFVKGTSFDLSDKELFCIEEQDVFNSIYSLVRDFTCLPPGLKFNLVEALRSNLSVLLPNIDSLSRASMSSPSDGIPITDRIASHRNALKIYSFFLLSIVLAXXSSADSGTGAKVTAHGRKKNPVYAWNWEAQXXRIMNLXANSLEVD

SEQ ID NO: 206023 - protein, 175 aa, Triticum aestivum
  unsure (1)..(175): unsure at all Xaa locations
  Clone ID: PAT_TA_100441.pep
MAETEYRCFVGGLAWATDDHNLQQAFSQYGEILDAKVTNQPTPRSVGISRPICCPCGRSVPILGLCGGSDRIWWXXVFCACVQIINDRETGRSRGFGFVTFGSEESMRQAIEEMNGKELDGRNITVNEAQXRRSGGGGGGGGYGGQRGGSGGXXGGGGGXXGXXGGGYGXXXGGG

SEQ ID NO: 206024 - protein, 134 aa, Triticum aestivum
  Clone ID: PAT_TA_100442.pep
HEGHHPKHQRQQLNLVDWAKPYLADRRKLPRLVDPRLEGQYPSKAALRAAQLTLSCLAGEPKNRPSMAEVVTVLEEIERIRPRHRRASPEEDRESSSSASSRSAHHGRRHQQQSPRPKSGSDGARSGQPSPRVR

SEQ ID NO: 206025 - protein, 100 aa, Triticum aestivum
  unsure (1)..(100): unsure at all Xaa locations
  Clone ID: PAT_TA_100443.pep
MAAILRLIPSFNRLLVEKVVQPKKTAGCFLLPDTSKQXNSGKVXXAGPGXPDKERKXIPVALXKESDXXLLPEXGGLXXKLAPEXXYLLYTXXDILRSLH

SEQ ID NO: 206026 - protein, 119 aa, Triticum aestivum
  Clone ID: PAT_TA_100444.pep
MDPVEIAQGVDARPECSLTPTDPVSKVLNDDDLLIEILLRLTPKPSSLRNASLVYKRWRRILFDPQFLGRFRKHHWKLLGFFYQQFNEAPNFTPISDQLDLIAAALPENLFHPYSLPWL

SEQ ID NO: 206027 - protein, 199 aa, Triticum aestivum
  unsure (1)..(199): unsure at all Xaa locations
  Clone ID: PAT_TA_100445.pep
MDPINEPLLSSPSQRNCSPSKVRLGTPTFLATLLCFCFAAFLLLNPARVHLCTNSPDPASCHAIVADAVLTSPGAHPSRPARVLRAILARSLHQHDAAAAAVAGMHGRASDPRQRAALADCVQLMELARDRLADAADHTTATPXXARTWLSAMLTDHVTCLDGLNNGPPRDAVGAQLEPLMSLASASLAVLNASCTAAD

SEQ ID NO: 206028 - protein, 103 aa, Triticum aestivum
  Clone ID: PAT_TA_100446.pep
MMGRGMADDGVSRRATFGERSGALLTEAQELAALWEADVGVLVFDGAGRQMDYCSPHTSPHEQDFRFDSKTTTVSKAFRWSLPYRRFQFGFLDQEFRIKVDTK

SEQ ID NO: 206029 - protein, 126 aa, Triticum aestivum
  unsure (1)..(126): unsure at all Xaa locations
  Clone ID: PAT_TA_100447.pep
MVSSSYSNLLDLATGAADQGPAPAALGALRRRLPSVVTTPGLMEDSPASPSTPSPAPRPRTIVVANHLPIRAHRPASPXXPWTFSWDEDSLLRHLQKSSSSPSMEFIYIGCXRXXVPVPEXXAXXX

SEQ ID NO: 206030 - protein, 103 aa, Triticum aestivum; identical to SEQ ID NO: 107316
  Clone ID: PAT_TA_100448.pep

SEQ ID NO: 206031 - protein, 170 aa, Triticum aestivum
  unsure (1)..(170): unsure at all Xaa locations
  Clone ID: PAT_TA_100449.pep
MMMPTGGDSSSPVRALRRLAGSLLAAARLRGSFSASKCKTEARMAAARMKLLRNRREAQVRKMRGDVAALLRDGREDTARIRVEHVIREQNTMAANEIVELFCELIVTRLPIIAKQKECPADLKEGICSLIFAAPXCSELPELTRMRDLFEKKYGKXXVAAAVDLRPXXX

SEQ ID NO: 206032 - protein, 199 aa, Triticum aestivum
  unsure (1)..(199): unsure at all Xaa locations
  Clone ID: PAT_TA_100450.pep
MATRPELMDDLLGEVLLRLPPDEPEHLFRAAIVCKSWLRIVCDPAFRRRYRAFHGAPPLLGLLHLLQVLQGSPAHRFASTTSMPDFPYPGSDGEGEHPTPLDCRHGRVLYHLVQGDSLVLVVSDPVTGDRRVLPAPGVDWFIWTAAVFCAADGCRHLDCQGGPFRVAFLGTGNDDRVVXXNVYSSVTGAWSAPVCLDDG

SEQ ID NO: 206033 - protein, 129 aa, Triticum aestivum
  unsure (1)..(129): unsure at all Xaa locations
  Clone ID: PAT_TA_100451.pep
MGLRRRGPPLLMLLGLAATALAASASASEGDADPLYRACFEECQRTGTLKEDSIKHCVVPTDDQPADKAWYAHEPLYLQWKEWNCNSECRYHCMMEREQEREELGXXXVKYHGKWPLKRASXXXXPXSX

SEQ ID NO: 206034 - protein, 107 aa, Triticum aestivum
  Clone ID: PAT_TA_100452.pep
CTPVAGPPSTSPRWPPPAWPTATPASAAPPPPPRPSPHPLPRRTHRFFLPTPTPSPLSPPPNRHLVPRPLLLPPAAPAAGGEGLERDATVFMGGLTTPSGASNGLRD

SEQ ID NO: 206035 - protein, 133 aa, Triticum aestivum
  unsure (1)..(133): unsure at all Xaa locations
  Clone ID: PAT_TA_100453.pep
PARFTLGFPFYFPPSLHSSPLSPPSPASRPWSHPPGAXDPRPSPSGGASPPPPPPPPPPPSGXSRASSPAPAGSSPPCSAPPPPPPRAAPAPPRRAGPPPPPRPRSAIPARASTAAPALILMILCVSRRKTIS

SEQ ID NO: 206036 - protein, 78 aa, Triticum aestivum
  Clone ID: PAT_TA_100454.pep
PDSDCITTQYTDLARSDECCFQAWHTGRCAGDVRSPKLYIQPMIHRNTSKTDNSWQNLFIPQFLTHSLQSLLQIKSNH

SEQ ID NO: 206037 - protein, 122 aa, Triticum aestivum
  Clone ID: PAT_TA_100455.pep
RHEEHLPDPDPPTHNSHCRRCPASRHRRRPPPTTRRRRPPASTRRHRAPPSMRRCQTPPSTRRRQPPTSTRRRRLPLPPAIAGSSPSTRPRGILASTSRRRSHPSTSTAAMRDASPPKDAPP

SEQ ID NO: 206038 - protein, 200 aa, Triticum aestivum
  unsure (1)..(200): unsure at all Xaa locations
  Clone ID: PAT_TA_100456.pep
MAATSRDAPVPPAMPDLVRDHLYFGDINDAIAALTASLPDGTYITHVLSVVSSASISFFTDYRPGLSLPTEEARRVVAGEDGAPSAVAPGRLMRVVERTGEGLRVTRMAVPLKDTEEENLLDHLEPCLDFIDEGRKAGNVLVHCFAGVSRSATITTAYLMRTEQKSLEEALESLXXINESVCPNDGFLDXLKLFEXXGFK

SEQ ID NO: 206039 - protein, 198 aa, Triticum aestivum
  Clone ID: PAT_TA_100457.pep
MELSSAFEERVRQMEDARNHCMTRLQAEKEILAAKSRLLAAKVAAARRLERRRLLLERRAADLASRALAARAAIDATHARRLAVARDISSTNGEIEEAQRKAEEWDRFYESKRKEMEEFRAMSQQFEAGTRQEVQRLKASVSQLQAALQELQSSGLRSDDAGIGAAEARKADLMAKKLDELAQARQFLLRQQLQAFAS

SEQ ID NO: 206040 - protein, 80 aa, Triticum aestivum
  Clone ID: PAT_TA_100458.pep
SSIEGSSAISEHLKIVEVKWGVVDDRILKVLEFLTSDPLHVFCILNKFSYMRKKLIDQAVKKEIPNYVGTVCRNTELSMA

SEQ ID NO: 206041 - protein, 147 aa, Triticum aestivum
  Clone ID: PAT_TA_100459.pep
HEAQIGQRAESPAAPTQSHYLPQRARQGPRAEDEVRRPVCPPKLGSPRAGGLVRNDRPRPAPFFLAVLALALVGWGKEGFGARWQDPARRPLRREDSGYRVLVRWTAFRVILIQGAACKCSSLTPPHPSKLAIWIWSSMKFPPLKLA

SEQ ID NO: 206042 - protein, 111 aa, Triticum aestivum
  unsure (1)..(111): unsure at all Xaa locations
  Clone ID: PAT_TA_100460.pep
MLPQQLQQQQHTPSQHPXMISFGDAQQQQQQQFEAAAALIQPQYMAPEALRYWSAALNLSPRGVLGGVVPPALYQHLLRPPGPAKLYRGVRQRHWGKWVAEIRLPRNRTRL

SEQ ID NO: 206043 - protein, 119 aa, Triticum aestivum
  unsure (1)..(119): unsure at all Xaa locations
  Clone ID: PAT_TA_100461.pep
NDQGVPLKKKKKXXRGGPVPISPFMNXIXPPPLARLLKTSELEKPCVSPLNSLXQIPLFPTWLITKKAPPIPLSKHFPTLMGKWNPPFTGPLTPGGVGVPXXVNPSICNPLTPPPFXFF

SEQ ID NO: 206044 - protein, 83 aa, Triticum aestivum
  unsure (1)..(83): unsure at all Xaa locations
  Clone ID: PAT_TA_100462.pep
XKXXKQXHPDIGISSKAMSIMNSFINDIFEKLAXXSAKLAXYNKKPPITSREIQTSVRLVLPGELAKHAVSEGTKAVPKFPSS

SEQ ID NO: 206045 - protein, 175 aa, Triticum aestivum
  unsure (1)..(175): unsure at all Xaa locations
  Clone ID: PAT_TA_100463.pep
MGGRRRRRRCRAKIEQPSADTPPKTPSSGSSGSSGLTEERVAPRKIPSSSSKPYEEEEVISAPERKRTDPCTLRLVLLNLIRTFYLEALSRLPPARLWSTHARGVLVAGHCYGPLSPVDNILVNTIWHDTAFPRRPTVDFHFGDVLEISPECIARIAHRSLXXLIACLLHLCPSL

SEQ ID NO: 206046 - protein, 122 aa, Triticum aestivum
  unsure (1)..(122): unsure at all Xaa locations
  Clone ID: PAT_TA_100464.pep
PGDPFFPLPLGRVRGFKIKKGAPWGFCLLKPFAAHFWGAPNFFYWAGHMCVLFWEGGRDFFSHFGGGGFPPFXKGKKKHGVFXNTFEPXPFGEMYIPPFPFFFYGPAPFNFFXGFFXPXFPR

SEQ ID NO: 206047 - protein, 135 aa, Triticum aestivum
  Clone ID: PAT_TA_100465.pep
PPAALHRNTRRRRRCFIAVLTPMQRCGPSMLHRITRRHRPCFVATDSTAAPRRRRQRSCTAPPCRLLGSIAARRRRGCRDEARDSNGVDAATQHDDDGGCCDAARCGPMVMSRRLQHRRLPLQSPRVGASPCSMR

SEQ ID NO: 206048 - protein, 89 aa, Triticum aestivum
  Clone ID: PAT_TA_100466.pep
LPGQFWPKFSLFPPFSQSLPRIRSTCSLPSPTRGVAATARALSCRRHPAGVIPEQRPATSQWTHASHSCCCFVVGSLKPHISVTHQRGI

SEQ ID NO: 206049 - protein, 125 aa, Triticum aestivum
  Clone ID: PAT_TA_100467.pep
SSSGQSKGKFMQQAKNILQRKSVKGNLHRTSYERKSTPRSTGTKHQTSGEPKESKGEMSVGDGGMRRRTSHRSEGADAGGGRADPETPGGGRRARVMGFLHPATLAPKPSPLQSPPVLSPFLCAP

SEQ ID NO: 206050 - protein, 55 aa, Triticum aestivum
  Clone ID: PAT_TA_100468.pep
FFFLIFGQLGGHFYLKEFHIYISNAPFSKRSNIFQTNKFGHNSYFRIFYKDWNEF

SEQ ID NO: 206051 - protein, 89 aa, Triticum aestivum
  unsure (1)..(89): unsure at all Xaa locations
  Clone ID: PAT_TA_100469.pep
MAAPAKASWMVAMSVGAVEALKDQAGLCRWNYALRSVHRTAKANVRGGASQGKKQLPASAAAVAXRRRAENSEEGLRTVMYLSCWGPNY

SEQ ID NO: 206052 - protein, 73 aa, Triticum aestivum
  unsure (1)..(73): unsure at all Xaa locations
  Clone ID: PAT_TA_100470.pep
LFSSLXSKTLPFTPPFSTIQXXNNFLSTLFFYYHLQFXXFIFLAYLSSLITFTHPPFVSHLXFPFLTLFFHFI

SEQ ID NO: 206053 - protein, 96 aa, Triticum aestivum
  unsure (1)..(96): unsure at all Xaa locations
  Clone ID: PAT_TA_100471.pep
IAGXGITXXXXAXXRKALPALPVSITLGVLFNVLTRTLLKAFVMQCSTNIXMFQHPRIIIVHNQGLLQLGRLYFGNCSSLSGHVCETVNLMAYATC

SEQ ID NO: 206054 - protein, 93 aa, Triticum aestivum
  unsure (1)..(93): unsure at all Xaa locations
  Clone ID: PAT_TA_100472.pep
PLPARDXPRXXIKTMYLAHAHAYRTXSNVRIEGFMKRSTPRSELPPHPRDLVYPFPRSFLRFFAPCEPXTLPSLLHSALXEGPTLPLLSAXXX

SEQ ID NO: 206055 - protein, 88 aa, Triticum aestivum
  Clone ID: PAT_TA_100473.pep
LPARKDACCQLQANFGMQACMCGAYQHLISWQTSTRSIPFDLFSGAATHRNAFCFSIQAKGNHHHHKNKTSQESSIRLTFSSFYYLCS

SEQ ID NO: 206056 - protein, 209 aa, Triticum aestivum
  unsure (1)..(209): unsure at all Xaa locations
  Clone ID: PAT_TA_100474.pep
ARGCISGRDLSARAGRQAGRQAGAPRNGQPPAGANAGHALRRLRRRRAPLLQRQARHAPAGPPLARLPAPSLLLQAPPPPPHPELLLGLLRLRLPGARLRLAPEPLRGDPAPLRXPPRGARPGHRRTGSGPLIFTSGSTSSSATSPLTNALPAGNICPTGRLAKPLPSFSAASTPPPPAPPRAIRHDVLGSGTGNYGHGSIMRSRSGGX

SEQ ID NO: 206057 - protein, 158 aa, Triticum aestivum
  Clone ID: PAT_TA_100475.pep
FEWVIGEIESRFLQSLVAPGEMIGCVAAQSIGEPATQMTLNTFHYAGVSAKNVTLGVPRLREIINVAKKIKTPSLSVFLKPEVSKKKELAKNVQCALEYTTLRSVTHATEIWYDPDPLGTIIEEDVEFVRSYYEMPDEDIDPDKISPWLLRIELNREM

SEQ ID NO: 206058 - protein, 75 aa, Triticum aestivum
  unsure (1)..(75): unsure at all Xaa locations
  Clone ID: PAT_TA_100476.pep
PPLDHXQTPLHSLQQPKANLCMLVXLXGHLGGLGGXLGKMGLLALLFRRIMGGQNMGDTGDHPXXTQGDTGQNPS

SEQ ID NO: 206059 - protein, 80 aa, Triticum aestivum
  unsure (1)..(80): unsure at all Xaa locations
  Clone ID: PAT_TA_100477.pep
CQHRGSYYKYAQKCTCYLLLSLKPRDLSMITXWLCTGDTGTTGANAERKEELPHREKKEKVPGQPPLPPLKXXSLGNKTL

SEQ ID NO: 206060 - protein, 152 aa, Triticum aestivum
  unsure (1)..(152): unsure at all Xaa locations
  Clone ID: PAT_TA_100478.pep
ARGLAAPASPPPAPNFMSNAREAASSSPPSKRGGGRXVVVVMGATGAGKSRLAVDLAGHFAGVEVVSADSMQVYRGLDVLTNKVSLHEQNGVPHHLLSIVDPSAEFTCRDFRDHALPIIEDILDRGGLPVIVGGTNFYIQALVSPFLFEDMS

SEQ ID NO: 206061 - protein, 60 aa, Triticum aestivum
  Clone ID: PAT_TA_100479.pep
ARGPQTQSIAVNTPGISASPLLAEFTSVDGSQANMLTQAPTKSSAVERPLDRLLKAVSIL

SEQ ID NO: 206062 - protein, 126 aa, Triticum aestivum
  Clone ID: PAT_TA_100480.pep
HINMYENVAPFLADKHVSFPTNKARSASARPSSALFQKSPSACENSTRSPCLSGSEITIHFYKKEPYVCKNSVRDPLFYLIHMLPFRRGGAALFAAATAPDGWISVVRHAFLQRSPCGLQRSSRPT

SEQ ID NO: 206063 - protein, 151 aa, Triticum aestivum
  unsure (1)..(151): unsure at all Xaa locations
  Clone ID: PAT_TA_100481.pep
MASPGGGYADRPAPPLDGMITVDGGGGRTPPPAGLPRPPGFRGLMQQPSRLASGVRQFASRVSMKVPEVVPGIRPGGGRMTRMQSSAQMGLKGLRFLDKTSGSKEGWKAVERRFDEMSKASGRLPXXSFGKCIGXGDXXXFAGELXXXLSR

SEQ ID NO: 206064 - protein, 57 aa, Triticum aestivum
  unsure (1)..(57): unsure at all Xaa locations
  Clone ID: PAT_TA_100482.pep
FFVHGETVLAHSNIMCRDLARPXFVAGLVCSRFHDLALLCRNRLDDVAPSEWISWFR

SEQ ID NO: 206065 - protein, 171 aa, Triticum aestivum
  unsure (1)..(171): unsure at all Xaa locations
  Clone ID: PAT_TA_100483.pep
MEPSRRLLLSDYDGAIMSPLPSPSTSSAAPFKPGVAVVVGILTSVFSITFLLLLYAKHCKRSAAESSGPYGSGGGSGGGAAGERRNSGVERAVVESLPVFRFGALRGQXXGLECAVCLGRFEPXXXLRLLPKCRHGFHVECVDTWLDAHSTCPLCRSRVXXAAPAQAVHDG

SEQ ID NO: 206066 - protein, 148 aa, Triticum aestivum
  unsure (1)..(148): unsure at all Xaa locations
  Clone ID: PAT_TA_100484.pep
SYTYKRNXXMYICXVSFHHLPNXPANISSIXLRVCMTLLFTHKRTMTKSRRKKKACTRHSRRGSVGVVAVVPAEEHGHAPPEDVQPRLVLLQHGAAPALPRARRRPPRAPMLRRRRRRRDEVAVRRADGVGDGGGRELHVFRRAGVAA

SEQ ID NO: 206067 - protein, 207 aa, Triticum aestivum
  unsure (1)..(207): unsure at all Xaa locations
  Clone ID: PAT_TA_100485.pep
MDRVSNAVHIQMPAPAQQSSAPMAQPPTGVAPADKTLSSASDLLKLLPTGTVLAFQALAPSFSNNHGVCHAANRYLVQALIGGCAASCVLLSFTDSLVGRDGRLYYGAATFGGFYPFNFTGTRAERDAVFKDLSRFRVTPMDLVHAVVSALVFLAVAFADAGVQGCLFPDAARDLRELLVNLPVAAGFLASMVFMIFPTXXXXIGYT

SEQ ID NO: 206068 - protein, 200 aa, Triticum aestivum
  unsure (1)..(200): unsure at all Xaa locations
  Clone ID: PAT_TA_100486.pep
GTRARLQAGLPMDKQKNHKNAEMGNDVFRRIILNQVGRDIGLEEENVPCNTPRNSVHSRFGGSSAKFAASTSGSTGAELVSPGEYVRDPGSILSLQPWIFKRSSTKNNEEMVVPSGSRSVGRGKNLVDGFRDGSTTEVSTRSPGLGSGPGXXRGALXSRRAQXHFINPLVATENSYIPQLYNEKFEFEECTFAPVPSPAX

SEQ ID NO: 206069 - protein, 204 aa, Triticum aestivum
  Clone ID: PAT_TA_100487.pep
HEAFLPDLDQETFARTLVELLRGDNFHFGSPLAALLDRLKGGLCDPRIVLYRRGSRFAERRKHYYHLQRYHNSMVLGLWDTKDCWKSCNRYSLGERLRAMDAMKAQRKQKELGLVARAGSETDSESRESAEQFLTRSKPDKMALNKAGNKERSKGVLRLGVSKAVGEEYIGGAGRDAAVALPKLSRPDNAYGYDAGVAHRKQHR

SEQ ID NO: 206070 - protein, 66 aa, Triticum aestivum
  Clone ID: PAT_TA_100488.pep
CALQKKSGENINNKLQLVMKSGKYTLGYKTVLKTLRSSKGMDRSALCFLRLFFISLLIDLSLWLIC

SEQ ID NO: 206071 - protein, 185 aa, Triticum aestivum
  unsure (1)..(185): unsure at all Xaa locations
  Clone ID: PAT_TA_100489.pep
MSLPGALTASSFAVLLLLALSTWPTCHATHNITAILAARRDMSEFSRLLTTTGLADEINERNTITVLAVDDADMAPLRARHLPREALRHVLSMHVLVDYYDHDKLHRLPGGSADVSTLFQASGDAPGSAGMVEISERRGGSVAFVPXXAGDDARATSVLFVKPIHXXPYNISVLQVGAXXSXXXA

SEQ ID NO: 206072 - protein, 171 aa, Triticum aestivum
  unsure (1)..(171): unsure at all Xaa locations
  Clone ID: PAT_TA_100490.pep
MASKQWTRVQTIGRGASGAEVFLASDDVSGELFAVKSATAACASALKREEDLMSCLRSSRVVSCIGGRAARDGSYQLFLEFAPGGSLADRAAIDGGLDERTVRGYAADVAAGLAYLHGAGMVHXXVKARNVVIGADGRAKLADFGCARKVXXXXPIIGGTPAFMAXXXARX

SEQ ID NO: 206073 - protein, 179 aa, Triticum aestivum
  unsure (1)..(179): unsure at all Xaa locations
  Clone ID: PAT_TA_100491.pep
XPIGNEGATEFEQWXXDALRIVFASHLTDIKSHPNGNAVQRRDIIGTNGGKSDFWKRVLEDYKTRQVVFDAKNFEELGPSEYRQLQSYLTGPYGKLGFIINRDESEVLKSGKDLDWTKEMYQSHNSLIIKLPAKYISKLLQKLRNPEKHDAIDRQMGKLLTLYETSYMAIKSTQKKRRK

SEQ ID NO: 206074 - protein, 95 aa, Triticum aestivum
  Clone ID: PAT_TA_100492.pep
HQEKIMKLSMLLRIKLLKRMHDSFMALLLYMEGPPQFVQVMDLLYIKQTVQLELTKETSTTDAYIICLNFFHFRRMSEKISPITELSYPGFQHSS

SEQ ID NO: 206075 - protein, 106 aa, Triticum aestivum
  unsure (1)..(106): unsure at all Xaa locations
  Clone ID: PAT_TA_100493.pep
PDXXRSGQPLLQFESESRAERNRGRKTRELVDYREAASQRDWWEKRVRIKLHKNPKLREGDAKNDIRMASSRSSSMQQRTSWRLQQVERLQCCSRGVLRTSGNYYC

SEQ ID NO: 206076 - protein, 86 aa, Triticum aestivum
  Clone ID: PAT_TA_100494.pep
PPAPPPHTSAASPCPLPFPPISSTPGAEASFPATVALARGGHASTPPSPSLPSASSCRSSTSPPGSGQRRAAPPPPLPLFLSMASI

SEQ ID NO: 206077 - protein, 205 aa, Triticum aestivum
  unsure (1)..(205): unsure at all Xaa locations
  Clone ID: PAT_TA_100495.pep
TRPEPGVWAVLTAISKKARLRAEGMNILLSADEHILGRTTENPRFRISVLAVSGNHCKIYKDTVIGELQRDEPVPVYLKDTSTNGTYVNWNKVTKRSPPTKLNHGDIISFTQPPHHDASYAFVYREVNAVSCVGNGTTILKRKSGEVGSESKRLKGLGIGSSDGPVSLDDIRRXXKSNAELXEQLEAHVVTIETLRAESKTAEAQ

SEQ ID NO: 206078 - protein, 111 aa, Triticum aestivum
  Clone ID: PAT_TA_100496.pep
EPNHARKLPRLGLCIRLFMVRRVFTLCHTQISFGRPAGRLGVVVRVTFLSEKLSTKLSTSDHNGFPKLCTNRIVFFTFTGGIMLSLGPSAMECTPKRKNDHDLVTSGPAQH

SEQ ID NO: 206079 - protein, 139 aa, Triticum aestivum
  Clone ID: PAT_TA_100497.pep
MKRLLSRLSRVAAADACAAAAYQPLRPDAAAKGSSAVSSPSSSFFGARRLSRGAWVPQGHVPVCVGEEGGPVERFAVRAELLGQPAFKALLWRSAQEYGYGHPGALRIPCAVANFRRLLLGLSDPGCKATDDDDAALYY

SEQ ID NO: 206080 - protein, 81 aa, Triticum aestivum
  unsure (1)..(81): unsure at all Xaa locations
  Clone ID: PAT_TA_100498.pep
EXQQPPPQQQQQNSGRSFMKEGWAAVFCCCFLVAGXLGGRRKKTIIFVVVGVRNHLLRRNNXGSLNIIFCRAAXPPLLDQR

SEQ ID NO: 206081 - protein, 199 aa, Triticum aestivum
  unsure (1)..(199): unsure at all Xaa locations
  Clone ID: PAT_TA_100499.pep
ARGRFPTPVVTLLIFSRPRAPATLLFFLLRTKCVTGPAPLPLPGTRATVPAPPSSSWHAGRRPSASFLLLARAPPSPRLLPPPGTRAAVPAPPSSSWNLXPPPPRLLPPPXRAPPPPHLLASPAMRAAAPTFPTALSSQAPVAAPPTSRPAPATAAPPSPPAPTPPRISSWWGTITGPPQSXXRSTPPPQSVHCSNTLS

SEQ ID NO: 206082 - protein, 102 aa, Triticum aestivum
  unsure (1)..(102): unsure at all Xaa locations
  Clone ID: PAT_TA_100500.pep
TPQNKLLKCEHIHTCISRTHXLTNLTAKTNCXXXLGSRXXKKDFRRSPFRGKKXSRRQQGPYGNFVKLKKKSPLKLLKGPIRERGASXPPCSLFGXYTXXXR

SEQ ID NO: 206083 - protein, 106 aa, Triticum aestivum
  unsure (1)..(106): unsure at all Xaa locations
  Clone ID: PAT_TA_100501.pep
VXXRPRRSASPPSPRTTAPLPPLVNLRPQTNDSSSSSQELSQAAHEEWRFFLLLLGAALPAHRGHQLDALNSPPGGRTDAPARARRLAGHEEGRGEEQLTTSLPRA

SEQ ID NO: 206084 - protein, 144 aa, Triticum aestivum
  Clone ID: PAT_TA_100502.pep
LHLQVHFIKKNLLVASYQFTKSLSRLACGSRYGQSHLTSAAAAMVAQPEILQWTPPPARSSAAPLCRCDHGIPTPPPLHRPPSPVPLPPCPPTPWPPPPRQDAPWKCAATQSTTSSSARSRHALLPLMAVSCLWLHFSGCGVLV

SEQ ID NO: 206085 - protein, 194 aa, Triticum aestivum
  unsure (1)..(194): unsure at all Xaa locations
  Clone ID: PAT_TA_100503.pep
TRAVWPTQSKSRGGGSFILHPPTRLPRSRAPPPGQWCLSPTPTPTPTPTSPSCPPPPNPSHKPCLRAAKTTAFKREERHKRKEQKREFKRQRKEQKRERKEQRKEQKREXRKRKEEKRDRRKRKEEKRERRKHKEEKRERKRQRKREDTLALALAQWEPLGAPAAASAPCAPPERPGPRDPSSPAGAAPSWIWG

SEQ ID NO: 206086 - protein, 178 aa, Triticum aestivum
  Clone ID: PAT_TA_100504.pep
MQKCKEDDRISKLPNDILVNILDRLNFRDVTRTSVLSRRWSQLPANLSRLKISARDFLSPQASIPDDELDEKLLRINALLRINAVNAANAAVVKATKSTLAHRDPGGCTIRLLSTTFYLRGDTPISVGHTVGNAMATLKVEKAEFTVLTQQKGRGCSIDEGEVWDGLCHFLMNATMHL

SEQ ID NO: 206087 - protein, 145 aa, Triticum aestivum
  Clone ID: PAT_TA_100505.pep
LDRAMPMIWTGAPAGCTVRYRLEDVRQPPSRSRSRSRSSRHQPQGRARPRQRRPTPAGDPLPSDTTPPSPPPFSLFLSSSSFSLPLIFSLSYRTNRAPPPSPFACTPAPSPFACTPPRLLGKLASKPAEEVWTRCGRWARWTPRA

SEQ ID NO: 206088 - protein, 49 aa, Triticum aestivum
  Clone ID: PAT_TA_100506.pep
ARGRERERELVSSFVCVIFQDHDENDLLFHVMVKMSHGPVRCQSFSLPG

SEQ ID NO: 206089 - protein, 65 aa, Triticum aestivum
  unsure (1)..(65): unsure at all Xaa locations
  Clone ID: PAT_TA_100507.pep
YXXXKGGXVGPHQRVGALPPSLLEQAFFLAVEGVKLKFVXPSSXFGGGRFPPPDEKQGFFGQLKG

SEQ ID NO: 206090 - protein, 67 aa, Triticum aestivum
  unsure (1)..(67): unsure at all Xaa locations
  Clone ID: PAT_TA_100508.pep
NAGHGGLLIHVLEIAVPILILTVPVLIVFEGDEILQSEAAXRNLCSWPXSLCLYLHPVHELXXSXXP

SEQ ID NO: 206091 - protein, 152 aa, Triticum aestivum; identical to SEQ ID NO: 119815
  Clone ID: PAT_TA_100509.pep

SEQ ID NO: 206092 - protein, 76 aa, Triticum aestivum
  unsure (1)..(76): unsure at all Xaa locations
  Clone ID: PAT_TA_100510.pep
RFEXAXXXIKELALVGTPGSKVVXPASHQLLPLVVKAIQENSGELDKEAIDVFIWCLTQSPESYKLWVLIELSKNK

SEQ ID NO: 206093 - protein, 152 aa, Triticum aestivum
  unsure (1)..(152): unsure at all Xaa locations
  Clone ID: PAT_TA_100511.pep
ARGRNPPCPTTSTSTPPPSPKPXPRQARPRPPPQEPPVPQQXTPPPPAAPDPAAPPHAXPGLAPRPPSPPRTWSGARSSPTRPGRGRSSPSPPAAPSSSSPSSARRPSPGATRPSSGPTRPTSPWGSSTTATPTTSTPPSTRPSTSSPAAXR

SEQ ID NO: 206094 - protein, 93 aa, Triticum aestivum
  Clone ID: PAT_TA_100512.pep
EKIHSIIWMYTAYSQIFMTKYIEMRATQKRQIADNGNSEQCVHCSLYEPTIFTFLCSSRINVFSHEILHTCGIHPHVNVELFPEFFETLKCHF

SEQ ID NO: 206095 - protein, 112 aa, Triticum aestivum
  unsure (1)..(112): unsure at all Xaa locations
  Clone ID: PAT_TA_100513.pep
HEGTLAKKPPPNFAKLTRGLGATDGVIDHGYAEDGKTIFQDIGASKAPQSDCPAAPVSSPSGCSVRLAAGCRLRRPAGCRLQPDPTPTRHRQDTDEMTVPRRHLQCTVSPXY

SEQ ID NO: 206096 - protein, 178 aa, Triticum aestivum
  unsure (1)..(178): unsure at all Xaa locations
  Clone ID: PAT_TA_100514.pep
AKREPFVKLLSDIPLSCFVPPHLSSSTPLTWCDRPSEGTTAAMPPPVAAALVMLLAVALGAARAADDLASDTAALQAFIAPFGSASVSWNASRQTCSWTGVVCSGGRVTGLHLPGDGLRGSVPVGALGGLTRLTVLSLRFNALSGPLPADLASCVKLRVINLQSNHFSGELPXAXLSX

SEQ ID NO: 206097 - protein, 133 aa, Triticum aestivum
  unsure (1)..(133): unsure at all Xaa locations
  Clone ID: PAT_TA_100515.pep
RPCHHLRGPPPASTVVGAECSPAMTGTSFPRSLASQHLLVVVSHHGRQGQPPRRLDLPPQPRGRPSSMATPLPASPSDPPSWAYTRAWSADVGVAGRLYNDEHCDCHLSISLFCRISSEXXSFVLLMNXXMSN

SEQ ID NO: 206098 - protein, 135 aa, Triticum aestivum
  unsure (1)..(135): unsure at all Xaa locations
  Clone ID: PAT_TA_100516.pep
MLDISALSYLKVLRDFQSQHGDLVEAVVPFMGESVTDGTLANFLKKPGDRVEADEAIAQIETDKVTIDVSSPEAGVIEKFIASEGDTVTPGTKIAVISKSAAPSEAHVAPSEETSQXXXPPPPPPEXPKVEAKSX

SEQ ID NO: 206099 - protein, 90 aa, Triticum aestivum
  unsure (1)..(90): unsure at all Xaa locations
  Clone ID: PAT_TA_100517.pep
TGSGPPFEEKNPMSRLVLIMGGIPFAKNSREKFEMLPKTPTLFAXWGLGFYNANFRSTPPPRWLVGICRGVSNDLGSRVPPMEKGALRAL

SEQ ID NO: 206100 - protein, 169 aa, Triticum aestivum
  Clone ID: PAT_TA_100518.pep
HEAQPAAGGDTVPDPALLVGGVLPKPPASPSIQPSPSRPPHVGSRGRRRGRPHLHTTVGVGGAVGLGRKEEPSSSGLPTRFHSKGGSHARSRTTHTYQFCRSSSSRRHRHRHLYGAALLIPTHPNRSATRALSGLPLSHRSDLAPLRIGRPRDLVIVGMRGEEGRRGRR

SEQ ID NO: 206101 - protein, 96 aa, Triticum aestivum
  unsure (1)..(96): unsure at all Xaa locations
  Clone ID: PAT_TA_100519.pep
GLRSGTSRCRRSTRASRGQGGGDGXXGFRVSAEGRARGAWVGKERGHGERGRAALVRRRGSGERRRLPGRHGEIGRPGGGGAEEERRGGWRRGASC

SEQ ID NO: 206102 - protein, 91 aa, Triticum aestivum
  unsure (1)..(91): unsure at all Xaa locations
  Clone ID: PAT_TA_100520.pep
XXFPPLLPIYMXXPRAFRVWGLSGVALWVSQHVCFRIPRCVTVVGLFMSPGVCGVEPRGCLGGFLLFFTGFFVCVFVFFYXVSVLRCTRLS

SEQ ID NO: 206103 - protein, 122 aa, Triticum aestivum
  Clone ID: PAT_TA_100521.pep
TRERERAKVDRQNSTVFKGNNDDASYNGLAHGNNELGKRVISTKTLYYLRPFERVKDAQVRDSRATNAGQVIFQPGREVGTTEMIREASQAREAEKVELETIIDHLKKQVVALEVQLRDRRT

SEQ ID NO: 206104 - protein, 124 aa, Triticum aestivum
  unsure (1)..(124): unsure at all Xaa locations
  Clone ID: PAT_TA_100522.pep
ASNSRPGPASPLAFPHPCFNDDGAVAVVGLVLKPHPSPGPNPPAAPFSPSLPPRFSFQLRLDGRQALFSFPCWGLGGLESKPPPPSTSPRPPPSLCNWLDLGXXSWPLXXSLGPAPPPTCASRV

SEQ ID NO: 206105 - protein, 187 aa, Triticum aestivum
  unsure (1)..(187): unsure at all Xaa locations
  Clone ID: PAT_TA_100523.pep
ASTGRWGQAAAAHRRSLARTPLLPKISWGWRPWRSLGNLWEEPLSKLDVGSAAALPLPTSPDPQQHRTLSEQLASLPPLADLALATFPCLSCLSNPPILTPRLGHLHLAVSLPDFADGCNPILTMDGGVCMVWKMRVLSGLPIASSGELLEIIDGLLWALPPPASLCPSLRGKPPASMGSALXXRFW

SEQ ID NO: 206106 - protein, 98 aa, Triticum aestivum
  Clone ID: PAT_TA_100524.pep
ESFTMSLAHFNKQRRNTMKMMTISHEVHHADCPCLETFQENSFLEINFWIGRIPLTDVTRTSVRLLLCPWLFSVTLLPCSPILLLMLTVSSCSFYQPA

SEQ ID NO: 206107 - protein, 63 aa, Triticum aestivum
  Clone ID: PAT_TA_100525.pep
TRDIPNFGHKGHRVSFKALGKSRIARPLCYIYSRLYPAYIVRFDLVETKDRDSLVLPTYMSRY

SEQ ID NO: 206108 - protein, 119 aa, Triticum aestivum
  Clone ID: PAT_TA_100526.pep
MARAANKYGNTPARLVVLYNKVDMLRVLLEHDCSLGYEVSTKGFSLLHAAAYRGHIDVAREILKHCPDAPYCQVDNQDGLTLLHTTITNNHAEFADFILTPQLRKVINMKPPLHYAVCN

SEQ ID NO: 206109 - protein, 69 aa, Triticum aestivum
  Clone ID: PAT_TA_100527.pep
MDGGTSSKRRVEAPGQEESSCKRQNVTMGMDALDCPVCFHPLRPPIYQCSVGHFICSSCRPKLVRNNCH

SEQ ID NO: 206110 - protein, 53 aa, Triticum aestivum
  Clone ID: PAT_TA_100528.pep
HEGSASRLGYTAGAGIVQSRRVVRNSYCAPPNGSSNLKAHFFNNTFCINIKKI

SEQ ID NO: 206111 - protein, 106 aa, Triticum aestivum
  Clone ID: PAT_TA_100529.pep
HEGQFRSEATMTSGELQEERDALDCTAKETGTSGRPATSCASLFFVADSCPGFATRMLCAVFFSHCASDNDTTFGMFFRDPNERLVLLPCSVTERFPKHFASDFLN

SEQ ID NO: 206112 - protein, 127 aa, Triticum aestivum
  unsure (1)..(127): unsure at all Xaa locations
  Clone ID: PAT_TA_100530.pep
MHLSLWKPLSQCAAMLMDKRHRPPRPPAAGAGAGSGGGRRLQESKLREALEEASEDGCLTKSRDAALLDDGDGGEDGAGSGSGSVSRTRSLARLNAQREFLRATXVAAERAFLSXGALPALADALAT

SEQ ID NO: 206113 - protein, 212 aa, Triticum aestivum
  unsure (1)..(212): unsure at all Xaa locations
  Clone ID: PAT_TA_100531.pep
ARGRSARRRPASPSPASPLPLPLDVGLSASPSRRRRPLPPPVLQSQSVCATEKFDFFPPVTSFYAVEARGRSIYVRRWIHPSLAPTSTPTEGEEDSAQLPPLPDPQAQHDVAGGPAGARALEEAESELLLVVEAPGGGTGGGGLRRVLGRAAHAVSPRRAQGATSGEQFRGGGAGLRGLQGVPVPLLQVLKNGVXXEVEXXCPECLGSSXXX

SEQ ID NO: 206114 - protein, 170 aa, Triticum aestivum
  unsure (1)..(170): unsure at all Xaa locations
  Clone ID: PAT_TA_100532.pep
MASSDEWGDDAAGGEWTTVTRSGRPSHAGAAGRSPNAKRAAPRPPKPAAPTVGEVGEGLAGLDVDGASRTGRLDKYDIPVEVSGDGAPAPADGFEQAGLAEAVLRNVARCGXDNPTPVQRYSIPIVLSGRDLMACAQXGSGKTAAFCLPVVSGLVSAAEGGQGGGRGDRD

SEQ ID NO: 206115 - protein, 211 aa, Triticum aestivum
  unsure (1)..(211): unsure at all Xaa locations
  Clone ID: PAT_TA_100533.pep
RFQPKDVNTEAASKEREQSIPDTLKSFFVRFVRLNGILFTRTSLETFEELFDVVINDLKVLLSSGPNEEFHFGSDAAENALVIVRLVAILIFTVHNVKKEPDNQSYAEIVQRRVLLQNAFTAAFEFVGHILKRCSELRDIASSFYLPAIVVYIEWLACHPELAADSEMDEKHANARSFFWNQCVLLMNKLILTDLASIDGDDDXXCXFDMG

SEQ ID NO: 206116 - protein, 97 aa, Triticum aestivum
  unsure (1)..(97): unsure at all Xaa locations
  Clone ID: PAT_TA_100534.pep
SEFXXXEVGLEPEYIVHRPAMVNYSLDGRLRPRXXVVKFFKANGLLDRDRDYYSVFSYVEKVFVQRYICPXKEGAPPLAEXXDAAPSGERPXNFKFP

SEQ ID NO: 206117 - protein, 150 aa, Triticum aestivum
  unsure (1)..(150): unsure at all Xaa locations
  Clone ID: PAT_TA_100535.pep
MKPRDISHRQQNQHRPTPHAARETEGAVTSPPRALGQAPRPDPGQRRACRRRDRSEPPRTPCTPRTSRPPTSAANTPAKPPPSTRSKRGEAPCRPPEHEPPPVXSSPGRQVPAAAGSVGASPGGVRLAAARGGEAGERGPAAAGGAAPPE

SEQ ID NO: 206118 - protein, 165 aa, Triticum aestivum
  unsure (1)..(165): unsure at all Xaa locations
  Clone ID: PAT_TA_100536.pep
MAARWAPPAGLLLLLLLAVLLPARADRPARTAHADDDPEASSAVFQLYGNVYPHGLYYVAMSIGNPAKPYFLDVDTGSDLTWLQCDAPCVSCSKVPHPLYRPTKNKLVPCVDQLCTSLHGGLSKNHKCDSPKQQCDYEVKYADXXSSXGVLVNDXXXSPPCECCP

SEQ ID NO: 206119 - protein, 100 aa, Triticum aestivum
  Clone ID: PAT_TA_100537.pep
LKSFINSDTKSHRSKESEIPLKQLSPNLSVSVWINQGPMSRRSWAKLKFRVSDTTSREAPKVPAAQQSPAWLCCLTTSRVSESRASSGAQPGSSFVSLGP

SEQ ID NO: 206120 - protein, 90 aa, Triticum aestivum
  unsure (1)..(90): unsure at all Xaa locations
  Clone ID: PAT_TA_100538.pep
GSGCCAASRSRRPQRRWRCVSSAAVAGSAVPSPTSRSRSPSAATASTPRXPASSSSPXXXXSSXXSAQPWASSSTRRETSSASWXXCSXX

SEQ ID NO: 206121 - protein, 77 aa, Triticum aestivum
  unsure (1)..(77): unsure at all Xaa locations
  Clone ID: PAT_TA_100539.pep
MAERRSGYRDWDRAAAEAGRCWRPPRSQAHGGGNVSVPLWEKKFCIDACSIPXXKLCEAXKLMSLYTNIVDWDDXXA

SEQ ID NO: 206122 - protein, 174 aa, Triticum aestivum
  unsure (1)..(174): unsure at all Xaa locations
  Clone ID: PAT_TA_100540.pep
ATQSSAGPAARCRLSCDRPRHGMASPPPEVAVPVDEEDRETEGEDICAFDIPGKNAPRDRLRRWRQIALVLNASRRFRYTLDLARDEERENLRRIIRAHAQVIRAVFLFKNAGQKALQESYDGTKFESLSQRFPIDLEKLVMLNRDHEAIMLXXVGGVSGLSDLLKSNLXXXVS

SEQ ID NO: 206123 - protein, 177 aa, Triticum aestivum
  Clone ID: PAT_TA_100541.pep
PPPSPPPKRQNPNPTRRGSGAMLEAAIPALWSTVHGWFTPWVLFLVLNIVIGTIAVTSKASPPAGGGEGAAAAAGGERRSLSRVPSMALDRLRSFNMSRFTAPAPEAPVSGVLDLGSDEQLPPLEMEPEAQGELEHEHVHMERSMSEAAAEAELPRLPARLRKSASDKSAFAHFVAT

SEQ ID NO: 206124 - protein, 142 aa, Triticum aestivum
  Clone ID: PAT_TA_100542.pep
RSPPTSESPQPEASMAPKAEKKPKAEKRLPAGKTASKEGGEKRGRKKGKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 206125 - protein, 210 aa, Triticum aestivum
  unsure (1)..(210): unsure at all Xaa locations
  Clone ID: PAT_TA_100543.pep
ARGSLHIDKHSIEELMSTKWNKLSASIKRWNRAMKAFVRVYLASERRLSSLVFGDLSETTVDLCFYEISFSSVMQLLSFYESVAIGPLKPEKLFRILDMYEVLDDLLPEAEFLFQAGGNDMVLAEYHEVLLQLGESARKTFAEFKYAIQSYTSSSAVPTGAVHPLTKYVMNYIKAVTVYSKTLDSLLXXADQQPIPNSCTHFTXTALHLX

SEQ ID NO: 206126 - protein, 74 aa, Triticum aestivum
  unsure (1)..(74): unsure at all Xaa locations
  Clone ID: PAT_TA_100544.pep
KLGPGGKGFKGKKKPFSNLNRWAPQIREGAKLPHPVSSRGNKGLNPTPFFFPGRGFGRTKFFYFFFGKQXQXGX

SEQ ID NO: 206127 - protein, 208 aa, Triticum aestivum
  unsure (1)..(208): unsure at all Xaa locations
  Clone ID: PAT_TA_100545.pep
SRPSPVGSCVPPPSSWSSDARADPAAFLYSSRLKHLPLNTTFVFCCCFTDEHRPPPRCFAFASRLRPRERLQPLGFDKLPSTTAFTMYIYTETRPPRCILTSPKTREHLHDEPRTTTVDVHFAKYHYRRRKNGSGKSEDPKYHDTDDMNIYGMCTTTRCDAKFDDDRVPLPLLEHERLLPLRLVNVYFHYFHYERPXXVYFLYLAPIX

SEQ ID NO: 206128 - protein, 86 aa, Triticum aestivum
  unsure (1)..(86): unsure at all Xaa locations
  Clone ID: PAT_TA_100546.pep
XXKNFIGPRKRGVPVTWASPVLXFFWRLSGRFRFARRFFLVPGPVTRPGCVGWGFVMPWGSFSPARFMLLYPFGGLGRNXCSXREG

SEQ ID NO: 206129 - protein, 177 aa, Triticum aestivum
  Clone ID: PAT_TA_100547.pep
TRTRRHSSHHLHRDLARSTNQRQPLLSIDPSHQPEQPSIHLVLAPETQDEPSSSSNQNERHRRRLERRRTGDECLAPISSPSFNSSSHSLTSLSLCLLVQGAPTPRSCSAAVESPWPRTLAVLSTPCRRGSALAKPRFRCCFAGEFRRAKFHCFPFEPRCRSLKILLPSPPVAPWPR

SEQ ID NO: 206130 - protein, 162 aa, Triticum aestivum
  unsure (1)..(162): unsure at all Xaa locations
  Clone ID: PAT_TA_100548.pep
PSPATSRSSRTSPASAPSAPPGATRGWMPRPRLRRSPRGSSSRPPRRRSSSTPRRTASTATSVCPSPPRTPTDAAAAAASRRPRTAGSSPSTPPISPRPSSTPSPAPFAPSRRSPPSSRRRMTWPGTCPRTASWRPAAXXSWSAPSXLSLTXXXRSPPCPTT

SEQ ID NO: 206131 - protein, 131 aa, Triticum aestivum
  unsure (1)..(131): unsure at all Xaa locations
  Clone ID: PAT_TA_100549.pep
MVARFPVSLRWFGGLLRASSSRRRRGVSVMAGGGEEAQLGGFLEYMDMLRNYERSGVPRGAGTDSDDGFDLGRMRRLLRRLGDPHTHYPSVHIAGTKGKGSTAAFLSNIMREQGYNVGXXSSPHLLTIREX

SEQ ID NO: 206132 - protein, 150 aa, Triticum aestivum
  Clone ID: PAT_TA_100550.pep
MPRRWQVWGRPDGSQVWIPAPDPDAPPPPPAAAPPPPPGRAAGTAAASLEDAPVKGRGAADGCRVESMADLLVQARNKLLEGDGMAGATVDAGKGELFCTASGRPVSVSERAIRRARALVGEEVEKAGIKRKQSFGDVSDVEGELRDAPF

SEQ ID NO: 206133 - protein, 79 aa, Triticum aestivum
  Clone ID: PAT_TA_100551.pep
RHFRQHANQFIFSCLKRLIKANGGNTTKLLYYLSKSSSSCYHGVVDRMQLASQSYWNLLRLAGLQPLNARVTEGRSSSC

SEQ ID NO: 206134 - protein, 207 aa, Triticum aestivum
  unsure (1)..(207): unsure at all Xaa locations
  Clone ID: PAT_TA_100552.pep
WVAEQQDLGGLGLAGICREVTRVLCATIFNSSCLGPMLLSLILPCANDVLSSRVDSNQDSLLRLAAYWAALLLFKLLYFGLCYVFTLFCTCAYVFLVASLYCTGGDFAAANHGRHALPVDPSRRLNRTFFFLAIPLLITFYAGAQAWIALQQLDAPGVVTLPLQLMGXXACLAGAAYAXVVCQLACVVSLLXXAWLLTAIRXXRALL

SEQ ID NO: 206135 - protein, 103 aa, Triticum aestivum
  unsure (1)..(103): unsure at all Xaa locations
  Clone ID: PAT_TA_100553.pep
MGFSFLPVMEYLSRRAFHAAGLCPHTVTLPCDPGEGSGTQTIHYWAPAPAGEPRLPPLLLIHGFGPMATWQWRRQVGAFSRRFHVVVPDLLXRLRPLPLLPGA

SEQ ID NO: 206136 - protein, 108 aa, Triticum aestivum
  Clone ID: PAT_TA_100554.pep
NVQIHMSVPTIRNCQYQVSINDYSSRQSLLPYKHVTQGKFVRDVVNYLNKTHHTKYTNTEVISIIPLSTSDSIKHTIASIKSTMAYTVCTPERIPIYGKTDIGNISKA

SEQ ID NO: 206137 - protein, 174 aa, Triticum aestivum
  Clone ID: PAT_TA_100555.pep
TRDAKRAKKKLHAAAAAAAGDVSASDLANDKVLVEETKKELSRIQAELSSTNRNLNFSDQQIEAISTKLPLDKSDLKTFFPKAWCDQNGEGVIDAAQKEFKGHVEEMEKQRGEEDIAGGDEGWAAAFDEDNFNPRAFSDAKGKKVQESLDSEHFTNPFYDEKKNSNPFGSQSYN

SEQ ID NO: 206138 - protein, 131 aa, Triticum aestivum
  Clone ID: PAT_TA_100556.pep
MARRLLHLRPRLQALAPRLVPSRQYMSDMRRSVFLDRLLRSLRSEISSCRAEPAPRPPPSAAPFALDDRPGEQWVRLRRAFGEQQEEEVRVDASMVDGAVAPTRSGVAAEDGGPQDRMHISVHRGLQARAA

SEQ ID NO: 206139 - protein, 175 aa, Triticum aestivum
  unsure (1)..(175): unsure at all Xaa locations
  Clone ID: PAT_TA_100557.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVXNEVEEVKEGXPDAYVRIIRFDNMRQVQWVSFNCLKXXGCEXSGKG

SEQ ID NO: 206140 - protein, 172 aa, Triticum aestivum
  unsure (1)..(172): unsure at all Xaa locations
  Clone ID: PAT_TA_100558.pep
QDPQKAERNNSTGDGDGDGGPKTRGAXCPPQHPLPGNHHGCALPGCLPVIAPLGARXXSTQIVREPQEKCQRTSKKITKAIEIGATIKSFXVFKTKKWRIQLGQXEAFKXXPWGIXQSKXXKQVCXXXEKREXXNQPLXXGTNFNGSFXVXKKTXQXYXRCCVXKLYPLKXX

SEQ ID NO: 206141 - protein, 88 aa, Triticum aestivum
  unsure (1)..(88): unsure at all Xaa locations
  Clone ID: PAT_TA_100559.pep
YRKFYNXHELFALLPLELTLCTCKKAMYHQLLYIQHYSGLKPPCILYQECLPRTHPLVRITKSSLTCKPXAXILLDDXQPXSLXPPER

SEQ ID NO: 206142 - protein, 68 aa, Triticum aestivum
  Clone ID: PAT_TA_100560.pep
NRGTYGPAIKAGEATFPGQATPVPQLFCCGDSTFPGIGVPAVAASGAIVANTLVSVAQHSELLDAVGI

SEQ ID NO: 206143 - protein, 121 aa, Triticum aestivum
  unsure (1)..(121): unsure at all Xaa locations
  Clone ID: PAT_TA_100561.pep
FVHFELPSLLPWTFVLLXSSGGXXLLHLAPKIYHGGVFGISYLYYEYNLEKLSAFQQFCAGYXQXYACCLPSIXXGILMALPIIVLXRFXXQEQNLFSTVXILLMATVLAXFCNXFFXXQL

SEQ ID NO: 206144 - protein, 124 aa, Triticum aestivum
  unsure (1)..(124): unsure at all Xaa locations
  Clone ID: PAT_TA_100562.pep
IPSAAXTPILLCRSTPSTXDSTEPXLPLPIHHSVPASIHHLSSSFSVSGEQARRAPKVTSYDXEXRVGGAPXIRGSVDQDGNDGGVREDAKXVITGASAKXRNXWWWRAXVRYMMWRXRHKFKV

SEQ ID NO: 206145 - protein, 129 aa, Triticum aestivum
  unsure (1)..(129): unsure at all Xaa locations
  Clone ID: PAT_TA_100563.pep
SRSTPLPPPMASPAGNPNPNPGNPXPPSRCPCSSGRLPTPRRPPRPCSPAPPARRRTPAPTPTPPPPXLPTPPLPPITRKIPKPPMPPTVIPSPCPNPXREPXPXXLKPIGRPGGPNPRGPASMQACGS

SEQ ID NO: 206146 - protein, 67 aa, Triticum aestivum
  unsure (1)..(67): unsure at all Xaa locations
  Clone ID: PAT_TA_100564.pep
TKXEHLTSXACLLTNSPIFPFLXFGIVVFLNWKPSPGFIKXTGRFLXLWFFAPPIVAEVGVLPPFSS

SEQ ID NO: 206147 - protein, 216 aa, Triticum aestivum
  unsure (1)..(216): unsure at all Xaa locations
  Clone ID: PAT_TA_100565.pep
RPNLLLLLLLLLLLLSLLETQATDGWRPLLAFALLHHKKAKGWFMDGWRPLFSSRQEXKRRIHGWMDXHHDTIRAPPPWXYNFFFFRSKSRPWICKVFGAKSVHGVLLNKPRQGFAXGSLTNGGRXNSSSLLPFFPSKEGKENGQWAXQQFRPAEQRQSNNFRPAERPKAFPGTNKRAKXQISPRXNXXGQKTNFXPTEQRGQXTNFAQPNKRAKG

SEQ ID NO: 206148 - protein, 190 aa, Triticum aestivum
  unsure (1)..(190): unsure at all Xaa locations
  Clone ID: PAT_TA_100566.pep
SYDFKTHKSISCARKVNPSDVIILEGILLFHDSRVRDLMNMKIFVDTDADVRLTRRIRRDTIEKGRDIIAVLDQYSKFVKTAFEDFILPTKKYADIIIPRGADNSVAIDLIVQHIRTKLGQNDLCKIHPNLYVIQTTYQIRGMHTIIRDAATTTHEFIFXPDRLXXXGCXAWALGHLPSREKASQLLQLG

SEQ ID NO: 206149 - protein, 175 aa, Triticum aestivum
  unsure (1)..(175): unsure at all Xaa locations
  Clone ID: PAT_TA_100567.pep
MAPAVMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEXPDAXVRVIGFENLRQVXCVSFNPLKATGXPRSPGKA

SEQ ID NO: 206150 - protein, 179 aa, Triticum aestivum
  unsure (1)..(179): unsure at all Xaa locations
  Clone ID: PAT_TA_100568.pep
MAAAFSSTVGAPASTPTNFLGKKLKKQVTSAVNYHGKSSKXNRFTVMAAENIDEKRNTDKWKGLAYDISDDQAGXIPRGKGIVDSLFQAPTGDGTHEGVLXSSYEYVSQGLKKYDFDNXMGXFYIASAFMDKLVCXHSPKNFMTLPNIKXPLIXGIWGXKGQRKSLQCEXFLPQXXGXN

SEQ ID NO: 206151 - protein, 132 aa, Triticum aestivum
  unsure (1)..(132): unsure at all Xaa locations
  Clone ID: PAT_TA_100569.pep
MSISVNGHSVVPPGFRFHPTEEELLTYYLAKKVASQPIDLDVIPDVDLNKLEXPWDIQERCRIGXAPQNDWYLFSHKGQEILDGGRATNRGNGXAGFWXGNRAGTXAIYSAGRVPASMDASSKGPWPKMGKF

SEQ ID NO: 206152 - protein, 108 aa, Triticum aestivum
  unsure (1)..(108): unsure at all Xaa locations
  Clone ID: PAT_TA_100570.pep
FKSYREGLMSPQTETKAGVGFKAGVKDYKLTYYTPEYETKDTDILAAFRVSPQPGVPPEEAGAAVAAESSTGTWTTVWTDGLTXSLDRYKGRCYHIEPVAGEDIAILN

SEQ ID NO: 206153 - protein, 97 aa, Triticum aestivum
  Clone ID: PAT_TA_100571.pep
GGDVEFIRDVTYRNGIFKFIEIDNFCIPAIARDETSNIISKTMQHFDSNDIIHDSELIYPVLKQAEPIIVPDGWKDSSHILGFLHGTIGLRTHAVQC

SEQ ID NO: 206154 - protein, 170 aa, Triticum aestivum
  unsure (1)..(170): unsure at all Xaa locations
  Clone ID: PAT_TA_100572.pep
MQIFVKTLTGKTITLEVESSDTIDNVKAKIQDKEXIPPDQASVSSLLXSKLEDGRTLADYNIQXRESNLHLVXXLRGGMQIFVKNLTGKNINLEGESSXDTNYNXKGKIQEQXGFSNGVNNVSIFSGKXNXXGWAQPFKTKNKGPLGLKLGGEKFFFQKTPKRKQPLGVP

SEQ ID NO: 206155 - protein, 129 aa, Triticum aestivum
  unsure (1)..(129): unsure at all Xaa locations
  Clone ID: PAT_TA_100573.pep
SNPIPTEIPISKPYPVRSRRDGXXRVFFDMTVGGAPAGRIVMELYKDAVPXXVENFRALCTGEKGVGKSXKPLHYKGAARFNRVDXPTLCCQGRGTSPKGQNRGKSNLTGKKSDQKSKKPKPGGFFPNG

SEQ ID NO: 206156 - protein, 111 aa, Triticum aestivum
  unsure (1)..(111): unsure at all Xaa locations
  Clone ID: PAT_TA_100574.pep
MYSNFKEQGIEYVKQAVQXEDNAGXYVKXFPLYMNALEYFKTHLKVREEXQRXKEXIXAKVQRXTFRRAXXKFGAVXQKGXGGGAPRGXPKGGETAXANRXQKQXGKXGGR

SEQ ID NO: 206157 - protein, 87 aa, Triticum aestivum
  unsure (1)..(87): unsure at all Xaa locations
  Clone ID: PAT_TA_100575.pep
MAAAFSSTVGAPASTPTNFLGKKLKKQVTSAVNYHGKXSSKXNKFKIMXTGKIXXEXGKKTKWEXVLXNXFPTNKKAXTKGXXXWDP

SEQ ID NO: 206158 - protein, 127 aa, Triticum aestivum
  unsure (1)..(127): unsure at all Xaa locations
  Clone ID: PAT_TA_100576.pep
XGXXRGXPPFXFXPFXTXDXHLPHLVFFXNPYFAPXFPEYRLLDSPQELQGSLPXXFGXTNPSKEDCSSNAQHHVGLRDEHTRPEDQAXDGRISAGPSQQTNVEASVVVVIAPQTAGSPSSCHLSAV

SEQ ID NO: 206159 - protein, 90 aa, Triticum aestivum
  unsure (1)..(90): unsure at all Xaa locations
  Clone ID: PAT_TA_100577.pep
FPATSRPPYTYTRARRRHGSLPAVTPSPPLLRLLPCEPAVPARTXLPLRTPPCEPAAAAPREPXPAVAPSPPPLRPLPCEPAVAARTGLS

SEQ ID NO: 206160 - protein, 208 aa, Triticum aestivum
  unsure (1)..(208): unsure at all Xaa locations
  Clone ID: PAT_TA_100578.pep
XKETXXVKPGXGXVXPFXFFPXQXXXPFFLGNGGXPKIPXPPKAXFLXLNXLPPXGXPFXPXSFXKHFEXXRFKXCPXSLXPPPPPKXFEXRLXLPERAFFFLXFGVNLKSPSXFEXGASLRRGXRASLLLEDRXRAGEEETNAKXPXGSGACWLGLGFEEEREKDRGELGGRGEGWRGFVDSCPGERRRRRRPAAVGQGGAREGERE

SEQ ID NO: 206161 - protein, 119 aa, Triticum aestivum
  unsure (1)..(119): unsure at all Xaa locations
  Clone ID: PAT_TA_100579.pep
MAASMITSPIVAPTSLPSLSRRGSSFAVVCNGXKKXKVXKPLGLXXGLTIQIQXQGKKVXKKGVXQFVXSXGXXSXGKSQSXNXXEXXXSGERXPXGNNGLXNWGVNXPGXXRGGVXLX

SEQ ID NO: 206162 - protein, 84 aa, Triticum aestivum
  unsure (1)..(84): unsure at all Xaa locations
  Clone ID: PAT_TA_100580.pep
MMMQAGGXSYPVELGXLDGKVGTRAVVKHSLPGAGFSLDQLNKLFAXKGLTQTDMIALSGXQXXGVTHCEXFVRGVYNFKGGAQ

SEQ ID NO: 206163 - protein, 115 aa, Triticum aestivum
  unsure (1)..(115): unsure at all Xaa locations
  Clone ID: PAT_TA_100581.pep
APPQLKRPFFREXNFGXXEKKXGPSWVXAWGLFXXILXSXEEETGAXGXXLGGGGFTXLLXSXXETLCPLRFLFPPDIPXARGFLAXASLLSHPRFPRLARGKGSARARIIGSXW

SEQ ID NO: 206164 - protein, 100 aa, Triticum aestivum
  unsure (1)..(100): unsure at all Xaa locations
  Clone ID: PAT_TA_100582.pep
QQPTIREERPHNRVKRGELGDHHCPAMSAGEMRKTACVTGGSGYIASALVETLLGEGVRRQDDGQRPRGHGRKNSQLKGLAKRLVPLEXIPXPVWTKKGT

SEQ ID NO: 206165 - protein, 175 aa, Triticum aestivum
  unsure (1)..(175): unsure at all Xaa locations
  Clone ID: PAT_TA_100583.pep
ISPSPKPSPPPWPQPPPPPSHSRAPPPPPPPYPNPPASLSRATKPASRRALPARIVRCCAASPAATSVAPPANALRXWXPSEPRKGADILVQXLERCGIVDVFAXPGGAXKEXQQALTRSPIINKQLXXQEXGEXFPXCXGKAXAFRARPGFXVXXFGXXGAKNLVFGGSKNLGN

SEQ ID NO: 206166 - protein, 103 aa, Triticum aestivum
  unsure (1)..(103): unsure at all Xaa locations
  Clone ID: PAT_TA_100584.pep
MGCARTVKAGAAAAAAVLVAAGVRMVGPAAAGFVAEEXPRAQAVAATWLTPPXLYLVINAIIISIAASSKVSKQPRRPAPNARFERTGSNCFRVWIPLEFTPG

SEQ ID NO: 206167 - protein, 167 aa, Triticum aestivum
  unsure (1)..(167): unsure at all Xaa locations
  Clone ID: PAT_TA_100585.pep
MAQKDAANGNGATTRPPPTPSPIRFSKFFQANMRILVTGGAGFIXSQLVHKLMXNEKNQVIVXDKFFTGSKKNXLXKWXXQPRFXLNRXEFTETXXVGGDKXNNFVGXAQQILLKXKTPFKXNKXECXLXTFKXLXPXXKKXGXXKLXTFHRKFKGDSPWGNKGGGL

SEQ ID NO: 206168 - protein, 100 aa, Triticum aestivum
  unsure (1)..(100): unsure at all Xaa locations
  Clone ID: PAT_TA_100586.pep
SLHLHHHTTTTSTSPICLLPSRSLSSSLPFHKPPPRVIELLHHLSPTGSGSNTSGSAYVGXSSKFHDXAPRSPLQRKRVGGPGDAXNQGSKQXPPWAXPX

SEQ ID NO: 206169 - protein, 112 aa, Triticum aestivum
  unsure (1)..(112): unsure at all Xaa locations
  Clone ID: PAT_TA_100587.pep
SXSGHEQVMTDGPXXTCSAQFQPIPSXWKPLXPPSXSTIXKGGXVLNQLPNWXQXGTXVAXXXVXXXTXXAPLXCQXLSXNLNSXLGSKXRXKHXILNFXSSLPPXFGXFPK

SEQ ID NO: 206170 - protein, 93 aa, Triticum aestivum
  unsure (1)..(93): unsure at all Xaa locations
  Clone ID: PAT_TA_100588.pep
RVRXXPPRESAPRSSSWFAESKRXCTAAACGAADHVSSTPWATSPAERSRKSPRRAESWGEREGVVVGGSGRPARCSGQRFGGDLSTIPYPVR

SEQ ID NO: 206171 - protein, 189 aa, Triticum aestivum
  unsure (1)..(189): unsure at all Xaa locations
  Clone ID: PAT_TA_100589.pep
GATSASTPTSRHTPPSLILSSPAAAGLVSPLASSPLPRRHRSTVGLLLCLPPPVLFHVAVDPNRPLSSWGNNAGRVFAVRMGGKMLQKRERRRRXXKETIXGWGLXXKXRAPATXWGGRPVLISRXNKVXPSSGAXRGATFXFNPQREKXXKLXXNXGKXKRNIXSTLPQXXSPGXXXKXEKXXPXWGG

SEQ ID NO: 206172 - protein, 62 aa, Triticum aestivum
  unsure (1)..(62): unsure at all Xaa locations
  Clone ID: PAT_TA_100590.pep
ALXEGLGAGGVATVAVAAPXPRGHGGVRVHPLRRALPDANAAAGREPRRRGRESWXGGWNGA

SEQ ID NO: 206173 - protein, 80 aa, Triticum aestivum
  unsure (1)..(80): unsure at all Xaa locations
  Clone ID: PAT_TA_100591.pep
YGVWWIGSNLFVWSAPLPGHRSAAPTLLFRLCRRCALPPRSQCVVNPSGTVAGPRHLPPFAGSXRRLPXILRVVKPPLER

SEQ ID NO: 206174 - protein, 86 aa, Triticum aestivum
  Clone ID: PAT_TA_100592.pep
PIRLAPLDPMGGEVPEPRRLIRALSFGCGGVPDEALHLRHGLSSTPPREREGRLRAAGLTGNPPLNPQSNVPSPFWPRLSLRSGFW

SEQ ID NO: 206175 - protein, 125 aa, Triticum aestivum
  unsure (1)..(125): unsure at all Xaa locations
  Clone ID: PAT_TA_100593.pep
ELQASPVPNAPMVLQPTGVRIVLKVPMNYSNSKSLILRAMSKVKVIDIRQQREHADGGGKRGRGGGRDGAAQDEVPRANXYGGCHKRRWTSPSTTKSLTPALRVCGTSSHVESKSSSKNKNLCLX

SEQ ID NO: 206176 - protein, 55 aa, Triticum aestivum
  unsure (1)..(55): unsure at all Xaa locations
  Clone ID: PAT_TA_100594.pep
MGSSLPAKXANLFKXIVKSYXTKXYKKGLRAADSILXXFPEHGETLSLKRLTPNL

SEQ ID NO: 206177 - protein, 94 aa, Triticum aestivum
  unsure (1)..(94): unsure at all Xaa locations
  Clone ID: PAT_TA_100595.pep
PPHPIIXRETKRGPHEEAQSDPGRREDPEPHAVEPYWQLAAALPFPGSNHQPVDGRKIEVILYXCFGFMVHRRRSFRVLTGFXXARCRRGGWRG

SEQ ID NO: 206178 - protein, 61 aa, Triticum aestivum
  unsure (1)..(61): unsure at all Xaa locations
  Clone ID: PAT_TA_100596.pep
FPFFAPKGPLLIHRLCFWAFSFVIXYGNGHINTQAYHFLRTEKKTIQAIFLENTPRRTILL

SEQ ID NO: 206179 - protein, 124 aa, Triticum aestivum
  unsure (1)..(124): unsure at all Xaa locations
  Clone ID: PAT_TA_100597.pep
MSGAAEEADSPPTHMSEDSSPGSSSGGSGGRRTPDRGGNNGGPRASSSGPPEQVLEKVLENVLEFLNAARERKAASLVCRSWXAXKXKNAASSSIGNGKPXNRAGPXGAFAPVSAVFLKXKPRF

SEQ ID NO: 206180 - protein, 92 aa, Triticum aestivum
  unsure (1)..(92): unsure at all Xaa locations
  Clone ID: PAT_TA_100598.pep
MAAQGLLSGRQLLGRPLQSSISRSSSSRKSPFVVRASSXPPAKQNDNRQLWFASKQSLTYLDGTLPGDFGFXPLGLSDPXGTGGFIXPKWVA

SEQ ID NO: 206181 - protein, 165 aa, Triticum aestivum
  unsure (1)..(165): unsure at all Xaa locations
  Clone ID: PAT_TA_100599.pep
MAVGXNXRISKGRKGSKKKAVDPFTKKQWYDIKAPLLFTXRNVGKTLVXRTQGTKIASKGLKHKVFESISXLIFKNDEEQAYKKXLRLRCWKDVQGXNXLNNFWGMXDFTNEKLKXLVRXXEXLIEGQXDVKKTYNYILXKXXICFTKXTXKQVKRTXFAQQVKL

SEQ ID NO: 206182 - protein, 152 aa, Triticum aestivum
  unsure (1)..(152): unsure at all Xaa locations
  Clone ID: PAT_TA_100600.pep
MDSXCPVCKDEFELGETARXLPCKHXYHSDCIVPWLRLHNSCPVCRQELPMPAGDESPDGAGASDGGEETVPPWQLLAGWGPTGLAANAGGNRTAAWKKGFNVGTEPTIKTGNVNGANSLNPFVSSLPCLFLPPFFEKNQLDCHVQNQFPEK

SEQ ID NO: 206183 - protein, 128 aa, Triticum aestivum
  unsure (1)..(128): unsure at all Xaa locations
  Clone ID: PAT_TA_100601.pep
SXKTRPXAXTXGIXPAXGGWGYXXPXXIGXRLINXRGGLRXXTGRTGAQPAXQCSLLDAHFLGRPRRCHSPLAPAPPVARYRPTRARTPGVRRAARVPSFGSARRGTCGRAPGLVVASSPRLTGNLAS

SEQ ID NO: 206184 - protein, 84 aa, Triticum aestivum
  unsure (1)..(84): unsure at all Xaa locations
  Clone ID: PAT_TA_100602.pep
EGRLXEXXRXXATXRXEGGEAKXKSFFFFGCXFXRXFFSXFFFXXNIFKGKCIXLCLNVKYRYSDXYNMNEEKTSXTMPXXXFF

SEQ ID NO: 206185 - protein, 142 aa, Triticum aestivum
  unsure (1)..(142): unsure at all Xaa locations
  Clone ID: PAT_TA_100603.pep
MAAKCYPTVKXDKYLAAVAKAKRKLRGFIAEKNCAPLMLRLAWHSAGTFDVATKXXGPFGNMKCPAEXXXGANAGLQXXXRXSNPIKGNFPTSPKPNFXQLPXILPLQGXRGAXGPFQPGGKGKXXPPPKRRLPXXSQGLTT

SEQ ID NO: 206186 - protein, 95 aa, Triticum aestivum
  unsure (1)..(95): unsure at all Xaa locations
  Clone ID: PAT_TA_100604.pep
XPTGXXXSFKVXXEXVPNLYAQXRTLXXTKVVFLAPRSPAAPKKFXXPVNGAEVDPSSPPGPRSQNPGGLGGFPPFGGLSLFFGEDFELKFPVSY

SEQ ID NO: 206187 - protein, 162 aa, Triticum aestivum
  Clone ID: PAT_TA_100605.pep
HGARPTRRTGRRGREPPPSFTRDITHVKARICRSWGREAGGGCARVERPINRRRSGSGCGLLCARQRRRPCAPDPARKSASPAPLTPLLLQPQGFLEEDAEERDEERRTDLDGWKEGVGPGEVLVCHPPLGLAGIGRHGSWRWQWRRVVAGERRRGEDYSSC

SEQ ID NO: 206188 - protein, 206 aa, Triticum aestivum
  unsure (1)..(206): unsure at all Xaa locations
  Clone ID: PAT_TA_100606.pep
MAVHVVPPLLLLLLATALPYTALAVFSPDFSFFLACGAGADVPFPSDNPTRTFVRDDGYLSQGRPAAVSASASSGAASNPLYAAARADSSAFSYRLAYPATAGASSFLVLRLHFFPFVPASSSTSLSSARFTVSVLDAYALLPTFSPPVAGVVKEFFVPRDGSKDFTIRFTPDAGSSAFVNAVELFSAPPXLLWNNTAVPVGSNDL

SEQ ID NO: 206189 - protein, 55 aa, Triticum aestivum
  unsure (1)..(55): unsure at all Xaa locations
  Clone ID: PAT_TA_100607.pep
XXXXXSCGDCVYISWIIELVASYCLVTHVLAVSLLYLRHMNCWWSHMYSGVRACV

SEQ ID NO: 206190 - protein, 69 aa, Triticum aestivum
  Clone ID: PAT_TA_100608.pep
IEEEIPGMDLYVPVMLSCKFHNTSVCVYPSYSFYYPLIVMLDSLRAEANNSFRLCAPYFSALCYCILLL

SEQ ID NO: 206191 - protein, 149 aa, Triticum aestivum
  unsure (1)..(149): unsure at all Xaa locations
  Clone ID: PAT_TA_100609.pep
MAEQPSATSSSAAAPPQVQVQAAAEPATELSPGAPASPHSPPVHLGDTVGTTTATALAATSSGEPSPRSTGKHPFYRGIRCRNGKWVSEIREPRKARRIWLGTYPTAEMAAAAYDVAARALRGSDAVLNFPGAAASRPVPASASXXXIR

SEQ ID NO: 206192 - protein, 161 aa, Triticum aestivum
  unsure (1)..(161): unsure at all Xaa locations
  Clone ID: PAT_TA_100610.pep
MEPPVAKKATQPEEEDRLSVLMDDVLLSILRKVDISTTVRTSSLSTRWRKLPWLLPELSIDVRHFLPVPCPDSITANDCQQAMVALTKAAKCLLAKPHRQSTITTLQLKLYLISTFLSDIGPLLGDVIDSGLLKDLDLCLLDDLKPGDSSELHMIQLAXXM

SEQ ID NO: 206193 - protein, 138 aa, Triticum aestivum
  Clone ID: PAT_TA_100611.pep
TRQQFISILTGHVNSASYFSMDAASFPSRLPMAACLRPAASAPVPATTPNRHGQRQQSPRRTAVCKCAPWHWELETCNIEGQQLRAEQLYTEPEVSEQQRATDLFSQKVQRSSFSTSDKVMSSYKFLQKFHTYKTQTE

SEQ ID NO: 206194 - protein, 119 aa, Triticum aestivum
  unsure (1)..(119): unsure at all Xaa locations
  Clone ID: PAT_TA_100612.pep
IASDPPRTPPHEFPNHSSPLHLAHSRKSPLGSPPSRTGLQLITRARFSEQGREKEEAMTEVALLRGPTNLASPASRSPSSSLRYLANADSDVLQXXGSGESPTGSXXRTERXXXXSXXX

SEQ ID NO: 206195 - protein, 105 aa, Triticum aestivum
  Clone ID: PAT_TA_100613.pep
GSHHRRRRRRHPHGARASYPVPSSTYHPTPSPAAGVWQRVGAAAATLLAVVLVAVALGRQRLRHRAPAEGIPALEDGCTVAHGIGSEAVDDLTDLIIVGAGVAGS

SEQ ID NO: 206196 - protein, 175 aa, Triticum aestivum
  unsure (1)..(175): unsure at all Xaa locations
  Clone ID: PAT_TA_100614.pep
MASRNHGPTPASSLATPLLSDSITPTTPTRAANGHARGHDGDDDLCAAASVCDGGDPFAFLSGDSRPPRPPGPSPADPFRNRTPWLGGPYGWARTLLLAPVAAARLVLFGLAIAIGYAATWVALRGWTDSRERPREGAGPMPAWRRRLMWVTRLSARCILFXFGYHWITRKXXXA

SEQ ID NO: 206197 - protein, 157 aa, Triticum aestivum
  unsure (1)..(157): unsure at all Xaa locations
  Clone ID: PAT_TA_100615.pep
ARGFFLSRTCRRDRTFRISKTDFRYSDLLDDIQSIDSLLLDLSTLRVATNDFGEGTMLGKGGFGMVHKGVLPDGKQIAVKRLCKSSKQGIGELKSELVLVAKLRHRNLVSLIGVCLEEQEKILVYEFMPNRSLDTILFDSXXCKDXXXXXXFKIISX

SEQ ID NO: 206198 - protein, 187 aa, Triticum aestivum
  unsure (1)..(187): unsure at all Xaa locations
  Clone ID: PAT_TA_100616.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAXXLXXG

SEQ ID NO: 206199 - protein, 199 aa, Triticum aestivum
  unsure (1)..(199): unsure at all Xaa locations
  Clone ID: PAT_TA_100617.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAXXLXXGNAXXXXXLIXXX

SEQ ID NO: 206200 - protein, 78 aa, Triticum aestivum
  unsure (1)..(78): unsure at all Xaa locations
  Clone ID: PAT_TA_100618.pep
DIITRDNLIYVCIILSPKFSNQKTFVKSNLFVQDTTGLAAILGEKIFQNDTFCPGYMMKLTLFVYQPTQITGQTGXSX

SEQ ID NO: 206201 - protein, 177 aa, Triticum aestivum
  unsure (1)..(177): unsure at all Xaa locations
  Clone ID: PAT_TA_100619.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFXXPGCEESGKXTS

SEQ ID NO: 206202 - protein, 201 aa, Triticum aestivum
  unsure (1)..(201): unsure at all Xaa locations
  Clone ID: PAT_TA_100620.pep
MMTSKVKVFGPGKSRNVARVLMCLVEVGVEYEVVDMDLKALEHKSPEHLARNPFGQTPAFQDGNLILFESRAISRYVLRKYKTNEVDLLREGNLKEAALVDVWTEVDAHAYNPAISPVVYECLINPLVLGIPTNQKVVDESIEKLKKVLEVYEAHLSKHKYLAGDFISFADINHFPHTCSFMATPHAVLFDSYPNVXXWWE

SEQ ID NO: 206203 - protein, 211 aa, Triticum aestivum
  unsure (1)..(211): unsure at all Xaa locations
  Clone ID: PAT_TA_100621.pep
HEELIQLERQMEQRDKALVLIARQLNMRLQAGEKLAEEDHQRLYAVMTSVRNILDEEGKRMKVPLLDLFKREQANSKELQENRQELIQGFENMPISGGAVVGIKRMGQLDENPFRAACNLKYRGNDPEGKAARLVSYWQEEIQXXSWRPFTNIQVDEEDKEVIDDNDPRLSKLRSDYGDNVCNAVKDALXELNEYSPDKRRIMNXXWNFRX

SEQ ID NO: 206204 - protein, 162 aa, Triticum aestivum
  unsure (1)..(162): unsure at all Xaa locations
  Clone ID: PAT_TA_100622.pep
VLRPYEQCPRLGARVLTYVHSGRRLYQRWSIMAGMLPGVECARRRRMWQGGGAGADQAAAGTRRLSFCLYAAGHGAAHAVGTGSSGSKQRSGAMDGWALDSNAREAKERLDQKLKSNGTGPDTVIKXHHSXXSIKVSXXNGXGGGGGXXGSSAXXAXXVXXE

SEQ ID NO: 206205 - protein, 210 aa, Triticum aestivum
  unsure (1)..(210): unsure at all Xaa locations
  Clone ID: PAT_TA_100623.pep
ARGEIKGPSPEMVEYLGMQNLINAVKESVGLSEGKLLFGFKANLCGKFVWGALDDVVMGGVSESAFQIQPTGSETGEATGLFKGTVSTSNNGGFTSIRTKNFTVPEDLSAYDGVELRVKGDGRRYKLIIRTSYEWDTIGYTASFDTTKGEWQSVRIPFSSLIPVFRARTATDAPPFDASNITALQLMFSKFEYDGKLNPTFAXXQFELPF

SEQ ID NO: 206206 - protein, 183 aa, Triticum aestivum
  unsure (1)..(183): unsure at all Xaa locations
  Clone ID: PAT_TA_100624.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAXX

SEQ ID NO: 206207 - protein, 178 aa, Triticum aestivum
  unsure (1)..(178): unsure at all Xaa locations
  Clone ID: PAT_TA_100625.pep
MSSDAAECSSMNTNAGEDDMTTEGGMLFFLNTERFPNQRMKIEMDQTITLSNLQKRLIVSVSWQDNGLKQYNLDSLDSLPEVYKIVLFTRRPQETCSLYACLEAFIKEEPLGPXXMWYCPGCKEHRQASKKLDLWRLPEILIIHLKRFSYSRYTKNKLDTYVDFPIHDLDLSSYIRDR

SEQ ID NO: 206208 - protein, 79 aa, Triticum aestivum
  unsure (1)..(79): unsure at all Xaa locations
  Clone ID: PAT_TA_100626.pep
MGAGRLLVLCLALCAAAAAAQRGIRRPRTVSVGALFTYESTIGRAARLAIELAVDDVNADRTVLAXXTLXXIXXXTNCS

SEQ ID NO: 206209 - protein, 109 aa, Triticum aestivum
  unsure (1)..(109): unsure at all Xaa locations
  Clone ID: PAT_TA_100627.pep
ARGREAAIGAAVRSAIGAAGGLIGSVVNKLSDKVVEAYVASSELGLNYKKIKQDLMLTQGLLHEARXGVSDNPGLQGLVQQLSGKADQAEDTLDELHYFIIQDQLDGTR

SEQ ID NO: 206210 - protein, 110 aa, Triticum aestivum
  Clone ID: PAT_TA_100628.pep
FAGTGYWICWIQRSFCCDRRRRHMSFCCNRYTIFMPSVICFATTLSFFATFLHPWRCLSMAAMAFFFDGIGKQFLIQPTSNFASTSIFFCWNLWIFFAGAYVFPEMQSNF

SEQ ID NO: 206211 - protein, 209 aa, Triticum aestivum
  unsure (1)..(209): unsure at all Xaa locations
  Clone ID: PAT_TA_100629.pep
ARGFDFPIQSADDVRNQNDLQASLCVLLRIIIHKLSNLVDNSIIPVAADNLMLLFFRVFNHRTCGSTVHDKAMLATGALAYAIGQDFEKHMPKLLLNYSEYQLTPVSLGVLGNICHVLEHQMLTSSVKVMDVFKKALSNPMLDRSVKPAIFSCFGDLALAIGEHFDGYLPTVMEMLKEDADLGIDKXXVGYRNQLXWAICXXYSGILNG

SEQ ID NO: 206212 - protein, 154 aa, Triticum aestivum
  Clone ID: PAT_TA_100630.pep
LQHRCIAAPTSSTSAASQHPVPLAAARVLHHAAGSTDEVCVASGHRGPPCRSAGGHRGPPRHRASFIDERCNAAPFAWSLGDIMLPRRSHRRPPHRRNGVTDERCNACGAWSRGACEAAALRADEAAGQRPLERVHGHGGESGERGAEKNRRDR

SEQ ID NO: 206213 - protein, 152 aa, Triticum aestivum
  Clone ID: PAT_TA_100631.pep
PSDWRWPSSCSPAATTTATLRMVLMPSSSPSPRFLHHQPPRAPTDLSPHSIFLGSHLGETPNSPPPEIFRRPHRWRLRPPRQLRTVPTGRPQPPELLGGLGFSNGAAVCWQASPERRLCSAKGEDTGGSPVKPDWWARGTHGQRVPRHCALT

SEQ ID NO: 206214 - protein, 156 aa, Triticum aestivum
  unsure (1)..(156): unsure at all Xaa locations
  Clone ID: PAT_TA_100632.pep
MDRSLSGGQTLLLLVVATLTLQHSATAYESESSGSIRMARPDCPDKCGSVSIPYPFGTGKGCFQEPFDVTCNATGPYLASTRVRILDINLAMGEIRVLNPHIAWECNYTNGTNSSGSDGLTLDPFHKLSNTKNKLISIGCATLGLIXATKLEFPIV

SEQ ID NO: 206215 - protein, 160 aa, Triticum aestivum
  unsure (1)..(160): unsure at all Xaa locations
  Clone ID: PAT_TA_100633.pep
MGVLFSCPVEDDGECGLVAAAAAAEEQQQATFLKASLGSGKLRIEGSLSFKRLQLVEPKIPVATXXAVTAPVPVPVPMPRELLRTRFADAAVAASAAPPESPKHEAAAVTLQXVYKSFRTRRRLADCAVLVEQNWWELLDFALLKRSSVSFFDIXXXXXX

SEQ ID NO: 206216 - protein, 169 aa, Triticum aestivum
  unsure (1)..(169): unsure at all Xaa locations
  Clone ID: PAT_TA_100634.pep
MAPTVMASSATSVAPFQGLKSTAGLPVSRRSSSAGLGSVSNGGRIRCMQVWPIEGIKKFETLSYLPPLSTXALLKQVDYLIRSKWVPCLEFSKVGFVFREHNSSPGYYDGRYWTMWKLPMFGCTDATQVLNEVEEVKXXYPDAYVRVIGFDNLRXXQCVSXIXXXXPGC

SEQ ID NO: 206217 - protein, 116 aa, Triticum aestivum
  unsure (1)..(116): unsure at all Xaa locations
  Clone ID: PAT_TA_100635.pep
VFFFFFFFFFFFFGPXIINWAATLHPPXGGALTTLNFSPESFGAFLYRDFFFTLTPSGETHPKIPLPSLIYPVMFKCFYHLFINPFHGFPPDLTPGAPNQLFXXKVAPFNFFFXHS

SEQ ID NO: 206218 - protein, 133 aa, Triticum aestivum
  unsure (1)..(133): unsure at all Xaa locations
  Clone ID: PAT_TA_100636.pep
KKKGTVGTPKGKRGGGHKTKRGFRSPPNPGGDQGVLPGGRKTKPCMLLALGGGSGARGKKTVAVGPAVNGDPITAVGGACVPLFKGGFFYPPFGKGVNIPPKSNXLGIWGGPAYPVDPPRGAXXGLXXISTSF

SEQ ID NO: 206219 - protein, 184 aa, Triticum aestivum
  unsure (1)..(184): unsure at all Xaa locations
  Clone ID: PAT_TA_100637.pep
MAQSMLMSGVNGVASGRSLLQAARPSSASTPFSRLALSSSSSXGKKTKAAPAKKVAAPKPKTEDGIFGTSGGIGFTKENELFVGRVAMIGFAASILGEAITGKGILSQLNLETGIPIYEAEPLLLFFILFTLLGAIGALGDRGRFVDEQPTGLDKAVIAPGXXFRSALGLSXXXPLFGFTKSNX

SEQ ID NO: 206220 - protein, 168 aa, Triticum aestivum
  Clone ID: PAT_TA_100638.pep
HPRPPRRSHPDDALDPAARARGPKPGQRRPRTAWIPAPHGGADGYEDEEGHHHYYDDADQSDSAAAAARAARVSGSREASVDESDGVADWGLPNGGAACYGGGGGVRAWLDGLGLSRYAPVFEIHEVDDEVLPLLTLEDLKDMGIGAVGSRRKMFAAIQKLRSTDTVS

SEQ ID NO: 206221 - protein, 170 aa, Triticum aestivum
  Clone ID: PAT_TA_100639.pep
MAAMAAAAARCMNAACGAPAPTAAGVGEWRKGWPLRSGGFAVLCDKCGLAFEQLVFCDIFHQKESGWRDCSFCGKRLHCGCVASKNSFDLLDSGGVQCVNCMKNPGAQPVPCQVAPKLFLPPQNNQLFGKSDEFLPGRPLESPSLMLDSRNDDIAIIANHPFVNLQSSIL

SEQ ID NO: 206222 - protein, 59 aa, Triticum aestivum
  Clone ID: PAT_TA_100640.pep
SSDQANWLQTSVREVFTCLAPPLPSPPFLLKVRQISAPLAANRLPEPTNCHRVLFVVLW

SEQ ID NO: 206223 - protein, 170 aa, Triticum aestivum
  unsure (1)..(170): unsure at all Xaa locations
  Clone ID: PAT_TA_100641.pep
MVPRLERGGGGGFQLPNSEQENSLFLRALISVVSGDTGAPALHPEPSNPPFAAAAAAPVPACGRCGADGCPGCEFAAAAAAATTGSSEGEECSAASFVRNGGVGKRRAGGSGSKFKGVRXXPWGKWAXXXRDPHRAVRKWLXTFDTDXXXARAYDVXXXEXXGHRAKLNF

SEQ ID NO: 206224 - protein, 78 aa, Triticum aestivum
  Clone ID: PAT_TA_100642.pep
MKTSTDLFGPNLGCPPGAGAGYLPPPSPQNLLGDGSGWFRSTTPPRNRIEEHTIASPPPGPHPGPLLSRRRRYEPPSC

SEQ ID NO: 206225 - protein, 175 aa, Triticum aestivum
  unsure (1)..(175): unsure at all Xaa locations
  Clone ID: PAT_TA_100643.pep
MFRPPWQHRRRPGPSRSAGKALPPPPSSSSMPPPCTPNPCRPSRTPSPXPTPPPSPLDGRHPRALRPMPPPSPHRRRPTPTLLTSHAATQSPSVMTYTSNPRRRPSPSXSTLQPCPHPEPPPHSSSTTLPQPPHHPCRCPNPPPRNLPIPFAIAASASHRIVARRLVSKEKVQVK

SEQ ID NO: 206226 - protein, 205 aa, Triticum aestivum
  unsure (1)..(205): unsure at all Xaa locations
  Clone ID: PAT_TA_100644.pep
ARGNDSSIVKRDEIPASPADNQSILVSLSSRCVWKEAICERPHLLRIKYYGNFDKPLGRFLRDELFDQSNCCLSCELAPEAHVYCYVHPQGSLTISVRKLIVKLPGEHDGKIWMWHRCLRCPRDKGLPPATKRVVMSDAAWGLSFGKFLELSFSNHAAASRVASCGHSLHRDCLRFYGFGEMVACFXYAXXQVHSVYLPPPKLDF

SEQ ID NO: 206227 - protein, 137 aa, Triticum aestivum
  unsure (1)..(137): unsure at all Xaa locations
  Clone ID: PAT_TA_100645.pep
PDAGLGVRKRLVADTKAQPAETLVCIYGGVYVVWIIELQCHVVHKYSRVVVLDFVGLVPQNPKIANALRDLLERTKGASVSRRLEEGVQGRSQVLSGPCDQTVRGQGSFVQALGRGQPLSSGQXXNGGAVWRESDAV

SEQ ID NO: 206228 - protein, 65 aa, Triticum aestivum
  Clone ID: PAT_TA_100646.pep
CAIGSCPFVTCLVRKILKGHESFYCEGKKPTSGDMMVGCEIKINQTKINHGYYSTNSSIRSRDSL

SEQ ID NO: 206229 - protein, 206 aa, Triticum aestivum
  Clone ID: PAT_TA_100647.pep
WQFQIKLERVFVIRSCVWFLYLGPSFIYLSCGKKGKTEKRLHKEKTEKTGHPQLELELVVGTTHGTVVEAQAGELVVLSVCQPARHAYCCRIQLAVSPLPLLSQLELPAMDLIKPLPNPAKKEKRYLGSLGRRASAPPEATAGLGDGATGIGSGGKGGEEEDSGGGERPDLPWLGWMRSACVRRGTNKEGRKAGECLVGVRCDADA

SEQ ID NO: 206230 - protein, 203 aa, Triticum aestivum
  unsure (1)..(203): unsure at all Xaa locations
  Clone ID: PAT_TA_100648.pep
GAVPVKKNDDEEVVCFICFDGGXXVVCDRRGCSKVYHPACIKRDESFFRSRGKWNCGWHICSSCEKAAQYMCYTCTYSLCKACVKQGKFFGVRGNKGFCDTCYATILLIESKDQDATKVMVDFDDKNSWEYLFKLYWLDVKGKHLLTLEELISAKSNWTVRSISARREKEESSGERYEANNDHNVSSDNSSRKRSTPTSFPSC

SEQ ID NO: 206231 - protein, 173 aa, Triticum aestivum
  unsure (1)..(173): unsure at all Xaa locations
  Clone ID: PAT_TA_100649.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQXILAIWACQVVLMGAVX

SEQ ID NO: 206232 - protein, 177 aa, Triticum aestivum
  Clone ID: PAT_TA_100650.pep
ARGRRRSLGTLPPHRLLRRPPSGATPEHPSHAGELTIKQQQPRRPPTLPFPRPFLLLSHLSVPRLHRDNGTPPARGMMPPQLDPHPPPSPALYRPSSPRIGRAGSRRCQILASPPAERSSLSPSREVGTTEPCMCRRPCGACGSTALRSGCRPAARPASNNTHGRRLRRQRSFSRMW

SEQ ID NO: 206233 - protein, 85 aa, Triticum aestivum
  unsure (1)..(85): unsure at all Xaa locations
  Clone ID: PAT_TA_100651.pep
DSLFFXVFFLLWGAPRCEKPYGTFSSSILGLFLLLSFSKREFSKKENPRFLNFPLEIFFGAVNIWVEGVCVCVFSLXXXFFFWFF

SEQ ID NO: 206234 - protein, 141 aa, Triticum aestivum
  unsure (1)..(141): unsure at all Xaa locations
  Clone ID: PAT_TA_100652.pep
MADAALLLVTKKIGKAVAAETLSYARPFLEKKSRSIKALPDKMILIKNDLELIRAYLKEVDRKGFTDLVTEIWTGQARKLAYDMEDIVDQFTYVVGKHHLDGAWWSFFTKSXXPFTLDEIATAVKRINXXLKRLXXCRDWT

SEQ ID NO: 206235 - protein, 206 aa, Triticum aestivum
  unsure (1)..(206): unsure at all Xaa locations
  Clone ID: PAT_TA_100653.pep
PVEYTTSEIIDGKPVNTVEGLKVYEGLVNVTEINKIVSLVNETKASSRRGGFEVGQTVIVGKRPLKGHGSVIIQLGVPIIEGPLEDENQRETTRVEPVPGLLHDLFDRFFRQGIVPFKPDYCVVDFYYEEEYSHPQQPPSWYGRPLCTLCLTECDMVFGRVIFGERGDNXXPLKLSLSTGSLVVLQGRSADVAXRAIPATRKQRIL

SEQ ID NO: 206236 - protein, 130 aa, Triticum aestivum
  unsure (1)..(130): unsure at all Xaa locations
  Clone ID: PAT_TA_100654.pep
MTHRSAAAGATGTGAFFLDSAEKDAVRIDTMHRRVALSGSGAAQRGSGPRRALSERVVATVESGVAVGSGEYLVDVYVGTPPRRFRMIMDTGSDLNWVQCAPCLDCFEQSGPVFDPAASXSYRNVTXXXX

SEQ ID NO: 206237 - protein, 72 aa, Triticum aestivum
  Clone ID: PAT_TA_100655.pep
ATDVGCLVIVLCCVHVGTSSMFMSNKHMICACALLYWPHWSWLIDLDYSLFLQRTISFSSQLKQQFILNSTS

SEQ ID NO: 206238 - protein, 162 aa, Triticum aestivum
  unsure (1)..(162): unsure at all Xaa locations
  Clone ID: PAT_TA_100656.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLXXRXXMQXXVKXLTX

SEQ ID NO: 206239 - protein, 137 aa, Triticum aestivum
  unsure (1)..(137): unsure at all Xaa locations
  Clone ID: PAT_TA_100657.pep
SDQRIPDDMEKNSHLKDLQALGPLEVLRADLVEEGSFDGAVAGCDYAFLVAAPVNLYAEDPERDVIEPAVHGTLNVLRSCVRAGTVRRVVLTSSAXXVSSRPLXXDGHVLDXXSWSDVEFLRSXKTGAWAYPVXXXL

SEQ ID NO: 206240 - protein, 104 aa, Triticum aestivum
  Clone ID: PAT_TA_100658.pep
SLDSLIIPKHHNFFKCTCIYACVGIARGTEGLVSFSKIKIYCVRALFTFLAPVKKGRVGERWTKDDDVRQKTEHYIFKVYCRRRIHYSYCQKDNSQRSMIILKL

SEQ ID NO: 206241 - protein, 129 aa, Triticum aestivum
  unsure (1)..(129): unsure at all Xaa locations
  Clone ID: PAT_TA_100659.pep
FNFNFAKNPFYVLNCCKSAPLSFFLLPPSPDPSTVRPPPARPWPRSPTAPLTCPWTSPPLGAAASPPAPAPPASSRSPTPTAAAPPRSPTPTVAAPXXPPHRRAPPPRRSPRRRRFLVPAATPAXXPSP

SEQ ID NO: 206242 - protein, 81 aa, Triticum aestivum
  unsure (1)..(81): unsure at all Xaa locations
  Clone ID: PAT_TA_100660.pep
WYKNHVWAWASTAXWFCAVSQKQAYAQATAEPKSGEVAPGLLQAEQVLAVLFVETGMRSKAYLSANNASTTHQVGLSLCQL

SEQ ID NO: 206243 - protein, 142 aa, Triticum aestivum
  unsure (1)..(142): unsure at all Xaa locations
  Clone ID: PAT_TA_100661.pep
TRERRKLHKMKRDYFRQHGGLILFDEMRSKQGITFKIFTEEELQQATNKFSEQQVLGQGGYGTVYKGLLKGDVEIAVKRCKTVDEQQKKEFGKEMLILSQVNHRNIVKLLGCCLEVKVPMLVYEFVXXGTLFQFIHGNHGMC

SEQ ID NO: 206244 - protein, 202 aa, Triticum aestivum
  unsure (1)..(202): unsure at all Xaa locations
  Clone ID: PAT_TA_100662.pep
MGLPMARGPCCCSPSSSSSSSSPWMLQAQLPKNPHPPLSGRSVCSESLRVLALHLLLNRRANLSRRWGDITRTAASSSGLLQITGNMSGCSPKIKVDAERTSLDGALDRNAQFDMIYEDMSSWMNGAHTSGNSLQYNLLMQNIHVLQSSLAAQDLVLLERDILVHIEQLGALKWFNASXSGATITHTSHAPALPWNDTEFAP

SEQ ID NO: 206245 - protein, 182 aa, Triticum aestivum
  unsure (1)..(182): unsure at all Xaa locations
  Clone ID: PAT_TA_100663.pep
MAASLQAAATLMPAKIGGRASSARPSSHVARAFGVDAGARITCSLHSDMREVASKCADAAKMAGFALATSALLVSGASAEGAPKRLTLDEIQSKTYMEVKGTGTANQCPTIXXXVDSFPFKAGKYEMKKFCLEPTYFTVKAEGIHXNEXXAXXXTKLMTRLTYTLDXXXXXLXXXXXXXLKF

SEQ ID NO: 206246 - protein, 109 aa, Triticum aestivum
  Clone ID: PAT_TA_100664.pep
SILAARNKTTASDSRKRLDANGKSSAPSTASPQLHKTNVSRGSTKMIEPISPNQAQTSGPNQNREHEGIVSKCVKARIPYADPDPDPLLTDQHRLVPTRGHPFKQGGEV

SEQ ID NO: 206247 - protein, 180 aa, Triticum aestivum
  Clone ID: PAT_TA_100665.pep
MFEALVAALLFSVLNYGINRATASGDGDFFHNCTPSRCSEEGTIEIRFPFRLATSPQSCGAPGLELACSREADTMLLHPILGLCKVTAIDYIFGGLNVIPLEESWTRCPLQKISTTNLSTSVYIPDSYGGETANLVRCSRELIPTEKAGTIPGMGDNIVGPISCLSNTSQFIYLMDGSEP

SEQ ID NO: 206248 - protein, 78 aa, Triticum aestivum
  unsure (1)..(78): unsure at all Xaa locations
  Clone ID: PAT_TA_100666.pep
TVTFVMTLLCRQCQICLTSHGNLFYLNSMADSYMHSCHDLSELVWPWYLLFYILFFKEEIYAWQNFFSAPWKXXFVXX

SEQ ID NO: 206249 - protein, 165 aa, Triticum aestivum
  unsure (1)..(165): unsure at all Xaa locations
  Clone ID: PAT_TA_100667.pep
MGDLPDLDRAQAAGAGRRDRLAALLELAAADDVDGMRAALEGAGEEAAELADDVGLWYGRSKAYEPRTPLMVAATYGSARVVSLLLGRAGWVDVARRPGGDGFTPLHCAASGGSCNAVQVVKMLLDAGADPATVDSTGRAPADVVRAHPASADAXXDLEILLGRR

SEQ ID NO: 206250 - protein, 174 aa, Triticum aestivum
  unsure (1)..(174): unsure at all Xaa locations
  Clone ID: PAT_TA_100668.pep
MVGGAMEDGAREVERWEGYVDWRSRPAVKGRHGGMVAASFVLVAEVLENLAFLANASNLVTYLMKSMHYSPAQSATTVTNFMGTAFLLGLFGGFLSDAVCTTYAVYLISAFVEFMGLVVLTIQARSPSLMPPECTKAAGALPCEPVSGGKXXMLFVGLYLTALGIGGIXXSLXS

SEQ ID NO: 206251 - protein, 65 aa, Triticum aestivum
  unsure (1)..(65): unsure at all Xaa locations
  Clone ID: PAT_TA_100669.pep
NYSTXARTFIQHWYKEMDXHKKNXGCPTKLQKXXKRRKNNTPPQKQLLTXXKXKIXGQTXXTKXX

SEQ ID NO: 206252 - protein, 209 aa, Triticum aestivum
  Clone ID: PAT_TA_100670.pep
PKCIGQQFGILQDLLERSDDAVQSTNDAMLYTLSKEELLELFETVSDQLSLVWSGFLKFHRTNKLKILDYLHDIWDVDRKSEWSIWIVHSKIEIPHRYMHGMGDSSSPRHSLRRVSSSKKLHHDPVQNASSRAELHRKSIAQMKINARSVQDMHIYANPSRVPVVLIEQHVMVVPQHGCNKDLLANAPDLYNTSVPPNLQGSFSPSGKN

SEQ ID NO: 206253 - protein, 123 aa, Triticum aestivum
  Clone ID: PAT_TA_100671.pep
MYGQGGGFNPHFRHAAPPPPPPLSQQPLPPPPPRPQAGVTAGFPQQSLPPPPPLAQYPQPPAMRPPPGQYHQHGMLPHQNQAYPYAHLGQMHHMPMLPGHMQMPGPPQAMYQPPPQYPMPVPL

SEQ ID NO: 206254 - protein, 66 aa, Triticum aestivum
  Clone ID: PAT_TA_100672.pep
CGSHSKPLYIVAFEIFRPTMCSNLYNWISKKNPESLLHKDKITRKGLLVISESYICFSPSVGSIPI

SEQ ID NO: 206255 - protein, 171 aa, Triticum aestivum
  unsure (1)..(171): unsure at all Xaa locations
  Clone ID: PAT_TA_100673.pep
MGAANSREDLDLTSSSGEEEEEDADEEYDPGSASGAKQRQDDPLRATTPASIEFLDAKLRALDLKYKQPDNAARLYLHVGGASADARWVPAERRATYAFLDKAVAVDDDDYYDDERRGRRSLSSASSRGPRWVLEVDPGRRVSAPVGQELQLKALPGQRRADFXAAGSVGA

SEQ ID NO: 206256 - protein, 82 aa, Triticum aestivum
  Clone ID: PAT_TA_100674.pep
MTVGMINANPVVHERPERAAHPAHAALDALDVFDTVRDIKDPEHPYSLEQLSVLSQESVSVDDKLGHIQYVCLQECAAQVSF

SEQ ID NO: 206257 - protein, 136 aa, Triticum aestivum
  Clone ID: PAT_TA_100675.pep
NPSKRSKTRGLRPYRRSKPSENPDAPPASSSFSSGAGGGEGPGIRADLGGNRAEERIKTKFIPGKGRGIDRSMSTGEAARGVEPGTDYRREAEEGPAAAGELLWWGGVSPSAGAERASERAPWLSCAPLLSSPASC

SEQ ID NO: 206258 - protein, 197 aa, Triticum aestivum
  Clone ID: PAT_TA_100676.pep
HEALFLSSQREEEEEARLVTPLPEWEVGRSRANKQHLGGWVGGRGDCFARPAPSFDPADRSQSNPIQSNNLLYFSSPAAGRRLRFAWTSHPVGWILESFSRSIHPSGPFSTQHIRLPSIEQEYIRSRLVPDMEHAMPTMAAESEGATTDDDVHLSPTSVSSGGGGGGGGPPSVRFKILCSFGGRIMPRPSDGALKYI

SEQ ID NO: 206259 - protein, 195 aa, Triticum aestivum
  unsure (1)..(195): unsure at all Xaa locations
  Clone ID: PAT_TA_100677.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDXXEGPLXXGADGTLKFXXXXGIDYAXVTV

SEQ ID NO: 206260 - protein, 173 aa, Triticum aestivum
  unsure (1)..(173): unsure at all Xaa locations
  Clone ID: PAT_TA_100678.pep
MPAPTPPRNQPKRRRPLALPAVCPCEGIAPEPLLASVVSLTADVASRRAGDASAFPVLRRGTRQAVRLAGLLLAFLEEIQDATATLSYSAVVGLTELHVAMQKMRFLLTDCARRGGRLWVLVNAELIASELKLCLGSVAAXXDVLPRCIVDASVESGELXRLVSDXXWVVGAA

SEQ ID NO: 206261 - protein, 67 aa, Triticum aestivum
  Clone ID: PAT_TA_100679.pep
GLYMCTYRDVSSLRYLSVVTISPRLASSDGSSGARARSYGGQGSSSPNLYIFHDCVLDRTQRKCGIA

SEQ ID NO: 206262 - protein, 47 aa, Triticum aestivum
  Clone ID: PAT_TA_100680.pep
TRIYTDHELKAMVERMESSELKTVNLTDNDLAKDHLRYFVSYIFLPQ

SEQ ID NO: 206263 - protein, 135 aa, Triticum aestivum
  Clone ID: PAT_TA_100681.pep
METGAKAPKKAGRRAGGGGPKKKSVSRSVKAGLQFPVGRIGRYLKHGRYAKRVGSGAPVYLAAVLEYLAAELLELAGNAARDNKKNRIIPRHVLLAIRNDEELGKLLAGVTIAYGGVLPNINPVLLPKKAAAAAT

SEQ ID NO: 206264 - protein, 145 aa, Triticum aestivum
  Clone ID: PAT_TA_100682.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLG

SEQ ID NO: 206265 - protein, 143 aa, Triticum aestivum
  unsure (1)..(143): unsure at all Xaa locations
  Clone ID: PAT_TA_100683.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGXFYIAPXXMDKXXVHLSKNFMTLP

SEQ ID NO: 206266 - protein, 125 aa, Triticum aestivum
  Clone ID: PAT_TA_100684.pep
AGRLVHPTMHATLGHVLEESRCSRGGGQMWRRVLSGHRTQAAAMDLAARLGSWWTGSRAREDREAAEETGDARSRRRSSVYGQPWLRELRALSTGGYGCRSSELGWGWILAQFKSGCHWEREASC

SEQ ID NO: 206267 - protein, 107 aa, Triticum aestivum
  Clone ID: PAT_TA_100685.pep
LISMPPNPLPAPEIDSQTTKVSSNNPILFIHRINHREKLRRARRARRRGRWRCRGAGRRAGTAVAAFGADAARSSVVGGRGAAGTQVGVGVGRRELGPAQLGGRTLV

SEQ ID NO: 206268 - protein, 184 aa, Triticum aestivum
  Clone ID: PAT_TA_100686.pep
TPQTPKPRSGCKLRHGSPVPTSGLPPPSRPASPLSRSSAPRSGILCPRLGNRRRQPYRTCRRTTRGSAPTRRGSASASRPPQRRDEQVPLPPAPSGRASPGGERRRRRGEGRSGGGREFDQGILQPWLPIEDLDGVVMNQTMKSPFSRCFQLFPPNVCFYFNFFQANRKECLHVSAKSVYGGEQ

SEQ ID NO: 206269 - protein, 201 aa, Triticum aestivum
  unsure (1)..(201): unsure at all Xaa locations
  Clone ID: PAT_TA_100687.pep
AAKAIAKWGRQATDITHLVVGTNSGAQAPAVDLRLASLLGLRASVCRTMLNLNGCSAGAASLRLAKDLAENNRGARVLVACVELTVVAFHGPEEAYPHKLISQAVFGDGAGAVIVGADAVHPIERPLFEMVSASQTTIPATDGVLTMQLTEAGLDGHIFTXXXXPLAAQHIEQCLMDAFQQLGIMNXXTNWNDLFFXXHPG

SEQ ID NO: 206270 - protein, 184 aa, Triticum aestivum
  unsure (1)..(184): unsure at all Xaa locations
  Clone ID: PAT_TA_100688.pep
MAAQSWNPFSCCVRGAAVDDDDHRESRRGNKGSPRSPLKSLSSSGTLSPEELSLTLSGSNLHSFTYAELCAATASFSRANYLGCGGFGPVYKGAVNDKLRPGLAAQAVAVKYLDLECGTQGHQEWLAEVFFLGQLXHKNLVKLIGYCYEDEHRMLVYEFMSAGSLEKHLFKSISGSLPWMTRMK

SEQ ID NO: 206271 - protein, 110 aa, Triticum aestivum
  Clone ID: PAT_TA_100689.pep
MSRGRVRRAAGSPVAAALVLLQAAVLALSPGCDAAAVTTDAEPDYREALSKSLLYFEAQRSGRLPYNQRVRWRGHSGITDGLQQGVDLVGGYYDAGDHVKFGLPMAFTVT

SEQ ID NO: 206272 - protein, 142 aa, Triticum aestivum
  Clone ID: PAT_TA_100690.pep
ARGKTLPFSASPFLSKSNLNLSPAPPPPASAPHATPQHPPLRTGARRRRHRLFPLPPSPRRISSTHSLARDAGPRAPTGRQIDSYTNSCEPERGTSPPAAVGVERSVRRAFGGRGRALPPGGGDGSGGGGGAADGEPAGGAD

SEQ ID NO: 206273 - protein, 61 aa, Triticum aestivum
  unsure (1)..(61): unsure at all Xaa locations
  Clone ID: PAT_TA_100691.pep
GNLPCARXXASKMLLGPQRFFLFTNERXSNXSGTGKVMCPTCLCPGMAMASGHDPRKDPFD

SEQ ID NO: 206274 - protein, 70 aa, Triticum aestivum
  Clone ID: PAT_TA_100692.pep
MRRRGGGGGRQQQQYKGVRMRSWGSWVSEIRAPNQKTRIWLGSYSTAEAAARAYDAALLCLRGSAADLNF

SEQ ID NO: 206275 - protein, 90 aa, Triticum aestivum
  Clone ID: PAT_TA_100693.pep
SEILGRPFWRVLGPSDCLIWLTASGSFLLRYWIKIWGGLDFASLNCLLAIHSFMPFLFFFVLYSPFKVVWPAGQGVNPARVSHPACMPQP

SEQ ID NO: 206276 - protein, 61 aa, Triticum aestivum
  Clone ID: PAT_TA_100694.pep
DNDEAGDDNGDAGIVNANKRHVPAPAQRIIVQTTSEIDLLDDGYRWRKYGQKVVKGNPHPR

SEQ ID NO: 206277 - protein, 125 aa, Triticum aestivum
  Clone ID: PAT_TA_100695.pep
RPPRARPPSLLSNPSPPPVPSPSLAPRGRPSGRRRLGDFRGTPTLTPLPPIKVSPPPPVLHQPPPHRRSNNPSRVIRPPHPTPPPPHSQASAPRVRRRVANPLPRAPAPSAPAGAGGIPVPCLLL

SEQ ID NO: 206278 - protein, 61 aa, Triticum aestivum
  Clone ID: PAT_TA_100696.pep
FSPSFYSVRRHPSSITDGCLRSNFGSPAFHRASDGRSCSCLEFHCLINLILSPIGLAKLRD

SEQ ID NO: 206279 - protein, 125 aa, Triticum aestivum
  Clone ID: PAT_TA_100697.pep
HDDLTHHGCPPQALFLTDSRVLRGGRFGCDGDLMLPRDCYGDPMLRQDLDCSGDAATAPPRRAATAVNIWTASSCCDSCCDDISATAAQLLQQRFKLLRRCLRRCRRCCDYAVLLRASAATIIDK

SEQ ID NO: 206280 - protein, 154 aa, Triticum aestivum
  unsure (1)..(154): unsure at all Xaa locations
  Clone ID: PAT_TA_100698.pep
KTTCHEDTTSTDGSSTDEYDPWNPPYPPPCPPAVENSLSDSIRLAAKWLREKEAAVGAVRASSIIFPERIPKEVNHLFHDKVHHLAPILDKDSVRRFLSYMERNGQGMRWGSIITPXALNHMISQDAVKCVKIVLEGQAPELDGCRAGPNCMNQ

SEQ ID NO: 206281 - protein, 121 aa, Triticum aestivum
  unsure (1)..(121): unsure at all Xaa locations
  Clone ID: PAT_TA_100699.pep
MRSRRPPPAATRAVLFLLALLAAWGAATADLASDARALVAFRAAVGQRVAWNVADPTTVCAWTGVTCEGGRVAALRLPGAALAGPVPAGSLGNLTALHTLXXXXNALRGALPSDLAPMAAL

SEQ ID NO: 206282 - protein, 122 aa, Triticum aestivum
  Clone ID: PAT_TA_100700.pep
ERSRPRPRPPRRPRLATRGKDLAAARSRAAPEDGDGGAASSSSPPPDPRQSSIWPGPPPPSPPSRAPTGGPAGEAAARPELVPVRSRPAPRHARAPPPPPLGSDLALCGRAPPPTAAVRLPV

SEQ ID NO: 206283 - protein, 56 aa, Triticum aestivum
  Clone ID: PAT_TA_100701.pep
SFKLLFALLKIMLLILLDPYANFANFIIPSRQRVQKMPLNSSLYRNCWILELQITC

SEQ ID NO: 206284 - protein, 161 aa, Triticum aestivum
  Clone ID: PAT_TA_100702.pep
HEGGRPPGSGAPAAPGPRSGSAASDPDLSPAATAPSTPVESATRSASASPAPDPGSSTASAGTAASSPAAMAPPTPVESVAWAGSASPAAGPGSSTVSLPAPPTPPTPPAPRAAPDTRMVTRARAGIHRPSNHYPVDEYLLAASTSAPSPLPSSARAPFTT

SEQ ID NO: 206285 - protein, 98 aa, Triticum aestivum
  unsure (1)..(98): unsure at all Xaa locations
  Clone ID: PAT_TA_100703.pep
TGGRQRRSSQGATSHRRTKEGGALQRELIRFLNAGAFGTGTDGHVLPAAATRAAMLVRVNTLLQGYSGIRFEILETIATLLNANVTPCLPLRGTITAX

SEQ ID NO: 206286 - protein, 174 aa, Triticum aestivum; identical to SEQ ID NO: 133468
  Clone ID: PAT_TA_100704.pep

SEQ ID NO: 206287 - protein, 60 aa, Triticum aestivum
  Clone ID: PAT_TA_100705.pep
STSRDNHTQILAWFACLTHAPIIVYCNTTATTHSLSKLSTATMEPSAVSRQQPGHNCRLL

SEQ ID NO: 206288 - protein, 86 aa, Triticum aestivum
  unsure (1)..(86): unsure at all Xaa locations
  Clone ID: PAT_TA_100706.pep
MLHLLSCDVNKVSTSTRHQLIGIKQRDTGLAPPSQWDLVPDKQMMLXXQPLXRCTEITSPNTDDAKCHKKQIAXXCHHCTISHLLP

SEQ ID NO: 206289 - protein, 119 aa, Triticum aestivum
  Clone ID: PAT_TA_100707.pep
RALLDPRPPRSTSPSHRHPQEPHELHPRPDPLLPMLFVWPRPPAAVTLPARCRSSPLPTPSPPFHSTTTKDPAAGSIARLLPFPLCCSTSSSSPSSLPRASTLRRPRRPPCLALASSSA

SEQ ID NO: 206290 - protein, 155 aa, Triticum aestivum
  unsure (1)..(155): unsure at all Xaa locations
  Clone ID: PAT_TA_100708.pep
XXXXXXQGVKPXXXPMTXQSEKWSTARFHRCPPRRCFGRSGATAPVPMTARHTNPPTPPPKKSQLSDQITARHRSPRLPSQIKNQRGPKTEGLDSAGVTRARSRPVCLPVNQCGWSKMGEGQLMWGAAALDQHQDLGEEECARLGKGVGKKKPRA

SEQ ID NO: 206291 - protein, 98 aa, Triticum aestivum
  Clone ID: PAT_TA_100709.pep
KLSKKEKPGWTEVYSPKSLTSVDHGAVPWRQLLVTKWQIRAKPPPQALLVVMHLACCSRPGENPGAPRDIQAAGLLDPTTRAMFFPGRRIQRREAQPP

SEQ ID NO: 206292 - protein, 132 aa, Triticum aestivum
  Clone ID: PAT_TA_100710.pep
KRKAKKKKTDQGSRGVKRFSGSLLVLARTRKRTLHASKAEAEEEDEKMVSRNPFLPDLIATKRGPGGGEIGREILPAVAGVAWVLRRVCCVWVWGKIAQPRRGSGVSGSWVVGRGWEGRGCACLVMVWCGVG

SEQ ID NO: 206293 - protein, 164 aa, Triticum aestivum
  unsure (1)..(164): unsure at all Xaa locations
  Clone ID: PAT_TA_100711.pep
MPPSLSSLRSLFTRTLGLGSGGAEHSGDEESQAGGGPVPSGGSRPVAGPPGECYACTQPGVPAFHSTTCDQVHSPGWDADAGSSLVPVQAQQLRAQPLPGAAAVAAARWLFGPVLDPRSKRVQRWNRWILLGRAAALAXDXLFFYALSIGRXXXXXMYXXXXLA

SEQ ID NO: 206294 - protein, 146 aa, Triticum aestivum
  unsure (1)..(146): unsure at all Xaa locations
  Clone ID: PAT_TA_100712.pep
MVDEPLDPPPPTPAAAAPPTPLLRPRREAFEHGLLPIPKLIFPEGTLAQTLSQLKEKLAPAAAAAGDGRVGAASLAEALQIPPDQAALAIGMLAAXXPAXXPALXXGGSGGGADLRDVLLFLYIQSXXRLVXXPHKDSPAVADXWX

SEQ ID NO: 206295 - protein, 180 aa, Triticum aestivum
  unsure (1)..(180): unsure at all Xaa locations
  Clone ID: PAT_TA_100713.pep
MPPPTPVPSLPEELLEEVFLHLPPDEPDHLVRASIASKLWLGLLTGARFRGRYRDFHGAPPMLGFLYTLPFLCSSPLSTDPRPHFVSTTKFAARIPDDLREYDAQDCHHGRVLLRYKMLFIWNPMTGCSTELPPSTEYMEAESSGAAVLCAVTCCDHRACHEGPFWVVFVYLDXXXEGVC

SEQ ID NO: 206296 - protein, 154 aa, Triticum aestivum
  unsure (1)..(154): unsure at all Xaa locations
  Clone ID: PAT_TA_100714.pep
MLRAAAAAAAAFPARFAAVPAVPAAEEMRSPLLRVFGSLRGGRSSVMGRRARFCSSSCGSDSXXAAAAAAXXXXEDAVAGEGEAEGKPCSXXXSTNPXXXXFLSVIAXXLAQRPLFXXFYMPIYVKDQKXXQALIENRKXXXPYXXXFLVXDEX

SEQ ID NO: 206297 - protein, 185 aa, Triticum aestivum
  unsure (1)..(185): unsure at all Xaa locations
  Clone ID: PAT_TA_100715.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAXXGINPIMMSAXXLX

SEQ ID NO: 206298 - protein, 84 aa, Triticum aestivum
  Clone ID: PAT_TA_100716.pep
DKFANYGVQARARKCQARCHAIQALAGWCVPLGLWAPYLLVDYIRWAKAIVQTLHGWRCTVHHCAPAPQQGKKAPCKSLTRNTW

SEQ ID NO: 206299 - protein, 58 aa, Triticum aestivum
  Clone ID: PAT_TA_100717.pep
INFFMQQITFMHRCILAYTNLTFMLMLLLFMNTSFTLGHDGKSFKTSKRVRLLIVLFL

SEQ ID NO: 206300 - protein, 175 aa, Triticum aestivum; identical to SEQ ID NO: 133536
  Clone ID: PAT_TA_100718.pep

SEQ ID NO: 206301 - protein, 97 aa, Triticum aestivum
  unsure (1)..(97): unsure at all Xaa locations
  Clone ID: PAT_TA_100719.pep
MPFQLKPGHHHGAMDGKPPPPPPTLAPAPTPPAPPRVSRLRRLLVRVSASERLAVAGDGKEREKEERPAAGGXXEVGSVGLDRMVLSFMEDSXXXAR

SEQ ID NO: 206302 - protein, 142 aa, Triticum aestivum
  unsure (1)..(142): unsure at all Xaa locations
  Clone ID: PAT_TA_100720.pep
SLIPFSSGFLPTWTRFCLKPNTSYMFDRSLVHVAIFLFPFIYLKCVHFIEHIACNVCMYTVVLAAACHDRLSPTTDKSRPILGCPARLAAPHLPGHLSDVYMXPRMHGTFFFFFDEYMHGTLVQAPXVEXAPDSSPGMIXXT

SEQ ID NO: 206303 - protein, 152 aa, Triticum aestivum
  Clone ID: PAT_TA_100721.pep
MPEDDASFLLCAEDAFFFVDAATASTCTTAEQIGGWCSGAEEESAAASFVAELIGGEADYSPRSDYSDRLRSRSVDPAARADSVAWTLKVQEYYGFLPLTAYLAVNYMDRFLSLHRLPVSSPPGARRPRPATSPTLNTHISPCQTTMSRAYQ

SEQ ID NO: 206304 - protein, 118 aa, Triticum aestivum
  unsure (1)..(118): unsure at all Xaa locations
  Clone ID: PAT_TA_100722.pep
XXXXPLFTHSLALVDFTTPLPEYQSYFRYACDVQRERGAERGRASEDGTAERNQCRRVSVVGKKRSWWRGQRGRERESANGGKRAEDSFLSVWCWALSRSAPLAWRFLCLFGARFALF

SEQ ID NO: 206305 - protein, 158 aa, Triticum aestivum
  Clone ID: PAT_TA_100723.pep
MGVPAFYRWLAEKYPMVVVDVVEEEPVEIEGVQVPVDTSKPNPNGLEFDNLYLDMNGIIHPCFHPEDRPSPTTFAEVFQCMFDYIDRLFIMVRPRKLLYMAIDGVAPRAKMNQQRSRRFRAAKDAADAAEEEEKLREEFEREGRKLPPKLQSQTCDSN

SEQ ID NO: 206306 - protein, 89 aa, Triticum aestivum
  Clone ID: PAT_TA_100724.pep
GATGASGMPLAQAENKTTKLIIILLYASDQTCMDPHTEPKGLERYVFVLLFRLAKHMGTTIVNYVNTWEQPGQEGIVILACGERLIMPT

SEQ ID NO: 206307 - protein, 204 aa, Triticum aestivum
  unsure (1)..(204): unsure at all Xaa locations
  Clone ID: PAT_TA_100725.pep
HEAAEAAAAVDFDGMLAVYEGFCNLKQINLKVKICKGSSVRKALVREATLFGASKLVLGITKRKRTIGSSLSVAKYCAKKLPAKCAVLAVNGGKIVYRRESNAHSGKVSAEVPACGDDEMYCVLPFGARQKGEEESELPCDEPSKDGSPDDEEQHDVGAKGSQPEDVVAEEQQPSSVEPAELSTXXXQTEAADPADRDKEPTMS

SEQ ID NO: 206308 - protein, 100 aa, Triticum aestivum
  unsure (1)..(100): unsure at all Xaa locations
  Clone ID: PAT_TA_100726.pep
LCFLHASVVSFSKRXXKHXXSAYSHCIVFNIQCKHTMATKGKKSIGAKHNRKQTRYKRDSCFYNFITEPPSKMVEHSLSDHNFLGXXCSLIKFIYDIVLF

SEQ ID NO: 206309 - protein, 47 aa, Triticum aestivum
  Clone ID: PAT_TA_100727.pep
FFYLKVLWGLFLGELLNLGNRFQFGKMLCNVVWGPPVLFSCQSFMVP

SEQ ID NO: 206310 - protein, 61 aa, Triticum aestivum
  unsure (1)..(61): unsure at all Xaa locations
  Clone ID: PAT_TA_100728.pep
NPXXXPXXDLKXDPLLNPELKPEPMLNPEPNLDLMLNREPNLDPEPNRDPPPKGNPPMTAN

SEQ ID NO: 206311 - protein, 198 aa, Triticum aestivum
  unsure (1)..(198): unsure at all Xaa locations
  Clone ID: PAT_TA_100729.pep
TRVVLPCAQRRKGSETKKLMAGAESARPAPPVLPWTVRLQVLALGAFCDLSQRRDGTVNRSLFSLADRQTSARPRPDALGVRSVDVVVDPARSLWARVFSPSADNAEATPLPVLVYFHGGGFALLSAASAPLDAMCRRFCRELGAVVVSVNYRRAPEHRYPAAYDXXADVLSYLATTGLPADIGVPVDLSRCXXXGXX

SEQ ID NO: 206312 - protein, 127 aa, Triticum aestivum
  unsure (1)..(127): unsure at all Xaa locations
  Clone ID: PAT_TA_100730.pep
PPSPRPAPPHLNPTSSLHPNPTRHPHKSGETPXASGGKREKQLKRNTARAGGRAAAGDRPGGLADSXGWGPIPAPAXXPRAIPAPAPAGMTAPAPXPPGXSEPAXSGRRGGGGGGGLFGGLRRRLVL

SEQ ID NO: 206313 - protein, 82 aa, Triticum aestivum
  unsure (1)..(82): unsure at all Xaa locations
  Clone ID: PAT_TA_100731.pep
MEENLGGFETQYFLLYYIQXXIHRAVEAQGPRSCXLQQLTYAKTDFTVLPKHVLPYGGSFFFNIAGPRSCYLSLYGAYDSPS

SEQ ID NO: 206314 - protein, 100 aa, Triticum aestivum
  unsure (1)..(100): unsure at all Xaa locations
  Clone ID: PAT_TA_100732.pep
MNHPKPPGGTPLLTPSPKKKKTPPRPTEPPLCRQPPLPXVLNYRGQNLDPHPPPFPTXSPPPWFKIPPLTPPFPQGGPPLLVPTPEAPPFLSSRGQKKKT

SEQ ID NO: 206315 - protein, 91 aa, Triticum aestivum
  unsure (1)..(91): unsure at all Xaa locations
  Clone ID: PAT_TA_100733.pep
GRAPVPQRDVLRHRAVGCFLTHAGWNSTLEGIAEGVPLACWPFFADQQINSRFTAAVWGTXLDMKDVCERAVVERMVXXXMESGEXXXXAX

SEQ ID NO: 206316 - protein, 93 aa, Triticum aestivum
  unsure (1)..(93): unsure at all Xaa locations
  Clone ID: PAT_TA_100734.pep
MPPRPTPAPGQLPRPRPPPLMPVAKRPPAPWALALPAGRRARARLCLRLXXXXSFLLLLTAFLRTQPPXAXXDALPPSAGPGKVDLXFLDRAG

SEQ ID NO: 206317 - protein, 48 aa, Triticum aestivum
  unsure (1)..(48): unsure at all Xaa locations
  Clone ID: PAT_TA_100735.pep
SPXKGLWXXFKVCLPYVHVVGMVVFNQIKGFQVLLSYKSKGGLQCFHF

SEQ ID NO: 206318 - protein, 121 aa, Triticum aestivum
  Clone ID: PAT_TA_100736.pep
HEAGWERRLHRPPLPTSTTTSLSAPARGERRSGGAKEGASCLHGCTCSPSSTVAVSTCPSSTTSSPVSRRRAQSWRTRGRSWRTRGMELLHVHLKSRMSWLSICNCFFSLKFLQLVIVHSL

SEQ ID NO: 206319 - protein, 186 aa, Triticum aestivum
  unsure (1)..(186): unsure at all Xaa locations
  Clone ID: PAT_TA_100737.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPXMMSAGELXX

SEQ ID NO: 206320 - protein, 87 aa, Triticum aestivum
  Clone ID: PAT_TA_100738.pep
TRSASDLPAEDVKETEAINGSTVANTSKLSEDVTSNVVLADEAALEEHVIATEATVDIPEAQEPELEETKSTELAEVEENIFREPSC

SEQ ID NO: 206321 - protein, 70 aa, Triticum aestivum
  Clone ID: PAT_TA_100739.pep
LSPFLSISATSNSGRREYLSMEGVCRAELILNQTNYYVLPLSGITRHVKWMYLDIFLVIDTSISIHLCDK

SEQ ID NO: 206322 - protein, 158 aa, Triticum aestivum
  unsure (1)..(158): unsure at all Xaa locations
  Clone ID: PAT_TA_100740.pep
PRPTRCPAPIPRASPDPVVXPPPPXPPPPPPPPAXPPSPPPPTPPSGAPPSPPPPGSPPPTPPSGAPPSPPPPGSSPSLPPFTAALRFPGPLHPPSPPLLSLPARHRRPAPPPPSSGPPAAAPFHFPTSSGDAPALPVPNPAXYAAXXRNRSPSPATC

SEQ ID NO: 206323 - protein, 131 aa, Triticum aestivum
  unsure (1)..(131): unsure at all Xaa locations
  Clone ID: PAT_TA_100741.pep
MDYSTSLLRLTFLALGAALVLIVARSAFRLPLAIDAPAASFLHGAGGCTRFSPWACRSPRTEKSTPRRPSHESDVPRHPLDPLTVTEVSRARDLLRAHPPFASAPSALAVHALALDEPDXPXVRRWRKAHG

SEQ ID NO: 206324 - protein, 58 aa, Triticum aestivum
  unsure (1)..(58): unsure at all Xaa locations
  Clone ID: PAT_TA_100742.pep
MADLAVGLSKXVVAEALTKVQSAIDEDNKLRHKAQRDLVTITLEFEMMQSFLNVXXGG

SEQ ID NO: 206325 - protein, 58 aa, Triticum aestivum
  Clone ID: PAT_TA_100743.pep
FFFLCTQQANFFYLFLSVKTNERARSWGQANTSHAARKKRDLQERNEIHSFLLLCIHI

SEQ ID NO: 206326 - protein, 89 aa, Triticum aestivum
  unsure (1)..(89): unsure at all Xaa locations
  Clone ID: PAT_TA_100744.pep
XXXXXXAGSNPRRSGGRSWSAPREARDRHQGGGLVPAPAEQRRGHPAPHHGRRLRGGLRRKKQRKAELAGDFRSGKIVGFRRWSRRAFP

SEQ ID NO: 206327 - protein, 196 aa, Triticum aestivum
  unsure (1)..(196): unsure at all Xaa locations
  Clone ID: PAT_TA_100745.pep
TRAAPSFPAPTPPALSPTHRRPRSQNPLVDAPPPCPLPSPAPPSLPTXQIEPARRQRPWFWLLSGRIPPSPRRLHTRMDALPADAPPXYPAPPAPHHLPSPSPPTSPSSASPTTTRDPPFPDDHAGGAGPRRRGRGRRLVPPQPPPPQXSPPPPTPTPLLPRSLSPPRPRRRXRRCSASSTPAAXSSPDPPPASFP

SEQ ID NO: 206328 - protein, 97 aa, Triticum aestivum
  unsure (1)..(97): unsure at all Xaa locations
  Clone ID: PAT_TA_100746.pep
LQSFTRLYKGQSSCLLNATTLHHTTPWGAQXKKKKSGEPSGXVPIDILGLPHVVIKGGLPAVKLGXXXVPREXPIXLPQPLDANVHDLLEHVXLLXX

SEQ ID NO: 206329 - protein, 191 aa, Triticum aestivum
  unsure (1)..(191): unsure at all Xaa locations
  Clone ID: PAT_TA_100747.pep
MSSLRHAMPVVLVLAHAVLALALQGVAAGSGEVPAVIVFGDSTADTGNNNFIQTVARGNYAPYGRDYAGGVATGRFSNGRLPADLVSEALGLPPSVPAYLDPSHTIHHLASGVSFASAXSGLDNITAQIPSAMTLGEQIDHFRQYTERLXRAXXXXAARRIIAGALYIFSIGASDFLQNYLVFPVGYSFTP

SEQ ID NO: 206330 - protein, 71 aa, Triticum aestivum
  unsure (1)..(71): unsure at all Xaa locations
  Clone ID: PAT_TA_100748.pep
IIXXXXYCTLFITTTIRSTTVWQRLVTTIHHSRNNFITFXVSVYKKNHKFSSYSQRAKRQLDNFHPAPVLQ

SEQ ID NO: 206331 - protein, 193 aa, Triticum aestivum
  unsure (1)..(193): unsure at all Xaa locations
  Clone ID: PAT_TA_100749.pep
MWEWDATSLAGALKSAATCRSTPHVKPLHAVLLKLGLSASAILATSLAHLALRCGLPGYARALFDEMPRRDVVSWTSLITGHAHQGLHGDSLALLRRMVESGVAPNGYTLSGGLLACAGVGQGALAAGKEIHARVVKMSMYGPVDSVVENXXLDMYARCRNVDYARRVFGVMVXXDIVAWNSMMAGYXXSGQA

SEQ ID NO: 206332 - protein, 122 aa, Triticum aestivum
  unsure (1)..(122): unsure at all Xaa locations
  Clone ID: PAT_TA_100750.pep
PPPPPPPPPPAGLPLPPPPAAGPGPPRGSLRCLVSVSTPHVPNPVLFWSTAPSSPPLASSCFRRPAPEKRQXGRPEPGPRPVARHPERGRDGTAAERAASRRGPRRRSRGGGHGGGARDMPR

SEQ ID NO: 206333 - protein, 172 aa, Triticum aestivum
  Clone ID: PAT_TA_100751.pep
PSQRRVSSNRSLRRRWISVRQRRSIQRQGARKTKKANALPEREGKVPGEEEVEGEVSNSSPASPPELATTPPPAPLQCHCASAPMPVHPEETAPVPAPWPPAPVPPAPLPLARERLIGSRGEGEASAPPSPPRRPSAMAAAAGPRRPRRARTRAAAISCLGSGVWIRWGKPR

SEQ ID NO: 206334 - protein, 44 aa, Triticum aestivum
  Clone ID: PAT_TA_100752.pep
FFFCYKRQTLFNIPSDTKDGTGESHHVTSLHSFNKEHIYAQHFL

SEQ ID NO: 206335 - protein, 171 aa, Triticum aestivum
  unsure (1)..(171): unsure at all Xaa locations
  Clone ID: PAT_TA_100753.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFXXGXXDYLGNPNLVHAQSILAIWAVXXVLMGFIEX

SEQ ID NO: 206336 - protein, 89 aa, Triticum aestivum
  Clone ID: PAT_TA_100754.pep
GNKQPHPHFLFTFLKQTKIKTMIPPEKPTIHSFGSKSKPTTLHPTLNKPPFKLTPLTIIPPRPPSNRRKESALKKNRPAAPPGWGFLGR

SEQ ID NO: 206337 - protein, 112 aa, Triticum aestivum
  Clone ID: PAT_TA_100755.pep
KDIFRCETSRSMCLQTLPCNASSCYMQTAIFEGEELKCFLFLSHQAFPLKLHSGTPMLWRVAKLRNGPGTTTQLLLDDTFCYSYCFDGATKYRRSSEDQPTKQSHEYDPEIC

SEQ ID NO: 206338 - protein, 158 aa, Triticum aestivum
  unsure (1)..(158): unsure at all Xaa locations
  Clone ID: PAT_TA_100756.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIXKLADNCTGLQGFLVFNAVGGGTGSXXGSLLLXRLX

SEQ ID NO: 206339 - protein, 130 aa, Triticum aestivum
  unsure (1)..(130): unsure at all Xaa locations
  Clone ID: PAT_TA_100757.pep
YPCVDSPYCCCSSCRANMANVLAHAFQAAQENHAVAEETFRLCDEDRLSEVFRKVRRSIEQHPHSKQADTTCCVSAERISHDSYPSSDDGDVPEWHLHFSNQXXPLDGTGKPQLHYPAHMYMEMXXLEXE

SEQ ID NO: 206340 - protein, 183 aa, Triticum aestivum
  unsure (1)..(183): unsure at all Xaa locations
  Clone ID: PAT_TA_100758.pep
MPMSTEAVKLDSMSSKSPLISLLHPFHFLSPNIYALYPTPRRPAMATMPMPTPRSILLLLLLATSFFLLLPNPSSASVSHPDLILPKAVNDNEAHVVVLTAANFSSFLAVRRHVVVDFYAPWCYWSRKLAPEYAAAAAHLADKGLDVALAKVDATQDRDLARAHGVDXYPTVLFFVVPRHFPY

SEQ ID NO: 206341 - protein, 192 aa, Triticum aestivum
  unsure (1)..(192): unsure at all Xaa locations
  Clone ID: PAT_TA_100759.pep
MSPQTETKASVGFKAGVKDYKLTYYTPEYETKDTDILAAFRVSPQPGVPPEEARAAVAAESSTGTWTTVWTDGLTSLDRYKRRCYHIEPVAGEDSQWICYVAYPLDLFEEGSVTNMFTSIVSNVFGFKALRALRLEDLRIPPTYSKTFQGPPHGIQVERDKLNKYGRPLLGCTIKPKLGLSAKNYGRACYEX

SEQ ID NO: 206342 - protein, 87 aa, Triticum aestivum
  unsure (1)..(87): unsure at all Xaa locations
  Clone ID: PAT_TA_100760.pep
XXRRXXRATRTRRAAASSSRRGGRRRGPPGRAGSRPPRRPSGGGTRPPWPPPTAIPNYPTTTSKKLPPLEINRLTNQSSPNNKNGGR

SEQ ID NO: 206343 - protein, 48 aa, Triticum aestivum
  Clone ID: PAT_TA_100761.pep
MEVCCCSTSSSLLASGRFAAPVASARARQWGAAGGGRADVLAHPLHPA

SEQ ID NO: 206344 - protein, 112 aa, Triticum aestivum
  Clone ID: PAT_TA_100762.pep
GTSYGGFVAYSLARAAGPARVGPVVISNSDLLKTAEDDRAFLERTARRLMELSFYRKQRLFSDKREEKIELMKAITVGTDEFQLTPLEQDVLLVWGDHDQIFPVDKAFAVKR

SEQ ID NO: 206345 - protein, 80 aa, Triticum aestivum
  Clone ID: PAT_TA_100763.pep
MASFSEAPPGNPDAGAKIFKTKCAQCHTVDAGAGHKQGMAPPPPVSAQRLSVFIYSRLSLAVLGAGDPNGSFDLRVWGGG

SEQ ID NO: 206346 - protein, 55 aa, Triticum aestivum
  Clone ID: PAT_TA_100764.pep
VDFTPSTLCKNGIYLGQILGGKKKANLSMFKNVWGNPFGFWGEIPPIWGINLNIF

SEQ ID NO: 206347 - protein, 151 aa, Triticum aestivum
  unsure (1)..(151): unsure at all Xaa locations
  Clone ID: PAT_TA_100765.pep
AGRGEGGEGEHERVLALREIKNQIIGNRTKKLLYLRLGAVPAVVAALAEPGASPAALVQAAAAAGSFACGVXDGARAVLAAGAVGHLTRLLAHPDDKVVDACARALRMIYQSKQAPTFDVNNEKNMDFLLSLLDSENENVTELAANIISYS

SEQ ID NO: 206348 - protein, 204 aa, Triticum aestivum
  unsure (1)..(204): unsure at all Xaa locations
  Clone ID: PAT_TA_100766.pep
ARGCPLPPSLRASSSRSLRSSTTPSIHSSRSTSSLPTSPRPSVAAAFSLPLLCAPRLGVGAFQRREQKRKSLHTPTRQPAAAFFSLPSPPLPPSLSPPSLLSCYLQPSQREQSRADQREARGGPKHRTPSREEGKTAGMWDLNDSPAXEAPPLSPSVDDSGASSSSXXXVVEIPDDADDDSXEAVVTRQFFPPAAPGEXXXXNG

SEQ ID NO: 206349 - protein, 138 aa, Triticum aestivum
  unsure (1)..(138): unsure at all Xaa locations
  Clone ID: PAT_TA_100767.pep
ARGRGVRGLSGGERKRVSIGLEMLVDPSLLLLDEPTSGLDSTTAARIVGTLRRMAAGGGRTVVVTIHQPSSRLYHMFDKVLLLSAEGRPIYYGRAADALSYFASVGFASPLSVNPADLMLDLANXILPEXNGDPGGGS

SEQ ID NO: 206350 - protein, 158 aa, Triticum aestivum
  unsure (1)..(158): unsure at all Xaa locations
  Clone ID: PAT_TA_100768.pep
MGTALCLALAVLLLLLVNDPVLVAADDGVDEQLLERFKAAVRNHGELGGWTRGDGACSFPGAACVRGGKRLVSLSLSGVPLDVDFHTVAGTLLRLGGLEVLRLRGANISGSLASGSGPGXXXCXXXLAQLDLSGNGMLGGSVADVRALAGACDGXXXL

SEQ ID NO: 206351 - protein, 168 aa, Triticum aestivum
  unsure (1)..(168): unsure at all Xaa locations
  Clone ID: PAT_TA_100769.pep
PPPWLTPPPPSLCPLPSPHHQQPPSLLSPQIEDRSGSGTPTALLRLKQGALALVLQPWTRCPPISSLCMCWMVGNNNCIKSYLDAILDTGNQIAAIAPPCFSSILSTSPCYSVEEVITVYEDTDLYKSLLRGVNVVYRTTNLXXSGXXXLTLPTSPWXVFFWXXPLYS

SEQ ID NO: 206352 - protein, 121 aa, Triticum aestivum
  Clone ID: PAT_TA_100770.pep
MPRNWSRGASSSSVETRAVNTGSSGATDACPRPESSMPRNSSRGVSPASSSSVAIITSMNTSSSGATDACPRPGSSMPRSSSRESHASSSPPAAAPPETTSRRRSRNGAAIARWHELAKRA

SEQ ID NO: 206353 - protein, 193 aa, Triticum aestivum
  unsure (1)..(193): unsure at all Xaa locations
  Clone ID: PAT_TA_100771.pep
HEAFSSHPRLTSRRFRRRPIECFPNCSSAVPPRTQARVHPSSSLAWFRGSCTIQSGVGDQLMSGSASIQTGRRPVHRGESPDCPRETLDPARVPSPPPRPVLARLSSRGWSRTRRPSPRTRPRTAAPWTAGRGMTASPLPYGAQAECPEVVDPPPCRRFRGHVSTAXSACATLNDDLGRSPATTSXTPAPPXT

SEQ ID NO: 206354 - protein, 92 aa, Triticum aestivum
  unsure (1)..(92): unsure at all Xaa locations
  Clone ID: PAT_TA_100772.pep
XXSXXXRFAPLALPVPATTAIALALPXXRCVRAKAPQPDKRWHRIRMWARGRRQDHQELKAERRWPSIGRLTRGARGHLSRRSGTTRCGRAV

SEQ ID NO: 206355 - protein, 179 aa, Triticum aestivum
  unsure (1)..(179): unsure at all Xaa locations
  Clone ID: PAT_TA_100773.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSXVNIVSNASCTTNCLAPLAKIINDNFGIXXXLMTT

SEQ ID NO: 206356 - protein, 68 aa, Triticum aestivum
  Clone ID: PAT_TA_100774.pep
VIIIVQYQPPELCRIQGSTCGAPNLGVSKVASEFKFGSRDGSLTSHTRVNSSGACLFLPGSARDRPPA

SEQ ID NO: 206357 - protein, 207 aa, Triticum aestivum
  unsure (1)..(207): unsure at all Xaa locations
  Clone ID: PAT_TA_100775.pep
DYHQLCDGSVEREYRRLEATKPSTFSILNYLKIHLPEFFPELLRVILLDDDVLVRKDLAGLWEQDLEGNIMGAVGAHRPGADGGICIERTLTEHLNFSDPAVSSLGLDGSHCAWSWGATIVDLDAWRGANVTETYQLWLQKNRESGFMLWKMGSLPPALIAFDGRVRAIEPLWHLPDLGRRMPDAELLQLSAVLHFSGPRKPWXXXA

SEQ ID NO: 206358 - protein, 167 aa, Triticum aestivum
  unsure (1)..(167): unsure at all Xaa locations
  Clone ID: PAT_TA_100776.pep
TRPAHYHILDGRIIYPRPFSNLDSSHHRNPAPPLASSSRPAARRRGPPPADPAAAACLLPQNPPPPRASYRRPRRCHVPPPAEPAAAAGLLPQTPPSPRGSSRRPDATASFLPQPCQRPPPATPSAXPPASPLPATPMRVPTGSTRSSAAPAAINPTSRRHRRHPPR

SEQ ID NO: 206359 - protein, 173 aa, Triticum aestivum
  unsure (1)..(173): unsure at all Xaa locations
  Clone ID: PAT_TA_100777.pep
LLLLLAFVGTLLLAASSHVPAACTPQVRDALLAFKRGITGEIGTAGLLASWRKDDVDCCQWRGVRCSNRTGHTHVVALNLRGQGLAGEISPSLLSLPHLEHLDLSNNSITGRIPGFLGSLANLRYLNLSHVVYVSSVEVPPHLGNLSKLHYLDLSAYEPYKVSSXDLSXXXRL

SEQ ID NO: 206360 - protein, 86 aa, Triticum aestivum
  unsure (1)..(86): unsure at all Xaa locations
  Clone ID: PAT_TA_100778.pep
CRPNFYLIVFTLYLVFTLRLHVVVPYSYFLTVENTNCSLNTSHHVENIQSSLDAKVLYDRRQLLKCICRFPSPFHQFGPLVALAXA

SEQ ID NO: 206361 - protein, 80 aa, Triticum aestivum
  Clone ID: PAT_TA_100779.pep
LTALCFISSFYPPPSFIIFECNQNSTMAASKIYLWNFDMDCRCNIICKMDSLQLEQHYQHHMDILQISSKNMPIIQMLLI

SEQ ID NO: 206362 - protein, 112 aa, Triticum aestivum
  unsure (1)..(112): unsure at all Xaa locations
  Clone ID: PAT_TA_100780.pep
XRGXXXTSTASIPLAPTDRPPWQPAXXPPPPPGPXSSRCCSSASPPLRCSRGSLRPGTXXTRPSQDPTACEPAVPFFAAGFRPSPASLHPGGPLYLTVLVDAVVYKLILWTI

SEQ ID NO: 206363 - protein, 85 aa, Triticum aestivum
  Clone ID: PAT_TA_100781.pep
PPPPPWPPPPPPPWPPPPPPPRQCAPWRCAATQSSSRPSAHSILASPLMAACPATRRRWSVGCLRRPWVACVDDGQCKQEQSLRL

SEQ ID NO: 206364 - protein, 57 aa, Triticum aestivum
  unsure (1)..(57): unsure at all Xaa locations
  Clone ID: PAT_TA_100782.pep
CRCVVFFLIIEXGNPSFARLLEVENFHLPCCLFLMIILTVRWGVLPYPFQLFNLYGF

SEQ ID NO: 206365 - protein, 204 aa, Triticum aestivum
  unsure (1)..(204): unsure at all Xaa locations
  Clone ID: PAT_TA_100783.pep
ARGNIRTQFARELKVLKQRVLEAFGRRDRYIGSNTLSAPVELGASSKFTSYTPESELVGITKPKAELLELLGEEEKPRRVVSILGPRGIGKTTLARVVYDDTCVKSQFPCRAWVVASQHRGDKEILKEILRQVKVSSSSDADLGEDLNMHLQTNTRYLIVIDDMQTSLLDTIGSYFSSNGRIIVTTNMQSIXXSCSTNXXXYIQ

SEQ ID NO: 206366 - protein, 170 aa, Triticum aestivum
  unsure (1)..(170): unsure at all Xaa locations
  Clone ID: PAT_TA_100784.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGXXDYLGNPSLVHAQSILAIWAXXXVLMG

SEQ ID NO: 206367 - protein, 124 aa, Triticum aestivum
  unsure (1)..(124): unsure at all Xaa locations
  Clone ID: PAT_TA_100785.pep
MLVRAHQMQLLRALLMQPLCASSPLAQLRQPRPQPRAPQXXGARSPWSTSHCRRPRPPDPPPPHRQTAPPPPTPPGLCPVAPSGGGEGRGGGGXPSRPDLRRSGAAVEPHGSGRTRMFGCDNPR

SEQ ID NO: 206368 - protein, 157 aa, Triticum aestivum
  unsure (1)..(157): unsure at all Xaa locations
  Clone ID: PAT_TA_100786.pep
MERLRVAVSHRPPLLVGAPNHLRRRQLHLPLPLASRPLSSRHRLLSPAPRRHARHLLASQTPGPESGPDPDAEASAEPAGAKLVPLVVSLAAGLAVRFLAPRPAEVTLQAWQLLSIFLSTIAGLVLGPLPVGAWAFLGLTTAVATRTLPFEXXFXXF

SEQ ID NO: 206369 - protein, 107 aa, Triticum aestivum
  unsure (1)..(107): unsure at all Xaa locations
  Clone ID: PAT_TA_100787.pep
XXTKNNKHPLGNQMSHTFFVTTYKKQLPQWKNNNFFVQVPILHHIIKTASQNQTALLKFIPGETKKIFKPPKPPCFIWKTIFITYVSAKLKAVTTNPXGPKATLTXX

SEQ ID NO: 206370 - protein, 197 aa, Triticum aestivum
  unsure (1)..(197): unsure at all Xaa locations
  Clone ID: PAT_TA_100788.pep
MDADSGSPWASVQRNRLLPIRTSREPADTEWTPPARSPAEEPVSPTARVMEDIGIYIVITFGLDTPINLTTFQAGIEAMLARCPRYRCIQVVDGSNNGEARWARTTVNVQDHMIVPSLDHAAMATDPDKVVEDYVASLSTLPIDRSRPPWEFHFLDFPTSXXXXTXXXRVHHAYGDGMSSMALLMMXTHSAXXDXRS

SEQ ID NO: 206371 - protein, 136 aa, Triticum aestivum
  unsure (1)..(136): unsure at all Xaa locations
  Clone ID: PAT_TA_100789.pep
MLGGGKMKGDAVSGGSSNISPMVSFLLGAAVATVCVLFFMSASPGRSLVDVAAWSHNNGTAAQHHHLRSVADDLDAARXXXXVAAPAPAPVQAASPYGDLXXVLARAATADRTVIMTQINAAWXXPGSLLDLFFRA

SEQ ID NO: 206372 - protein, 173 aa, Triticum aestivum
  unsure (1)..(173): unsure at all Xaa locations
  Clone ID: PAT_TA_100790.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAXXG

SEQ ID NO: 206373 - protein, 66 aa, Triticum aestivum
  unsure (1)..(66): unsure at all Xaa locations
  Clone ID: PAT_TA_100791.pep
EXXEXXXALCAXXETNPSSFHEHGVASSVPAASVXDVDDEGMFGGFFSQSGAGALSLSLLSSQLVP

SEQ ID NO: 206374 - protein, 55 aa, Triticum aestivum
  Clone ID: PAT_TA_100792.pep
CKCLRSFIHFVLGNAHCSRIDLSQCLRSFASIVSALKKEIFAHKLGSLVLFCKSR

SEQ ID NO: 206375 - protein, 142 aa, Triticum aestivum
  Clone ID: PAT_TA_100793.pep
PPGAASPCSLPQAAGRLVKESGPARRKKSQRLKERRKGPGAHPVREKKEEVGCCAPLRPPAAIVCPKRKAEAGCPRWLKEKSQGSRLLSKKKRRNMRARLPTAGGRKNKKGAARCLIAWPLSSRLARVTLISWPVKLDRLDP

SEQ ID NO: 206376 - protein, 108 aa, Triticum aestivum
  unsure (1)..(108): unsure at all Xaa locations
  Clone ID: PAT_TA_100794.pep
SSECIRTLQNNISVDEILTHTQHLALYPSSRVLLTRTRVEVIMPLPPCVEVASTPRVDAHAVAPLCRNNLGWLSVLLCPHLQLIARKWITSSLFQKVNHEHINLLGXX

SEQ ID NO: 206377 - protein, 75 aa, Triticum aestivum
  Clone ID: PAT_TA_100795.pep
RTCSRARSSGSTVPTTPPRRSRSRRRPRRRAPRRGRRPRPRCPRRRRRPPPRPLPPRWRRRPRRGLVGEGEATTC

SEQ ID NO: 206378 - protein, 158 aa, Triticum aestivum
  unsure (1)..(158): unsure at all Xaa locations
  Clone ID: PAT_TA_100796.pep
LKKXXXYGGQRPSQQMAPRRAAGSREQTTEGSPAQLVRAVKTAGSGGSHIEDALGLREDALTRGMGRLLHPCPQPARVTAGGGSRHGDVPGKYAQTCAMGRVRPCPGGEGDESTRERKRERQRGGGFGSRGSQGEVRRRRRKAGGGGNGNPRRDMAKR

SEQ ID NO: 206379 - protein, 174 aa, Triticum aestivum
  unsure (1)..(174): unsure at all Xaa locations
  Clone ID: PAT_TA_100797.pep
MPTDAGKKAYVVALVIQVIYTGMYVVSKAAFDGGMNTFVFIFYRQAAATLLLLPLAILLERRNAPPMSLWLFTKIFMYALLGNTVSMNLHNISLKYTSATVASATSNSIPVITFLFAVLLHLEAIKLRAASGTAKLAGVALCVAGILVIALYAGXXLSPLNHHRAFHAHAAATA

SEQ ID NO: 206380 - protein, 172 aa, Triticum aestivum
  unsure (1)..(172): unsure at all Xaa locations
  Clone ID: PAT_TA_100798.pep
MAGAPLVLVMLVVAVGVAAAERGGKLQQGFYEQSCPRAEQIVKDYVEQQIPREPSVAATLIRTHFHDCFVRGCDASVLLNATTGGGEAEKDAAPNLTLRGFDFLDRVKALVEQECPGVVSCADILALASRDAVGIIGGPFWRVPXXRRDGRVSIKXXXLDQLPAPTMNFXLA

SEQ ID NO: 206381 - protein, 145 aa, Triticum aestivum
  Clone ID: PAT_TA_100799.pep
MWSQFPVEKQTYKTYTRDLYCKFRDEFLMIGHYNAFQIGVETFELRPNTEWVVKYGFRNYLVVAKIPEGYYSYECCKMERDGILCCHILKVFTHIGLDVIPEQYMLQHWTPITVPSVPSATSQQSDVMPPTSLKEIRHANMTADF

SEQ ID NO: 206382 - protein, 90 aa, Triticum aestivum
  unsure (1)..(90): unsure at all Xaa locations
  Clone ID: PAT_TA_100800.pep
ALSLSPYRRPATCSLPPRRRSFSLATHHGVRAVEQGAWIMASAKHGNTGGRKPSVWNDFDRVIVFVPGGTGAXXHGGVQXXRHHPPSQRX

SEQ ID NO: 206383 - protein, 57 aa, Triticum aestivum
  Clone ID: PAT_TA_100801.pep
HEGAGERKVRREPSLGQDELNRRVEAFINKFNMEMRLQRQESLKHYSEMVGSGGGRY

SEQ ID NO: 206384 - protein, 126 aa, Triticum aestivum
  unsure (1)..(126): unsure at all Xaa locations
  Clone ID: PAT_TA_100802.pep
MATPAIALLDQTLPFGIGGGGGSDRLSKEIFSILESNFLFGAQALEPAGACSAGHVRVLSIDGGADGGALAAAALVRLERRLQELSGNPEARVADYFDVXXXSGAGGFLAAALFARRMPAARDIVC

SEQ ID NO: 206385 - protein, 146 aa, Triticum aestivum
  unsure (1)..(146): unsure at all Xaa locations
  Clone ID: PAT_TA_100803.pep
VPPRLAARRRRWLLRQIAVLYTASFRIAAPLTCSTRSCWASRNRQEARVEMTSSPTVSATMGVMNPLLGKLATLMGDEYRKLKGVRKQASFLMRELGAMKAALEKLEVMEVLDPLXXNWRDHVXXMSYDMENCIDDFMRQFGGADA

SEQ ID NO: 206386 - protein, 188 aa, Triticum aestivum
  unsure (1)..(188): unsure at all Xaa locations
  Clone ID: PAT_TA_100804.pep
MEGAGEEKPHAVCLPFPAQGHITPMLSVANLLHAHGFHVTFVNSEYNHARLVRTRGAAVLAGSPGFRFATIPDGMPQPSGDVDDDVTQDIPSLCKSTLETCLGPFRRLLTELNDAASTGDHPVVTCIVSDLTMCFAMDAXKELDVPYVQXXXXSTVSYLGFRYFRLLIXXGIVPLQDVKQLTDGYLDT

SEQ ID NO: 206387 - protein, 46 aa, Triticum aestivum
  unsure (1)..(46): unsure at all Xaa locations
  Clone ID: PAT_TA_100805.pep
PIWHYALITCCFNPTLVTAXXXSIIKVAAHQIEPEIVFLLXXNRXX

SEQ ID NO: 206388 - protein, 91 aa, Triticum aestivum
  unsure (1)..(91): unsure at all Xaa locations
  Clone ID: PAT_TA_100806.pep
GCRPELDRDPGPHRALTKQQAKAALPFSALCVRISSNYYPNLGALRNASHVSLTDAAYVEISEGDFXYVLDDVRHLAPDVPINDDVVMDAF

SEQ ID NO: 206389 - protein, 71 aa, Triticum aestivum
  unsure (1)..(71): unsure at all Xaa locations
  Clone ID: PAT_TA_100807.pep
NRGPSQXXXPGVGPGKQGGQGRDGLPKLLGEGWVPFLAFRPEGGLGSRFRWKAALFLVGNWGVGLGKVXLF

SEQ ID NO: 206390 - protein, 55 aa, Triticum aestivum
  unsure (1)..(55): unsure at all Xaa locations
  Clone ID: PAT_TA_100808.pep
XXFLFXGXPVXVEHCCATCCLLIIRLSFCGDVFRSFRLCMHVNYLCPRSRGGSMX

SEQ ID NO: 206391 - protein, 89 aa, Triticum aestivum
  Clone ID: PAT_TA_100809.pep
DHWFIINNNQENRTKPLGKQKIGGPRITLLSPPPPKKKARKGKTLFPAYTTIKYSPEPHPKKKGGQRAHWVPNWNWNSKSQENSRHFKS

SEQ ID NO: 206392 - protein, 66 aa, Triticum aestivum
  Clone ID: PAT_TA_100810.pep
DDTFLDTSTTHKRTSCFLKGQLISQSAHPFLPKTYHHVPYNKLCFCLYICSLWCCIFGSFYSIQSR

SEQ ID NO: 206393 - protein, 43 aa, Triticum aestivum
  unsure (1)..(43): unsure at all Xaa locations
  Clone ID: PAT_TA_100811.pep
KHLLHSKISPHNITQGLVKSCTPQALRTRQAAHGFANIQFSRX

SEQ ID NO: 206394 - protein, 56 aa, Triticum aestivum
  Clone ID: PAT_TA_100812.pep
ARGSHLALPLHMETDPSLSQIATREVEAWISCYDGAHLDQVFGHACVNIAPQLITL

SEQ ID NO: 206395 - protein, 111 aa, Triticum aestivum
  Clone ID: PAT_TA_100813.pep
MVPRRTEGARRCRDAGRRAAAYRALGFLLISGPSILFAGGELFGSGPSPLVFLTLFLIEGGGMDLSRVGEKLLSSIRSARSLSLLPPTPAPSRAEVPCCSLPPRHPPFMLC

SEQ ID NO: 206396 - protein, 59 aa, Triticum aestivum
  Clone ID: PAT_TA_100814.pep
FSVCRALWFPVFLLFYFSIAAQIHVVLNCKVQLQVQTWTFLEPEHFQLVAQNCSTRVDI

SEQ ID NO: 206397 - protein, 62 aa, Triticum aestivum
  unsure (1)..(62): unsure at all Xaa locations
  Clone ID: PAT_TA_100815.pep
ETDQDYGDMNGGGGVGAGKISLRLQYYVLLAGVGAVLLVGCLKYMPAAAVVAAGYGSWGXLA

SEQ ID NO: 206398 - protein, 49 aa, Triticum aestivum
  Clone ID: PAT_TA_100816.pep
AQNRLKCSNFETKAPKNYSTCHVYHLNQISGESRTKAKAICVMLIISTN

SEQ ID NO: 206399 - protein, 141 aa, Triticum aestivum
  unsure (1)..(141): unsure at all Xaa locations
  Clone ID: PAT_TA_100817.pep
MQTLTASTSVSSIQRHTPRRTGRSGSLSFSARAVSSPPRAPAPSRFVRGADAAPAKPLIAVPKAPAVERQEKKLNFFQRAAATALDAFEEGFVANVLERPHGLSRTVDPAVQIAGNFAPVGETPPVQALXVTGRIPPFINX

SEQ ID NO: 206400 - protein, 99 aa, Triticum aestivum
  unsure (1)..(99): unsure at all Xaa locations
  Clone ID: PAT_TA_100818.pep
LQSLSLSHCESMASLPEWLGELTSLKRFQIKYCKGIRSLPDSIRKLTXXEYLAIDGCSTLRKWCESQENKMKLAHIRWKHLVLDNAHEEHIPEYGTAGL

SEQ ID NO: 206401 - protein, 179 aa, Triticum aestivum
  unsure (1)..(179): unsure at all Xaa locations
  Clone ID: PAT_TA_100819.pep
HEAASSPSDLLGATLSALRARLPPAVSTARSVLASSKNVNLTTAATNCLTALSLSSHRLEPPPSPSALMPASASLLHLYDCWSAYKYVNFSRTIYDAMAYLNDTITVNSNYISMLAALKRYGDDTSVWAPPQTERDGYWPSPAASGADVDALGVPKGLPADAXVCGAGCDYRTVRXXVA

SEQ ID NO: 206402 - protein, 124 aa, Triticum aestivum
  unsure (1)..(124): unsure at all Xaa locations
  Clone ID: PAT_TA_100820.pep
SSPPPPSRPSPPSTARASSPARAAPSSTSSGRPPPPPPRPPLRDHGAPPAPPRARAXAAPVPPPAPAAARVAPPPPPPPPAPAARVSPPPPPPAPAARVAPPPPPPAPAARVAPPPPPVPAPVV

SEQ ID NO: 206403 - protein, 163 aa, Triticum aestivum
  unsure (1)..(163): unsure at all Xaa locations
  Clone ID: PAT_TA_100821.pep
MAVGKNKRISKGRKGSKKKAVDPFTKKQWYDIKAPLLFTXRNVGKTLVSXRTQGTKIASEGLKHRVFEVSLADLQNDEDQAYKKIKXSRAEDFQGXNFLNNXWGNGXNTDKLKSPVKXLXNTQLXVNVWIXKXLXNXMXXNVXQLGSTKKNPRTKVPFLPQKF

SEQ ID NO: 206404 - protein, 149 aa, Triticum aestivum
  unsure (1)..(149): unsure at all Xaa locations
  Clone ID: PAT_TA_100822.pep
MKTFLILALLAIXATTATTAVRVPVPQLQLQNPSQQQPQEQVPLVQEQQFPGQQQPFPPQQPYPQPQPFPSQQPYLQLQPFPQPQLSYPQPQPFRPQQPYPQPQPQXYSQPQQPISQQQQPPFLQQQRPPFLREQQNTKFIPSHPGFAT

SEQ ID NO: 206405 - protein, 131 aa, Triticum aestivum
  unsure (1)..(131): unsure at all Xaa locations
  Clone ID: PAT_TA_100823.pep
MKKFLVLALIVVAATTXAAEPFTAFRSAWEPQHPSSPEHQPTPQPQEHPVPHQKLNPCRDALLQQCSPVADMSFLRSQVVQHSSCLVMWEQCCQATKKRXPKXSRSKASTTXVQRQIFATNKQKIWLISNQ

SEQ ID NO: 206406 - protein, 176 aa, Triticum aestivum
  unsure (1)..(176): unsure at all Xaa locations
  Clone ID: PAT_TA_100824.pep
MKTFLIFALLAVAATXAIAQMETSHIPSLEKPLQQQPLPLQQILWYQQQQPIQQQPQPFPQQPPCSQQQQPPLSQQQQPPFSQQQPPFXKQQQTVLPQQTTNFRQQQTNNFPAGKQQTNLFNRXQTNHFSQXNKPPIFLXHXATNHPFFXXQXNKQXXFXPATKPTIFXKTTEQFP

SEQ ID NO: 206407 - protein, 137 aa, Triticum aestivum
  unsure (1)..(137): unsure at all Xaa locations
  Clone ID: PAT_TA_100825.pep
MKTLLILTXLAMAITIGTANIQVDPSGQVQWLQQQLVPQLQQPLSQQPQQTFPQPQQTFPHQPQQQVPQXPQQPQQPFLQXPQQPFPQQPXQPFPQVQQTTTNNFPXETTNNQFSQDFKKPQKXIFXTNXQKNPFPK

SEQ ID NO: 206408 - protein, 83 aa, Triticum aestivum
  unsure (1)..(83): unsure at all Xaa locations
  Clone ID: PAT_TA_100826.pep
NYDTMNFACRPSGQTIGVWRERXQLELVLIANXILKGRLNTGNXNXXKIAKKNKRXGXWQMRDXXNXXGFYDTXMGILQYYXF

SEQ ID NO: 206409 - protein, 156 aa, Triticum aestivum
  unsure (1)..(156): unsure at all Xaa locations
  Clone ID: PAT_TA_100827.pep
MARTKQTARKSTGGKAPRKQLATKAARKSAPTTGGVKKPHRYRPGTVALREIRKYQKSTELLIRKLPFQRLVREDRARTSRRGXPLXVHAVARPQRRRAEGLSSGLLRRTLLRQSQGQSASTINARIQAPPRPARGKRGRNQIKKPQGPQCQRFNF

SEQ ID NO: 206410 - protein, 161 aa, Triticum aestivum
  unsure (1)..(161): unsure at all Xaa locations
  Clone ID: PAT_TA_100828.pep
MKVFILALLALTATTAIAQLETTCSQGFGQYQQQQQPGQRQLLEQMKPCVAFLQQQCRPLRMPFLQXQVEQLSNCQIVQHQCCQQLAQIPKANXGCHAIHNVVKGIMQQKXQQKLGRSXQQQSTKLQGFKTFNCFILFSPGTIAQANKQIGQPTNKPCKGA

SEQ ID NO: 206411 - protein, 109 aa, Triticum aestivum
  unsure (1)..(109): unsure at all Xaa locations
  Clone ID: PAT_TA_100829.pep
MGKEKTHINIVXIXHVDSGKSTTTGHLIYKLGGIDKRVIERFEKEAAEMNKRSFKYAWVLDKLKAERERGITIDIALWEXSRTTKYYCXVNLMPPGSVELQSKNNEFTG

SEQ ID NO: 206412 - protein, 102 aa, Triticum aestivum
  unsure (1)..(102): unsure at all Xaa locations
  Clone ID: PAT_TA_100830.pep
VFFFFFFFFFFLECPVYSTSDXRPCKPTNTGCMKTTKINTILVARATGTLFLPEDKYYHSTIIGHTTHXIVNQVXFHYIFSTHTCXNXNSPTXXRENEHMFY

SEQ ID NO: 206413 - protein, 175 aa, Triticum aestivum
  unsure (1)..(175): unsure at all Xaa locations
  Clone ID: PAT_TA_100831.pep
MAAKEPMRVLVTGAAGQIGYALVPMIARGVMLGADQPVILHMLDIEFAAEALKGVKMELIDAAFPLLKGVVATTDVVEACTGVNVAVMVXVGFPKKEXMERKDVMTKNVSIYKSSKHLLLKLKQPPNLQRFWVVAXPXNTNAXNLKXFAPSIPEXXXSICLTXPKNKNKATPVIS

SEQ ID NO: 206414 - protein, 193 aa, Triticum aestivum
  unsure (1)..(193): unsure at all Xaa locations
  Clone ID: PAT_TA_100832.pep
MKTFLIFALLAIAATSAIAQMETSRXXGLEKPWQQQPLPPQQQPPCSQQQQPFPQQQQPXIILQQSPFSQQQQPVLPQQQPXLLYWQQPPFSQQQXPVLPQQPPFFTXTNNINNXXQATHHFRKQQXPFLXQQPTFXQQQQQTXNFRQAXKQPIFQXXTXFFQXXTTXXVFXQQXNPXXVQPTRFCKXXKPGG

SEQ ID NO: 206415 - protein, 103 aa, Triticum aestivum
  Clone ID: PAT_TA_100833.pep
MKTFLIFALLAVAATSAIAQMETIHIPSLEKPLQQQPLPLQQILWYQQQQPIQQQPQPFPQQPPCSQQQQPPLSQQQQPPFSQHQQPVLPQQQISVQPSIFAS

SEQ ID NO: 206416 - protein, 97 aa, Triticum aestivum
  Clone ID: PAT_TA_100834.pep
IPPPPSSSPACATEPRRHARPPPLRCTPLEPLRSRRRATGRERARRPPPPAAPGPSRPRAPATAARRKKEGGSLEGGGPMRGRSPVGERKSYRAKHL

SEQ ID NO: 206417 - protein, 170 aa, Triticum aestivum
  unsure (1)..(170): unsure at all Xaa locations
  Clone ID: PAT_TA_100835.pep
PVSQPEPPVYGTPCRDVVRHIEVEFEPRETESADEAGNQQCREQCCEQQEQQIIRRSKRSEPHQADHASKHEARLRDLLPHVGIERVAEFSPPFAHEAHKNIVGTPNAQPRVTHLTTGFGLPLQKRATFAQTPCGRNNPAWPKCPFEPWPPLXKSLGAKPAXGGPGEKPG

SEQ ID NO: 206418 - protein, 137 aa, Triticum aestivum
  unsure (1)..(137): unsure at all Xaa locations
  Clone ID: PAT_TA_100836.pep
PGLERPWQQQPLQQKETFPQQPPSSQQXQPFPQQPPFLQQQPSFSQQPLFSQKQQPVLPQQPAFSQQQQTVLPQQPAFSQQQHQQLLQQQIPIVHPSILQQXLNPCXXFLPASSVTPGGNGNNLAKVRKMEARAIWQ

SEQ ID NO: 206419 - protein, 158 aa, Triticum aestivum
  unsure (1)..(158): unsure at all Xaa locations
  Clone ID: PAT_TA_100837.pep
MKTFLILALLAIVATTATTAVRVPVPQLQLQNPSQQQPQEQVPLVQEQQFPGQQQPFPPQQPYPQXPQPFPSQQPYLQLQPFXKPQLSYPQAATNFRPQTTISTSRKPQVFRKPQTNQIFASKQAXKQAXQQQPTNKQXXPXQTXFLQTNKFHARGFF

SEQ ID NO: 206420 - protein, 79 aa, Triticum aestivum
  unsure (1)..(79): unsure at all Xaa locations
  Clone ID: PAT_TA_100838.pep
MKTLLILTILAMATTXATXNMQVXPSGQXXWPQXQPFPQPQQPFCQQPQQTIPXPHQTFXHQXXFDFPNPNXKXPPSHN

SEQ ID NO: 206421 - protein, 179 aa, Triticum aestivum
  unsure (1)..(179): unsure at all Xaa locations
  Clone ID: PAT_TA_100839.pep
MKTFLILALLAIVATTATTAVRVPVPQLQLQNPSQQQPQEQVPLVQEQQFXGKQQPFPPQQXPYPASRNQFPSQQPYLQAATISKSRNYHIRKPQPFRXQQPYPQPQPKVFRXQNKQFRKQQGSNXKQQQQXXPPIPTTKFCNKNXXQCXDXVLQQQKIAQXKFKEYLAGGKLFQKGNF

SEQ ID NO: 206422 - protein, 158 aa, Triticum aestivum
  unsure (1)..(158): unsure at all Xaa locations
  Clone ID: PAT_TA_100840.pep
MKTFLILALLAIVATTATTAVRVPVPQLQLQNPSQQQPQEQVPLVQEQQFPGQQQPFPPQQPYPXPQPFXSQQTYLAAGKHFHKPQLSYPQXPQPFRPQQPXPQPQPQYSQXQQXISQQQXQQASRQQQQQQQPNSLQQFWQKTNWIPQGDVCANKQK

SEQ ID NO: 206423 - protein, 172 aa, Triticum aestivum
  unsure (1)..(172): unsure at all Xaa locations
  Clone ID: PAT_TA_100841.pep
MKTFLIFALLAIAATSAIAQMETSRVPGLEKPWQQQPLPPQQQPPCSQQQQPFPQQQQPIIILQQSPFSQQQQPVLPXQSNQVIILQQPPFSQQQQXVLXQQPPFSQQQQQQQQQQQPTFSQATTTKFYHNKHHFHNNNNHHFRKQATTIFTINLFHNNTNKFHKQQNPLVG

SEQ ID NO: 206424 - protein, 140 aa, Triticum aestivum
  unsure (1)..(140): unsure at all Xaa locations
  Clone ID: PAT_TA_100842.pep
MAPKADKKPAAENKVEKAAEKTPAGKKPKAEKRLPAGKTASKEAGGEAXTRGRKKGSKAKKGVETYKIYIFKVLKASATPTFGISSKGHVQSLNSLHQTNILRNPRGNGQNLELKQRKAPINLPGENLKNFRSAVLPPGG

SEQ ID NO: 206425 - protein, 194 aa, Triticum aestivum
  unsure (1)..(194): unsure at all Xaa locations
  Clone ID: PAT_TA_100843.pep
KXFVXXAPPXRICTHGTISHEXFPPAAESGXNSQRNFWXPXRXEGRFFVMGRXPHPQXKMGLVSPTXALRVRFCCFQPASGPVAARIPAFEPAPGGRCCPXPLFEPXPGPVGGXFRHCLGWHGRKRGRMAXGVEGGAWSWGKVQHQGWWSGKVEGWGHDGGRWEGVVGTPAVGGSELGWGVSGEGGGDRGWESC

SEQ ID NO: 206426 - protein, 193 aa, Triticum aestivum
  unsure (1)..(193): unsure at all Xaa locations
  Clone ID: PAT_TA_100844.pep
MKTFLILALLAIVATTATTAVRVPVPQLQLQNPSQQQPQEQVPLVQEQQFPGQQQPFPPQQPYPQPQPFPSQQPYLQLQPFPQPQLSYPQXPQPFRPQQPYPQPQPQYSQPQQPXSQQQQAASKQQQQQQQQILQQILQQQLDSMARDVVLQQHNISAWEAQQSFAKKSTYKAXCKQLCCQASXWXNSRXSRG

SEQ ID NO: 206427 - protein, 132 aa, Triticum aestivum
  unsure (1)..(132): unsure at all Xaa locations
  Clone ID: PAT_TA_100845.pep
AALHILVANAGVIDDKYPSRADXTTXDIDRAFVVKTRGTFLCLREAANRMPHGGGGRIVALTTSVVGSLRTGYSAYTASXAAVXAMVRTMAKGAQXXTGITGNCXAXGPTATXMFFAGKEATTVRGNRETNP

SEQ ID NO: 206428 - protein, 148 aa, Triticum aestivum
  unsure (1)..(148): unsure at all Xaa locations
  Clone ID: PAT_TA_100846.pep
MKTFLVFALLAVAATSAIAQMETRCIPGLERPWQQQPLPPQQTFPQQPLFSQQQQLFPQQPSFSQQQPPFWQQQPPFSQXQQPILPQXQPPFSQQQQLXVLPQQPPFSQQQQPXVLPPQQSPFPQQQQHQQLVQQQIPVVQXSNFAAS

SEQ ID NO: 206429 - protein, 188 aa, Triticum aestivum
  unsure (1)..(188): unsure at all Xaa locations
  Clone ID: PAT_TA_100847.pep
MKTFLIFALLAIAATSAIAQXETSRVPGLEKPWQQQPLPPQQQPPCSQQQQPFPQQQQPIIILQQSPFSQQQQPVLPQQQPVIILQQPPFSQQQQPVLPQQPPFSQQQQQQQQQQQPPFSQQQXPXVLPXQXPFSQQQQPPFSQQXQQPSSQQPXFPQQHQQFPQQQIPXGSNIRFCXKLNPCKVPKC

SEQ ID NO: 206430 - protein, 176 aa, Triticum aestivum
  unsure (1)..(176): unsure at all Xaa locations
  Clone ID: PAT_TA_100848.pep
MKTFLILALLAIVATTATTAVRVPVPQLQLQNPSQXNKPQEQVPLVQEQQFXQGKQQPFPPQQPYPQPQPFXSQQPYLQLQPFPQXPQLSYPQPQPFRPQQPYPQPQPQVFXQPQQPISAASXQAASKQQQQQQQQILQQXFATNNWIPCKGCCICNNTNGGKLNKVFAKKVTLQA

SEQ ID NO: 206431 - protein, 152 aa, Triticum aestivum
  unsure (1)..(152): unsure at all Xaa locations
  Clone ID: PAT_TA_100849.pep
MKTLLILTILAMATTIATANMQVDPSGQVQWPQQQPFPQPQQPFCQQPQQTIPXPHQTFHHQPQQTFPQPQQTYPHQPQQQFPQTXQPQQPFPQXPQQXFPQQXQXTISPIPXQXFPQXPMHXXEPFPQSQQPXXPFXPSPKXNFXQPQQXN

SEQ ID NO: 206432 - protein, 102 aa, Triticum aestivum
  unsure (1)..(102): unsure at all Xaa locations
  Clone ID: PAT_TA_100850.pep
MAAKGDGPAIGIDLGTTYSCVGVWQHDRVEIIANDQXGNRTTPSYVAFXTDSERLIGDAAKNQVGMNPINNVFECKRLNGRXFTXSTVQSDIXLLAQRLAGW

SEQ ID NO: 206433 - protein, 88 aa, Triticum aestivum
  unsure (1)..(88): unsure at all Xaa locations
  Clone ID: PAT_TA_100851.pep
HWSPQNSPSLQVPSMSCFEHFSSHLTHLFHSSLHHLTSYGICLFLLDWLLSLVLVSNSPACLPWFLLLPXGFLYXXGXPPSLSPLKFC

SEQ ID NO: 206434 - protein, 161 aa, Triticum aestivum
  unsure (1)..(161): unsure at all Xaa locations
  Clone ID: PAT_TA_100852.pep
MKTFLILALLAIVATTATTAVRVPVPQLQLQNPSQQQPQEQVPLVQEQQFPGQQQPFPPQQPYPQPQPFPSQQPYLQLQPFPQXPQLSYPQXPQPFRPQQPYPQXPQPQXYSQPQQPISQASKQQAXXQQQQQQQQNXYNKILQQQTGFHARDVVLQQQQT

SEQ ID NO: 206435 - protein, 98 aa, Triticum aestivum
  unsure (1)..(98): unsure at all Xaa locations
  Clone ID: PAT_TA_100853.pep
SPRGIFXIGGQLGAKSPXLLLPKSGTARKASGPXDPAASFHLHPRRPQSSSGGHARSSHLHRRSPRGGCGEGSKLEWGEHQQATKAKAKQQPLQYLAS

SEQ ID NO: 206436 - protein, 147 aa, Triticum aestivum
  Clone ID: PAT_TA_100854.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHAIVLQQQQQFGTKVFPTNLNKQQTNKGQQQTVKF

SEQ ID NO: 206437 - protein, 171 aa, Triticum aestivum
  unsure (1)..(171): unsure at all Xaa locations
  Clone ID: PAT_TA_100855.pep
MKTFLILALLAIVATTATTAVRVPVPQLQPQNPSQQQSQEQVPLVQQQQFLGQQQPFPPQQPYPQPQPFPSQQPYLQLQPFPQAQLPYSQPQPFSXPNXQYPQPQTTNISQXTNNPNFHKQQASKQTTNKQTNKEQQITFKQNFCNKQTGXPCXGLLANTNIAGKIKFCNK

SEQ ID NO: 206438 - protein, 108 aa, Triticum aestivum
  unsure (1)..(108): unsure at all Xaa locations
  Clone ID: PAT_TA_100856.pep
MKTFLILALLAIVATTATTAVRVPVPQLQPQNPSQQQPQEQVPLVQQQQFPGXQQQQFPPQQXYPQRKPFSSXTNISGSKQFPEAGKPFGQQIISRKPQIFQPTNQYS

SEQ ID NO: 206439 - protein, 168 aa, Triticum aestivum
  unsure (1)..(168): unsure at all Xaa locations
  Clone ID: PAT_TA_100857.pep
MKTFLILALLAIVATTATTAVRVPVPQLQPQNPSQQQSQEQVPLVQQQQFLGQQQPFPPQQPYPQPQPFPSQQPYLQLQPFPQPQLPYSQPQPFRPQQPYPQPQPQYSQPQHPISQQQXKQQQQQQQQEQQIXQQILQKQLXPCXGVCYCXKHNXAQWEDLQFATKTL

SEQ ID NO: 206440 - protein, 94 aa, Triticum aestivum
  unsure (1)..(94): unsure at all Xaa locations
  Clone ID: PAT_TA_100858.pep
QASNPSKYLTQIHHEDLTHPTXXAMATTIATANMQVDPSGQVQWPQXQPFPQPXXPFCQQPQQTXSPTPXQTFHHQPESNTFPXXPTXHXPHQP

SEQ ID NO: 206441 - protein, 167 aa, Triticum aestivum
  unsure (1)..(167): unsure at all Xaa locations
  Clone ID: PAT_TA_100859.pep
MKTLLILTXLAMATTIATANMQVDPSGQVQWPQQQPFPQPQQPFCQQPQQTIPQPHQTFHHQPQQTFPQPQQTYPPSTTNNNFPKTQQPQRNHFPRPNKHSPNNPNLPFPNNPQQPXPPSSXNPNKXFSQVHXKQQXTFFPSPXKKFPXXPKNXKXIXPPKKKTTGF

SEQ ID NO: 206442 - protein, 173 aa, Triticum aestivum
  unsure (1)..(173): unsure at all Xaa locations
  Clone ID: PAT_TA_100860.pep
TFLILALLAIVATTATTAVRVPVPQLQPQNPSQQQPQEQVPLVQQQQFPGQQQQFPPQQPYPQPQPFPSQQPYLQLQPFPQPQPFSPQLPYPQXPQSFPPQQPFPQQXQPQYLQPXQTNFXKQQAQQQQQQXQQXQQTTTNSFKQLTTNGFQGRECCGKTIAECKHKFLEKKF

SEQ ID NO: 206443 - protein, 123 aa, Triticum aestivum
  Clone ID: PAT_TA_100861.pep
MKFGKDFRSHLEGTLPDWKDKYLAYKALKKLIKTLPPDALRRRTTSGSLPPPPPPGLRELVSPGFSNVQAPTKLKRLLTIGTGKELVFNPASKGCLGEGFEKFKSKKKIGGFLQSKNFQLENF

SEQ ID NO: 206444 - protein, 146 aa, Triticum aestivum
  unsure (1)..(146): unsure at all Xaa locations
  Clone ID: PAT_TA_100862.pep
MEXFLVXAXLAVXATSAXAQMEXXCIPGLGRPWQQQPLPPQQTFPQQPLFSQQQQLFPQQPSFSQQQPPFWQQQPPFSQXQQPILPQXPPFSQQQQLVLPQQPPFSQQQQPSFTXPQQSXFPQQQQHQQXLVQQQNPLVVQPSNFS

SEQ ID NO: 206445 - protein, 103 aa, Triticum aestivum
  unsure (1)..(103): unsure at all Xaa locations
  Clone ID: PAT_TA_100863.pep
XKXXPXNPSCXFXXXWXLXAGXEXLDPXFFFDPCLLLXCLRXGFKLPXYPXXFFXXCKINGGAXRFLDGPQQSLTCFGESLFSLLNNXCSPTFQSSCYFAPTL

SEQ ID NO: 206446 - protein, 147 aa, Triticum aestivum
  unsure (1)..(147): unsure at all Xaa locations
  Clone ID: PAT_TA_100864.pep
MKTFLVFALLAXAAXSAIAQMETRCIPGLERPXQQQPLPPQQTFPQQPLFSQQXQLFPQXPSFSQXQQPPFWQQQPPFSQXQQPILPQQPPFSQQXQLVLPEQPPFXSQQQTTKFLPPQQSPFXQQQQQXQTGGATNIPWFPIQFLS

SEQ ID NO: 206447 - protein, 152 aa, Triticum aestivum
  unsure (1)..(152): unsure at all Xaa locations
  Clone ID: PAT_TA_100865.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPXVLPPQQSPFPQQXQQHQQLGANKSPGWSSHPILASLKQCKG

SEQ ID NO: 206448 - protein, 124 aa, Triticum aestivum
  unsure (1)..(124): unsure at all Xaa locations
  Clone ID: PAT_TA_100866.pep
VLLCAAPPLRTSQASASNPSPRPPPHLRPRRSLLRPSSTSHGLHPSASCPLVLQDCSMVLGGCDSGADGAPADQLNGGSSKGQRQQPKGRRFIGKVMELQIGVAAAXMMQSAKWFPKDXWETNL

SEQ ID NO: 206449 - protein, 98 aa, Triticum aestivum
  unsure (1)..(98): unsure at all Xaa locations
  Clone ID: PAT_TA_100867.pep
AKRHASQPLPQHTSHKWQXQYSXPQXQPIWQRXXAQATTIHQKXXQQXQQQQILQQILQQQLXPCRDVVLQQHSXAYGSSQVLQQSTYQVVQQLXCQQ

SEQ ID NO: 206450 - protein, 144 aa, Triticum aestivum
  unsure (1)..(144): unsure at all Xaa locations
  Clone ID: PAT_TA_100868.pep
ASQPLRRPITADSALMNPNTRILALKAQIAGTTQDHLQIFNIEAKTKVKSHQMPEQVVFWKWITPKLLGLVTQTSVYHWSIEGDSEPTKMFDKTANLGNNQIINYRCDPAXKWLXVXIGIAPGAPEXRPQXGGKGNMQPFLRFD

SEQ ID NO: 206451 - protein, 94 aa, Triticum aestivum
  unsure (1)..(94): unsure at all Xaa locations
  Clone ID: PAT_TA_100869.pep
MAVTFSDLHTADGLKALEAHLAGKTYISGDGITKDDVKVFAAVPVKPSAEFPNAARWYDTVAAAVASRFPGXSSGVXSASSAPAATAPAASKGL

SEQ ID NO: 206452 - protein, 163 aa, Triticum aestivum
  unsure (1)..(163): unsure at all Xaa locations
  Clone ID: PAT_TA_100870.pep
MKTFLILALLAIVATTATIAVRVPVPQLQPQNPSQQQPQEQVPLVQQQQFPGXQQPFPPQQXPYPQPQPFPSQQPYLQLQPFXQPQLTYPXPQITNPQPQPFXRPKQTYPQXQPQXSQPQKTIXQEQEQQXQQQQQKQQLXHNNXFLXKILQKNWFHEGSFFK

SEQ ID NO: 206453 - protein, 128 aa, Triticum aestivum
  unsure (1)..(128): unsure at all Xaa locations
  Clone ID: PAT_TA_100871.pep
MKTFLVFALIAVVATSAIAQMETSCISGLERPWQQQPLPPQQSFSQQPPFSQQQQQPLPQQPSFSQQQPPFSQXQQPILSASKQPIFNKQTTNQVSNRKQSTNFPQATTTFLPPTTNNKQTTCNKQIP

SEQ ID NO: 206454 - protein, 148 aa, Triticum aestivum
  unsure (1)..(148): unsure at all Xaa locations
  Clone ID: PAT_TA_100872.pep
LLPPQPTGASPTTWPAPSRRRGPAAAPRKQLATKAARKSAPXXGXVKXPHXFRPGTVXLREIRKYQKSTELLIRKLPFQRLVREXIAQDFKTDLRFESSAVSALQEAAEAYLVGLFXDNKLCANPRQSALTIXPKGIQLARXIRGXRG

SEQ ID NO: 206455 - protein, 52 aa, Triticum aestivum
  unsure (1)..(52): unsure at all Xaa locations
  Clone ID: PAT_TA_100873.pep
FLSLYNFVVCRLILSLXXFFFFFFFFFFFFFFFFFFFYFLFLSLLNLNLWPV

SEQ ID NO: 206456 - protein, 164 aa, Triticum aestivum
  unsure (1)..(164): unsure at all Xaa locations
  Clone ID: PAT_TA_100874.pep
MKTLLILTILAMGITIGTANIQVDPSGQVQWLQQQLVPQLQQPLSQQPQQTFPQPQQTFPHQPQQQVPQXLKQPQQPFLQPQQPFPQQPQQPFPQTQQPQQPFSPXQPQQPFPKIQQTPTNIFPKQPQXPIPPRTSKNPXQTNFPQASRQPTXKPFSPSPQXTW

SEQ ID NO: 206457 - protein, 165 aa, Triticum aestivum
  unsure (1)..(165): unsure at all Xaa locations
  Clone ID: PAT_TA_100875.pep
MKTFLILALLAIVATTATIAVRVPVPQLQPQNPSQQQPQEQVPLVQQQQFPGXQQTFPPQQPYPQPQPFPSQQPYLQLQPFPQPQLPYPQPQLPYPQPQXLPYPQPQTIFXQQQPISTNRKPQVFATTKNQFSXASSRQQQQQPTXNKQPTNQQQSFKQFGNNLD

SEQ ID NO: 206458 - protein, 167 aa, Triticum aestivum
  unsure (1)..(167): unsure at all Xaa locations
  Clone ID: PAT_TA_100876.pep
GTNKSQANLVSDRLEACRILLPHRLKMQIFVKTLTGKTITLEVESSDXIDNVKAKIQDKEGIPPDQQRLIFAGKQLEDGRTLADYNIQKESTLHLVLRLRGGMXIFVKTLTGKTITLEVXRALNTIDNVKXAKIKDXGGHSPDKQRLIFARATGMAAPFGLKTSGVP

SEQ ID NO: 206459 - protein, 174 aa, Triticum aestivum
  unsure (1)..(174): unsure at all Xaa locations
  Clone ID: PAT_TA_100877.pep
MKKFLVLALIVIAATTXAAEPFTAFRIASEPQHPSSPEQQPTLQPQEHPVPHQKLNPCRDALLHQCSPVADMSFLRSQVVQHSSCLVMWEQCCQQLKAIPXAIKNVXAIHNGRARQLXLQTSKKQFGTKVFSNPNLQXSKQTXKGSNKXTMGQXVXSPGPQTTQXIXQXSXPXV

SEQ ID NO: 206460 - protein, 159 aa, Triticum aestivum
  unsure (1)..(159): unsure at all Xaa locations
  Clone ID: PAT_TA_100878.pep
MKTFLILALLAIXATTATIAVXVPVPQLQPQNPSQQQPQEQVPLVQQQQFPGQQQPFPPQQPYPQPQPFPSQQPYLQLQPFPQPQLXYPQPQLPYPQANNFPKNPLFHFFKRIIFASKRQANQPTNQKKQANQQPTTRLKFWQTWIPMARGIFLPPNHQ

SEQ ID NO: 206461 - protein, 133 aa, Triticum aestivum
  unsure (1)..(133): unsure at all Xaa locations
  Clone ID: PAT_TA_100879.pep
WPGKGRWFPSSGRGTPRTSATPSSSRRCARTXPRPCRARRRQRPGGTTTKSSTPTSTTRTSAGTCPRARPARTATATRPRRSTMTTSAVTCPRGRRARTATDTPRRRSTTPRSTXTGATTGGTGAMAAAPRSA

SEQ ID NO: 206462 - protein, 200 aa, Triticum aestivum
  unsure (1)..(200): unsure at all Xaa locations
  Clone ID: PAT_TA_100880.pep
NPHPGLQFIPIARAPPQIAIAAPKSPEAAGRSPPVGLLRHHIFSPSHRSSPHHRRAVLLLLLCSLPPKVSVVLASLSRRSFPSIAVPFFSFGLSCCYSPSPLVVGGXGFGGACLPSSSHRCSSSHRVVPLQAVSTTTGVGFQSCSSLSSSVVWVLIIAELLCRSTALLCVGWCLMWILWLKPXXERKGSAYEKIPTLLFX

SEQ ID NO: 206463 - protein, 180 aa, Triticum aestivum
  unsure (1)..(180): unsure at all Xaa locations
  Clone ID: PAT_TA_100881.pep
HEAATAAASDAEARSILERAAAASFPPLHAVHHLLSVGVCVRCIFRMFGAFSHACLCASLTVSFFHSFLEEHDDSAKGGSCSCLSTDEACCSICFGILLPTCHKDEGVVPFDDISRIDIITSMVSQAIQREGYQIDGFSLEISLPAVVAANERAIRLYMKEKYGSENWFKDEIFSXXRCQ

SEQ ID NO: 206464 - protein, 181 aa, Triticum aestivum
  unsure (1)..(181): unsure at all Xaa locations
  Clone ID: PAT_TA_100882.pep
MAFYRGSGMGMGMGMGMGGGSSSSWAPAAMPPPPPPPIRPWTKAEDKVFESALVAIPEHVPNRWVFVAAHLPGRTPQEAWEHYXXLVADIDLIERGLVEPPESWDDDDDGAAGAGGTVAAGRGRPRGSGGEDRRKGIPXTXXEHXYTHTTAVKISNCLPSLDPVRFLVPLPCYSTARSCKT

SEQ ID NO: 206465 - protein, 163 aa, Triticum aestivum
  unsure (1)..(163): unsure at all Xaa locations
  Clone ID: PAT_TA_100883.pep
XWVINSTKSRISSSVKGCKAASDEESTEHFISTMKEKDVKIDRFEVRGKAWTRRRLVLTGSDGAFHVLQWKQHKTRKMNVGSATTSGESERLSRGLEEENSAGVKELRALIQGVEARISAQLKDFETTISTRFSPFESRIQSMDIRLQAIEQERAESXXXNVW

SEQ ID NO: 206466 - protein, 151 aa, Triticum aestivum
  unsure (1)..(151): unsure at all Xaa locations
  Clone ID: PAT_TA_100884.pep
MNTLLILTILAMAITTANIQVDPSGQVQWLQQQXVPQXXXXXSHQPQQTFAQPQQTFAHEPQQQVPQPXQPQQPXLQPQQPFPQQPQQPFXXXQRPQQPFPXQPQQXXPQTQQPQQPFPQQPQQPFPQXEQPQQPXXQXQQPQQPFTXXQX

SEQ ID NO: 206467 - protein, 93 aa, Triticum aestivum
  unsure (1)..(93): unsure at all Xaa locations
  Clone ID: PAT_TA_100885.pep
TGPHMSNTPKNCHNMGKIPQPTLNSGFQKKRGPAXXMGLKQSRMTEXFPPXTRAICFXPALALFWEPPETKAIPLPPGLFFQAXPSKGDXLXF

SEQ ID NO: 206468 - protein, 153 aa, Triticum aestivum
  unsure (1)..(153): unsure at all Xaa locations
  Clone ID: PAT_TA_100886.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQXESTLHLVLRXXGXQ

SEQ ID NO: 206469 - protein, 174 aa, Triticum aestivum
  unsure (1)..(174): unsure at all Xaa locations
  Clone ID: PAT_TA_100887.pep
MWNGGPPPPLPLPPMAAAPPPPGTAGAGLPPPPPPPAAAPPQAGQPLTPAELEAQLVEKARKWHQLNSKRYGDKRKFGFVEAQKEDMPPEHVRKIIRDHGDMSSKKYRHDKRVYLGALKFVPHAVYKLLENMPMPXXQVRHVKILYHITGAITFVNEIPWVVEPIYLAXXXSMW

SEQ ID NO: 206470 - protein, 116 aa, Triticum aestivum
  unsure (1)..(116): unsure at all Xaa locations
  Clone ID: PAT_TA_100888.pep
RPFSSLPSLLLYQPXPYYGHNNNQFRQPQQAQLPFPQQPQQPFPQPQQPQQPFPQSQQPQQPFPQPQQPQQSFPQQQQPXIQXXLQQQMNPCKNYLLQPCNPVSLXXSLXXMNLPR

SEQ ID NO: 206471 - protein, 120 aa, Triticum aestivum
  unsure (1)..(120): unsure at all Xaa locations
  Clone ID: PAT_TA_100889.pep
XVVPGXXLAGDVEVAVLVVRXXXXXXXHAXDNNFYNISXXXIHHAPSVTCLITHLXXXPIGXNHKGXXFVPAVLVEDVIPAAAKSDSDQIVSLMTPLPPICTPHIHQLIADLMYPIVVAL

SEQ ID NO: 206472 - protein, 96 aa, Triticum aestivum
  unsure (1)..(96): unsure at all Xaa locations
  Clone ID: PAT_TA_100890.pep
MKTMFILALLAFTATSAVAQLYTTCSQGYGQCQQQPQPQPQMNTCAAFLQQCIQTPYVQSQMWQASSCQLMRQQCCQPLAQISEQARCQAVCXVSQ

SEQ ID NO: 206473 - protein, 187 aa, Triticum aestivum
  Clone ID: PAT_TA_100891.pep
MKTLLILTILAMATTIATANMQVDPSGQVQWPQQQSFPQQQQPAIQSFLQQQMNPCKNFLLQQCNHVSLVSSLVSIILPRSDCQVMQQQCCQQLAQIPQQLQCAAIHSVAHSIIMQQEQQQGVPILRPLFQLAQGLGIIQPQQPAQLEGIRSLVLKTLPTMCNVYVPPDCSTINIPYANIDAGIGGQ

SEQ ID NO: 206474 - protein, 188 aa, Triticum aestivum
  unsure (1)..(188): unsure at all Xaa locations
  Clone ID: PAT_TA_100892.pep
MKTFLVFALLAVAATSAIAQMETRCIPGLERPWQQQPLPPQQTFPQQPLFSQQQQLFPQQPSFSQQQPPFWQQQPPLXXNXXXLGNVGAVLSXXXSDPQAVKXQXHPQCCALHYLDTXALREITRRPGAVQLXDXXQQXNXXLGSSQXXLQQQCSPVAMPQRLARSQMLQQXSCHVMQQQCCQQLPXX

SEQ ID NO: 206475 - protein, 171 aa, Triticum aestivum
  unsure (1)..(171): unsure at all Xaa locations
  Clone ID: PAT_TA_100893.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQSSYQQLQQLCX

SEQ ID NO: 206476 - protein, 179 aa, Triticum aestivum
  unsure (1)..(179): unsure at all Xaa locations
  Clone ID: PAT_TA_100894.pep
MKTFLVFALLTVVATSTIAQMETSCIPGLERPWQQQPLPPQQTLFPQQQPFPQQQPPFSQQQPSFSQQQPPFSQQQPILPQPPFSLQQQPVLPQQSPFSQQQLVLPPQQQYQQLLQQQIPIVQPSVLQQLNPCKVFLQQQCXQRLARSQMWQQSSCHVMQQQCCQQLPQIPEQSRYDAI

SEQ ID NO: 206477 - protein, 185 aa, Triticum aestivum
  unsure (1)..(185): unsure at all Xaa locations
  Clone ID: PAT_TA_100895.pep
MKTLLILTILAMATTIATANMQVDPSSRVQWPQEQPPPQPQQQFSQPQQPQQSFPQQQQWMIXXFLQQQMNPCKNFLLQXXNPVSLVSSLVSIILPRSDCQLMQQQCCQRLTQIPQQLHCAAIHNVAHSIIMQQEQQRGVQILRPLFQLAQGLGIIQPXQXXQLEGIXXLGLKTLPTMCNEYVPP

SEQ ID NO: 206478 - protein, 123 aa, Triticum aestivum
  Clone ID: PAT_TA_100896.pep
RRRLPGRRRAPTSPPAAPIPAPYLSTGARPRRPLPPRELSHNDRPSQDTGPIPCRRLDAARETPAAAGSRDAFLHNAVIPGFADSGLPGSALAAYRSMLAAVARLTASPSPSSSSAARAQAPR

SEQ ID NO: 206479 - protein, 77 aa, Triticum aestivum
  Clone ID: PAT_TA_100897.pep
NIYFFASSFILTLCGSRSALTPLSILTSSLNIILFRARCDWGHNRSPRLQEPLKHLTFSNPNIGSDLSRPLKLVMKN

SEQ ID NO: 206480 - protein, 211 aa, Triticum aestivum
  unsure (1)..(211): unsure at all Xaa locations
  Clone ID: PAT_TA_100898.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPQPQQQLPQPQQPQQSFPQQQRPFIQPSLQQQLNPCKNILLXQCKPASLVSSLWSIIXXXSDX

SEQ ID NO: 206481 - protein, 183 aa, Triticum aestivum
  unsure (1)..(183): unsure at all Xaa locations
  Clone ID: PAT_TA_100899.pep
MKTLLILTILAMATTIATANMQVDPSGQVQWPQQQPFPQPQQPFCQQPQQTIPQPHQTFHHQPQQSFPQQQQPAIQSFLQQQMNPCKNFLLQQCNHVSLVSSLVSIILPXSDCQVMXXQCCQQXXQIPQQLQCALIHRVAHSIIMQQEQQQGVPIXXXLFQLAQGLGIIXXXQPAQLEGITSL

SEQ ID NO: 206482 - protein, 201 aa, Triticum aestivum
  unsure (1)..(201): unsure at all Xaa locations
  Clone ID: PAT_TA_100900.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHAIVLQQQQQLVQGISTQPQQQQQQGQQQQGQGSSQPQQQTQLDQGWIAVIGTWVIQXIPAMCDVHVPPYCYTTISPSIDVTTGMGGYW

SEQ ID NO: 206483 - protein, 198 aa, Triticum aestivum
  unsure (1)..(198): unsure at all Xaa locations
  Clone ID: PAT_TA_100901.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHAIVLQQQQQLVQGISTQPQQQQQQGQQQQGQGSSQPQQQTQLDQGWIAVIGTWVIXXIPAMCDVHVPPYCYTTISPSIDVTTGMG

SEQ ID NO: 206484 - protein, 139 aa, Triticum aestivum
  unsure (1)..(139): unsure at all Xaa locations
  Clone ID: PAT_TA_100902.pep
HLGLGPGTISPARGFRLGSRPHPPXTCWXXIPPADXVFLKWVMHDWGDEDCIKILKNCKKAIAPKDAGGKVIIVDMVIGAGPQDPKHKETQVMFDLFIMFINGVERDEQEWKKIIFEAGFNDYKITPILGVRSIIEVYP

SEQ ID NO: 206485 - protein, 139 aa, Triticum aestivum
  unsure (1)..(139): unsure at all Xaa locations
  Clone ID: PAT_TA_100903.pep
FPRPPIGGQGGIXXFXGGXAXGXSIDXIXLKPXQXXLEXXSXWAXLANDLXXNDKRISESDKNXPNLYXQXGKXVTRGTFNQRAKITLPKKRSLERFLFQVKAPPWNTALMWSVAWIGNLKHKDLXGHVVSSHGVWRRG

SEQ ID NO: 206486 - protein, 71 aa, Triticum aestivum
  unsure (1)..(71): unsure at all Xaa locations
  Clone ID: PAT_TA_100904.pep
SCGGQSPYGYDPCKGIHTDKRYNLXLGLGLNKVAGKXXRIGHXAXLXELQIVXCXSXXEMVXKDIGXVLYS

SEQ ID NO: 206487 - protein, 66 aa, Triticum aestivum
  Clone ID: PAT_TA_100905.pep
SAAARAGTYHVCFLDNICIMFFILERVSFAGFLFFSLFQSCDSTHVSSQLVEPKRMKRRLDLSCYI

SEQ ID NO: 206488 - protein, 90 aa, Triticum aestivum
  Clone ID: PAT_TA_100906.pep
VRARSAALRRIRPRRCWSGGHTRLLLHCSWSPSSTHERDGLQEVRGPGFASINGILHHATYLNCTTPTPSSSCLRLPIDSRFYCQWSDVV

SEQ ID NO: 206489 - protein, 156 aa, Triticum aestivum
  unsure (1)..(156): unsure at all Xaa locations
  Clone ID: PAT_TA_100907.pep
KXXREKVPXNXKXGXQQGTFGPLQXXXKVXHXXSFIDXRXXHWREILXXESHVGXNTPEGRLHRPEKETGHLRLRQRRSVQEISSLHSRLGKTQTPGLGKYMNMDIHIFLGTNKKDKWRRKTQSNVRVDKTAMALYIWPVVSELFRPCRTPRSPVT

SEQ ID NO: 206490 - protein, 93 aa, Triticum aestivum
  unsure (1)..(93): unsure at all Xaa locations
  Clone ID: PAT_TA_100908.pep
ILCXCEEWKLNKCIQDEVKYGDNRAFKPWXKXNYXALLPCPGXGRXENXKFPXGPXMGGPGXXAXVPGPKFSPXSXXPFKXFHWAXXFLKPXW

SEQ ID NO: 206491 - protein, 82 aa, Triticum aestivum
  unsure (1)..(82): unsure at all Xaa locations
  Clone ID: PAT_TA_100909.pep
PPGQVNTFAIYGNGEDKXELTELVPGILNQLGPDSLASLRKLAESYQSLQKNAEGEDKKDDDDDEIPDLVEGENFESKGEVE

SEQ ID NO: 206492 - protein, 49 aa, Triticum aestivum
  unsure (1)..(49): unsure at all Xaa locations
  Clone ID: PAT_TA_100910.pep
KCTLFVVSFXRKGEKTRQFTSISSTLPFMIKKNFCNTLSYRKCXGTTMA

SEQ ID NO: 206493 - protein, 112 aa, Triticum aestivum
  unsure (1)..(112): unsure at all Xaa locations
  Clone ID: PAT_TA_100911.pep
PPEQVNPVNXRXIRIXPPLPHGXXMXFSXLFXGSNVVDXHRDXXLDIXSMXYEXXXALEXHIGDVXTXLAKXHXVDKLKISLXVPGATXVSNQSSEPSTENEACIXXQXXYL

SEQ ID NO: 206494 - protein, 60 aa, Triticum aestivum
  unsure (1)..(60): unsure at all Xaa locations
  Clone ID: PAT_TA_100912.pep
QAVLLNWVRNLDEFPVATFKCHYLTYPPLYTGFQXLLLPGEFFLKFKXSLKIGXLARXAP

SEQ ID NO: 206495 - protein, 78 aa, Triticum aestivum
  unsure (1)..(78): unsure at all Xaa locations
  Clone ID: PAT_TA_100913.pep
NIQNXSXLXXNXXVSFHFFSFXQVXMPXXHXHVSSVIXLKRSSRRILLYNVNSTHLXXSXTCTXWPLSXSXSYLXXEQ

SEQ ID NO: 206496 - protein, 84 aa, Triticum aestivum
  Clone ID: PAT_TA_100914.pep
PAPIGGNWIGAPPRPTRGKKRIWRLLERGRYSIADIKTYPWVKNWERSGFSKEEMAFPHLLKWVDRIAERPAVQRGIGEAYVKK

SEQ ID NO: 206497 - protein, 85 aa, Triticum aestivum
  unsure (1)..(85): unsure at all Xaa locations
  Clone ID: PAT_TA_100915.pep
XXSQVFXAPGRXLLIKGGISDCCQTSKYPCHSTFFRQSKYILELNIGTIDSFNPMNSMQKSIIDSRITYGDLKLRANLQPEEQCS

SEQ ID NO: 206498 - protein, 52 aa, Triticum aestivum
  Clone ID: PAT_TA_100916.pep
FILMCVRERDARLELQVEHGEFHLFIPSRTVKNETEFLIKINQIDEGEMCTN

SEQ ID NO: 206499 - protein, 127 aa, Triticum aestivum
  unsure (1)..(127): unsure at all Xaa locations
  Clone ID: PAT_TA_100917.pep
PFPKCXPFXXFFVPXSPXTFPXIXCTKXIVGFXIPXLLNWFPHCLLINKQSTXXASCTIPXSSSHVVLIPPLQTPSAMVFNSXSRGSTYQQHLRRRWLQPSRAGRKGAGRERACLQTLSFAGLGQFE

SEQ ID NO: 206500 - protein, 131 aa, Triticum aestivum
  unsure (1)..(131): unsure at all Xaa locations
  Clone ID: PAT_TA_100918.pep
QGFFNQFHXGFGFHWKGXENFXGEDPGVGGPFKLKPKLFPLCSPFSPLPIALCQILAYHRVFDXTLLTLLTSSIAVRPCIFEFKSNSCQRKDLGKSSESGFKVHGDIATAERDIGQHMLLLLVLRAEMYLG

SEQ ID NO: 206501 - protein, 68 aa, Triticum aestivum
  Clone ID: PAT_TA_100919.pep
ITCHPSMTTMMSSLPSGMLHRCTQDAPMLQSTSSILIGLLCNLNKLFSGLLVLFIIHCVYCVPRPRPR

SEQ ID NO: 206502 - protein, 108 aa, Triticum aestivum
  unsure (1)..(108): unsure at all Xaa locations
  Clone ID: PAT_TA_100920.pep
RVRAGVPCIITYLRLIEVFSYLFLCRXKXPXSYVKNKLIIMTSPXGAPRVLGPVILTTESPVEXMTSPPRYRSIXISKRHQPKLNLFPLTLSSPIXPIFILLSLYPVY

SEQ ID NO: 206503 - protein, 52 aa, Triticum aestivum
  Clone ID: PAT_TA_100921.pep
LMTKQNGRTTTLLYGTTRQIHRDAPPFPLLAFTLTVYGVSSSNFTKSSEYLG

SEQ ID NO: 206504 - protein, 43 aa, Triticum aestivum
  Clone ID: PAT_TA_100922.pep
MDEHIDRSPTSVTCMNQLKLPPYATKEMLRDKLLQAVRSAAGL

SEQ ID NO: 206505 - protein, 71 aa, Triticum aestivum
  Clone ID: PAT_TA_100923.pep
INFNFQQHGLNLQGLSALSNTSRETEHSTGRQNTSTSFTAALPWSVIIVVRLQNQDSDGNPWCTATSRCTS

SEQ ID NO: 206506 - protein, 138 aa, Triticum aestivum
  unsure (1)..(138): unsure at all Xaa locations
  Clone ID: PAT_TA_100924.pep
GPEFVNNTLKRGPLFILPKTPPKLAPKGKKIGREPVIRKFRGNGKXTLGFVDLFARXNFIEKXRAXGGYLFSLRTWVSMPGVIPVASGGXXXXHXPXXTEXFGGDSXLQFXXGTLGHPWGNAPGAAANRVALEACVPR

SEQ ID NO: 206507 - protein, 79 aa, Triticum aestivum
  unsure (1)..(79): unsure at all Xaa locations
  Clone ID: PAT_TA_100925.pep
MGGGNAQKSKMARERNLEKLKGGKGSQLEANKKAMNIQXCRICMQTFICTTSEAKCKEHAXEAKHPKSELVQXFPQLKQ

SEQ ID NO: 206508 - protein, 78 aa, Triticum aestivum
  unsure (1)..(78): unsure at all Xaa locations
  Clone ID: PAT_TA_100926.pep
YLPARNSNLIAFHTSQAAAXSGLHLXAAXGXFHYLRXQXXRPFFXXLVTRAGXHPNRNPXVXNGLAXXNCKFRPNSPX

SEQ ID NO: 206509 - protein, 70 aa, Triticum aestivum
  unsure (1)..(70): unsure at all Xaa locations
  Clone ID: PAT_TA_100927.pep
RAGEGHVLVAXHDXXAPDLXSXATNNRTCESSTTLIXPCXPLCXRXITVLNKGRXCNRMKYANVAVVPRP

SEQ ID NO: 206510 - protein, 139 aa, Triticum aestivum
  unsure (1)..(139): unsure at all Xaa locations
  Clone ID: PAT_TA_100928.pep
PGQVHVQHLLXVXGCGGAFLHPTHVFXNFKECYGNKYETKAXYPSYEDSSKIALGNILKFRRKNWQFDVIGGFVYFVLVFSMFPQCDSFRILHEDSWDGRVNSFFNATWNAIFEILEHSYVSLAGVLTLLTVSFFFVPR

SEQ ID NO: 206511 - protein, 102 aa, Triticum aestivum
  unsure (1)..(102): unsure at all Xaa locations
  Clone ID: PAT_TA_100929.pep
GTVVGKLEGEREMTLGFVDLLRDDFIEKDRARGIFFTQDWVSMPGVIPVASGGIHVWHMPALTEIFGDDSVLQFGGGTLGXXWGNAPGAAANRVALEACVPR

SEQ ID NO: 206512 - protein, 76 aa, Triticum aestivum
  Clone ID: PAT_TA_100930.pep
VKGKYCIYISFSNYSHEKNKPIPLELNYSQEEVDKTAITNALLLFTLKGKLLRPQLLPAKQRFVSPRHVEAFARPV

SEQ ID NO: 206513 - protein, 147 aa, Triticum aestivum
  unsure (1)..(147): unsure at all Xaa locations
  Clone ID: PAT_TA_100931.pep
XGXRKXAXRFLFDLIXXDFFEKNFASPFFFXLQDWLSLXQVXFPVASXGGIHVWHFPAXLTEXFGXDFVXQFVGGTLGHPWGNALGAAVNGVALEACVQVXNEGRDLAREGNEIIRAACKWSPELAAACEVWKATKFEFEPVDTIDK

SEQ ID NO: 206514 - protein, 50 aa, Triticum aestivum
  unsure (1)..(50): unsure at all Xaa locations
  Clone ID: PAT_TA_100932.pep
GCDQLIXTPSTPPSKLFPYVTLIQELSHQTMFPLYKTQTEIPVILSTSAA

SEQ ID NO: 206515 - protein, 59 aa, Triticum aestivum
  Clone ID: PAT_TA_100933.pep
EVPSNCKSKPFAWWIAVWRYLVSWPQENLAASGTSLAISSMLRLMQTVIAGMTRNGTCC

SEQ ID NO: 206516 - protein, 76 aa, Triticum aestivum
  Clone ID: PAT_TA_100934.pep
TDELNAYLVKYRIVLDPQLEALIGRHNRKPWSKFVNAENRHLVSEEAIDFLDKLLRFDHQDRLTAEEAMAHEYLGR

SEQ ID NO: 206517 - protein, 151 aa, Triticum aestivum
  unsure (1)..(151): unsure at all Xaa locations
  Clone ID: PAT_TA_100935.pep
TVHSGQAIYKVPLQFLSTLTLLLXFPSPFIFLICSLRICVCXCSCTLPSLVFGSXPVGSAVMRFLARNVAAAIVDAPVSFSADATTLRVFFRHDFADKFRHGRRGHEENDGELEDLHGRCSCCRSFDSWTFPNVEKKEKEEMGEASGYVPR

SEQ ID NO: 206518 - protein, 126 aa, Triticum aestivum
  unsure (1)..(126): unsure at all Xaa locations
  Clone ID: PAT_TA_100936.pep
XARSXHCSXPXIXGRGGXXIGSGPPGPGXEPKGGNXIHNIFIPVNFFGCDYCWYITGGTRFGLPEPLEAVXGXLDGLVSPPSCLINLCGRTLSSFLPLSFFWXAQKVTXSRPAEFTSFFAQCFRYR

SEQ ID NO: 206519 - protein, 68 aa, Triticum aestivum
  unsure (1)..(68): unsure at all Xaa locations
  Clone ID: PAT_TA_100937.pep
EVPAASDQISPGDLVVVYMHYSRPSYPSLKRTNRKSPSGARFHALKAGRYNCSPPATSFNREXGGPTE

SEQ ID NO: 206520 - protein, 136 aa, Triticum aestivum
  unsure (1)..(136): unsure at all Xaa locations
  Clone ID: PAT_TA_100938.pep
RGVWXMPTLTEIFXDNSVLXFXGGTLXHPWGNAPGAAANRVALXACVQAXNEGRDLAHEXNXIIXAACKXXPELPASCELWKAXKFEFEPVDTIDNVDKTDKGTGMFPLSGNGAPKSNSPRPQWLPGNISTSPNSP

SEQ ID NO: 206521 - protein, 96 aa, Triticum aestivum
  unsure (1)..(96): unsure at all Xaa locations
  Clone ID: PAT_TA_100939.pep
VRYRQIAVGRSARSFAMSDHSNALHQMKRMSSSCPGPSFYASHRSRVGAVVVCVYPSHRLRHTHISSVHCMHRCIYGLLMGTTISNSFCSXXITVL

SEQ ID NO: 206522 - protein, 112 aa, Triticum aestivum
  Clone ID: PAT_TA_100940.pep
KRGLPHAHILLFLDPDDRDPSPQNIDKIISAEVPDKDVDPEGYMAVENFMMHGPCGQACYKSPCMINGKCSKHFPKMFCAESSIDEEGFPIYRRRNNARTIEKSGVPRPRPR

SEQ ID NO: 206523 - protein, 67 aa, Triticum aestivum
  unsure (1)..(67): unsure at all Xaa locations
  Clone ID: PAT_TA_100941.pep
IQKVFSLSYIGNNTSLACLLDFSTLHLYASIRTNFLFKQHITDQHKCLVKTNIHIYSFIGTSSTXAV

SEQ ID NO: 206524 - protein, 58 aa, Triticum aestivum
  Clone ID: PAT_TA_100942.pep
LVSLMMSTNRSNITCSRSIAQKTIRRDTGTGLSRTLPPTQPLFRPPQHMKRLGKSRGP

SEQ ID NO: 206525 - protein, 62 aa, Triticum aestivum
  Clone ID: PAT_TA_100943.pep
RGRGRGAGAHGLPLGHAPSRAGAGAAAGRAAGGESAASASERQCGSDKSQELLVVTGQCVIS

SEQ ID NO: 206526 - protein, 60 aa, Triticum aestivum
  Clone ID: PAT_TA_100944.pep
RGRGRGTVILVHKAGTSGAVAPQSGFVSLDERFKILKEVDWESLQKQQESPVESAVPAAS

SEQ ID NO: 206527 - protein, 32 aa, Triticum aestivum
  unsure (1)..(32): unsure at all Xaa locations
  Clone ID: PAT_TA_100945.pep
MTETNYGYCHRFKQASYSIXXNVVXTSAATTL

SEQ ID NO: 206528 - protein, 81 aa, Triticum aestivum
  unsure (1)..(81): unsure at all Xaa locations
  Clone ID: PAT_TA_100946.pep
GRPGRYTWEESTVAWGVCNHAFHFHXLSKWVXTLQMCPLYNXXWEXXXXXXTLLRHWAAACYLPTTTPPKAQAYLLSSVIS

SEQ ID NO: 206529 - protein, 105 aa, Triticum aestivum
  Clone ID: PAT_TA_100947.pep
EWQCRQFEKVSSRTPELMRKMRANAQKMRVHFKDTEDLKTWDAYERNVLYACEHYLKTSLATPAVTPNSVLYEDLMKRKAYSKTRSGLLSMGLNKFKYCTCPGGR

SEQ ID NO: 206530 - protein, 68 aa, Triticum aestivum
  unsure (1)..(68): unsure at all Xaa locations
  Clone ID: PAT_TA_100948.pep
LTTCCVSRILDAGLPMESYEFYLDXXRYGSVKHIGFGLGXQRMLLFVTGLDNIIDVIPLPRYLPGRLE

SEQ ID NO: 206531 - protein, 70 aa, Triticum aestivum
  unsure (1)..(70): unsure at all Xaa locations
  Clone ID: PAT_TA_100949.pep
TKIHTKNXKLMFAACNQCDTMLKLKGGSSCGTSSLRHHSDSCRCKPKQEQLPENSSFMPIPSFALQAITE

SEQ ID NO: 206532 - protein, 117 aa, Triticum aestivum
  unsure (1)..(117): unsure at all Xaa locations
  Clone ID: PAT_TA_100950.pep
SVVAAEVHXXXTLXXNXXXXVNGGDKATGVDPXADINIEQSFXCIMXXXKHSIRIXXLEHPPKNLINTNYILCLQDRLIKAPGAGEPGKKRAASPVVSAXXXLSSALLWYLPGRPLX

SEQ ID NO: 206533 - protein, 109 aa, Triticum aestivum
  unsure (1)..(109): unsure at all Xaa locations
  Clone ID: PAT_TA_100951.pep
XIGNGYAPVLDCXXXXHIAVKCAELVTKIDRRSGKEIXXALKFLKNGDXGIVXXIXXKPMVVETXATYPPLGRYAVRDMRQTXAVGVIKGVEKKDPTGAKVTKAAIKKK

SEQ ID NO: 206534 - protein, 54 aa, Triticum aestivum
  Clone ID: PAT_TA_100952.pep
LAHDLFNDSSSVNIYPGDLRCGMPSNSKGRGSSKCRRCRSLLVSPIDDGWLLLV

SEQ ID NO: 206535 - protein, 72 aa, Triticum aestivum
  Clone ID: PAT_TA_100953.pep
SSGRPGRYSTKSNKTTMAKTEQMSYHHDHMPLASAELPTNPPFSRCSSISTALRSGWPYRSGYDLPQTYAML

SEQ ID NO: 206536 - protein, 73 aa, Triticum aestivum
  Clone ID: PAT_TA_100954.pep
RAAARAGTWKLERVIPDHDNVASLSERPSSMDCAALGFNVMIKFELSATSCDYHEWVRLPLKHHEWMQMYGDQ

SEQ ID NO: 206537 - protein, 71 aa, Triticum aestivum
  unsure (1)..(71): unsure at all Xaa locations
  Clone ID: PAT_TA_100955.pep
SVVAAEVLHRGTRFHLHGLGSVGAVFIGEFEEVFVFARWPLGVGFGEFRERFHQXXHLHDLDVAVPARAAA

SEQ ID NO: 206538 - protein, 62 aa, Triticum aestivum
  Clone ID: PAT_TA_100956.pep
SPARSTISFNIGIVSVYGLYGCRIVGLLSFCLSDYWCLAVCILVMQRPGDTLNALYHFDAIF

SEQ ID NO: 206539 - protein, 73 aa, Triticum aestivum
  Clone ID: PAT_TA_100957.pep
FERPPGQVWASGLTWREIMMDSAMDDGDLARLLRRTMDLLAQIPKLPDIDPVLQKNAQIACSVMDRVLGRDHA

SEQ ID NO: 206540 - protein, 64 aa, Triticum aestivum
  Clone ID: PAT_TA_100958.pep
RPPGQVLLINLANQVHHSSLRRNTSFLQVSRRCFQLASLVRPGESLVNQVHLHDTDQGALFPFG

SEQ ID NO: 206541 - protein, 86 aa, Triticum aestivum
  Clone ID: PAT_TA_100959.pep
AWSRPRYLKLKKEEIERFAAIEEKKLEDPYSISRCVTTLERLPGLQMADMVMAADIFKSKENRELFLSFSTDEPRLAWLKRQIGHI

SEQ ID NO: 206542 - protein, 40 aa, Triticum aestivum
  Clone ID: PAT_TA_100960.pep
TYEFLAPEVLDMARVSSASIILESFSLNLQRGDYSVVGTP

SEQ ID NO: 206543 - protein, 101 aa, Triticum aestivum
  Clone ID: PAT_TA_100961.pep
RGRGRGGKGISELERAVIEVRGLESIPSGGRRWTVNQRQLEQLMRTQEAFTRLESSINEQLPLDFWTIDLREAALALATISGEDISEEVLSSIFSKFCIGK

SEQ ID NO: 206544 - protein, 56 aa, Triticum aestivum
  Clone ID: PAT_TA_100962.pep
YSGISTIKTSKRQHDLQLLSSSELEGHDIDITGRVWSSARKELLKGSAIDKSWGSK

SEQ ID NO: 206545 - protein, 106 aa, Triticum aestivum
  Clone ID: PAT_TA_100963.pep
AWSRPRYSLGISTYINNVFEDLRNGWVLLEVMDKVAPGSVNWKFANRPPIKLPFRKVENCNQVLKIGKEIKFSLVNIAGHDIVQGNKKLILAFLWQLMRYLPGRPL

SEQ ID NO: 206546 - protein, 35 aa, Triticum aestivum
  unsure (1)..(35): unsure at all Xaa locations
  Clone ID: PAT_TA_100964.pep
VPDQLNKYIGESEPGVRKIXTRASTNSPYILFLER

SEQ ID NO: 206547 - protein, 202 aa, Triticum aestivum
  unsure (1)..(202): unsure at all Xaa locations
  Clone ID: PAT_TA_100965.pep
GRPGRYRKLLGAVVVIAANAGGAWTPIGDVTTTMLWIHGQITTLKIMQGLFVPSVVSLMVPLALMSLTSEANGSSHESSSLLSSEQMAPRGQLVFAVGLGALVFVPVFKSLTGLPPFMGMLLGLGILWILTDAIHYGESGRQRLKVPQALSRIDTQGILFFXXILLSVGSLEAAGILRQLANXLDANIPNADLIASICSISN

SEQ ID NO: 206548 - protein, 60 aa, Triticum aestivum
  Clone ID: PAT_TA_100966.pep
AWSRPRYSGTGLETYCCFRAHLLLFRLLRLKLVKNYKSRSDVTQNGKSYCCYFRYNDSFS

SEQ ID NO: 206549 - protein, 93 aa, Triticum aestivum
  Clone ID: PAT_TA_100967.pep
FERPPGQVQRMPIPYADRSDEDWTACPNHQSTSAMSPPALLRRPSLSLCLPSQFLRGSGPNKTPQRSKRNDYVKARYKSSPANVHPQYLGRDH

SEQ ID NO: 206550 - protein, 63 aa, Triticum aestivum
  unsure (1)..(63): unsure at all Xaa locations
  Clone ID: PAT_TA_100968.pep
RGRGXRYTVSHSISLLNLERRRXXEKXQGRKGMGASDLXXIKFASSVSSPSFPXXYXPGRPXX

SEQ ID NO: 206551 - protein, 99 aa, Triticum aestivum
  unsure (1)..(99): unsure at all Xaa locations
  Clone ID: PAT_TA_100969.pep
XVVAAEVHDNKQDTHTHTQGAKMAFGDANQNYQCHLLKIDTTQAIQTSKFRVISCHFLTERKYRHFYVHNTPIFSICFYLSKLMSKILGTNRTCPGGRS

SEQ ID NO: 206552 - protein, 48 aa, Triticum aestivum
  Clone ID: PAT_TA_100970.pep
ALICQKLTKPYSAVIKVDRHKYQSLHRDRCVVAIFCIVLTTLHRGVAS

SEQ ID NO: 206553 - protein, 119 aa, Triticum aestivum
  unsure (1)..(119): unsure at all Xaa locations
  Clone ID: PAT_TA_100971.pep
XTLVPPKMEKKSDLLSYQNNIIYTWTKTPRDKWTIVTGHATCVEPANQHNNATRLPAYAVQHFNFALVKKKGHHIFQAALLFRHRCPLHLCYSLLPVVFPLRRKIHVHGPRYLPGRPLE

SEQ ID NO: 206554 - protein, 50 aa, Triticum aestivum
  Clone ID: PAT_TA_100972.pep
GLKYLDLLSLPAQQNSENRQVRKKCKRPHTLNQLLSNINYISCTSAATTL

SEQ ID NO: 206555 - protein, 119 aa, Triticum aestivum
  Clone ID: PAT_TA_100973.pep
MHLLVIFMPLPLLSRHMTRHFLPQSFFLLFSSPTCTRSNIEARLNIAILQICQVHPHEIDSSVADKKSRLANLGSIRSCLHRKEHCLMPSSRKLEGVGFSLGKSPLQLAVLVPARAAAR

SEQ ID NO: 206556 - protein, 71 aa, Triticum aestivum
  Clone ID: PAT_TA_100974.pep
LLLSFCRSLLRGARVCRGRGRGRGKLFYFSAYIYDHTVVTHISSTTKRNIQTRHPKKAENKNTTISIKQIG

SEQ ID NO: 206557 - protein, 49 aa, Triticum aestivum
  Clone ID: PAT_TA_100975.pep
MSCFQGLFFCSQVAFLLLHNVCIYHITPQCHELGAAPIPSDVPARAAAR

SEQ ID NO: 206558 - protein, 48 aa, Triticum aestivum
  Clone ID: PAT_TA_100976.pep
KVWGFCTGIENEFRHEFHKVINHMLTVDEIDRGSVVSATGEVPARAAA

SEQ ID NO: 206559 - protein, 117 aa, Triticum aestivum
  unsure (1)..(117): unsure at all Xaa locations
  Clone ID: PAT_TA_100977.pep
ERPPGQVFSLVSPLHNEQTLQSCGWDVATGCAGIXMLEKPTAYIGKRFKXDGFEGKLDASNIRETIIRATGLCINSSSWTGIPDYCRFSFALEXGKFERAMGCITRFKELVLGXCSG

SEQ ID NO: 206560 - protein, 83 aa, Triticum aestivum
  Clone ID: PAT_TA_100978.pep
AAARAGTSATICSTSSNACRETAHFSTTLSYVNSQDNMINGRTVVNRAVSCSTYPRTRTCVLNLEIKMFLHLAAQNSVIHRNP

SEQ ID NO: 206561 - protein, 77 aa, Triticum aestivum
  Clone ID: PAT_TA_100979.pep
MHKLIVFQGYAYILTHPGIPTVFYDHFFDWGDSFHDEIAKLMEIRKSQDIHSRSAVKILEASSNLYFVCLFVPARAA

SEQ ID NO: 206562 - protein, 163 aa, Triticum aestivum
  Clone ID: PAT_TA_100980.pep
VVAAEVPNCIAKSPGSNANSKKWLAADQLQAQDVDVTGMTLRRPIDRGYLINTEVQREVWERVLRSLLQVDPTNSSLLLVEPQFNPPGLQHATDELVFEEFGFNSLCVADAPSLVHLYEASRQPSLFHTQCSLVMDCGFSFTHASPVLQNFTLNYAVPARAAR

SEQ ID NO: 206563 - protein, 45 aa, Triticum aestivum
  unsure (1)..(45): unsure at all Xaa locations
  Clone ID: PAT_TA_100981.pep
SSGRPGRSFLTNAESXXLCIKKRNFLDLKKKKKRILLIFIFHLFS

SEQ ID NO: 206564 - protein, 83 aa, Triticum aestivum
  Clone ID: PAT_TA_100982.pep
HVMEDKPIRQNMMLCLKATFFGHSSPSHPEGFHKFRSMKSCTSSATTFSSQQPKQPGHSRLGLLDKLQLWYPASCGFFLSADL

SEQ ID NO: 206565 - protein, 100 aa, Triticum aestivum
  Clone ID: PAT_TA_100983.pep
FHIVNFHYATTGANTTSLLMLINRPTIQFYHRKKKPYSILKFIPRPRETQSQSRCRKLNLPTAMSSLGGTELSKWLNEVQAFFFFFFFGVSKTGFTPHEK

SEQ ID NO: 206566 - protein, 75 aa, Triticum aestivum
  Clone ID: PAT_TA_100984.pep
IGNIQLAGDGTTAAITTGDGTTAVTCRFIKGVDKRAIITRGWSGFFRQAHIKKGQAYAFAFKCTFKGLCLIVYSI

SEQ ID NO: 206567 - protein, 65 aa, Triticum aestivum
  Clone ID: PAT_TA_100985.pep
MGLTFSKLFDRLWGKKEMRILMVGLDAAGKTTILYKLKLGEIVTTIPTIGFNVETVEYLPGRPLE

SEQ ID NO: 206568 - protein, 131 aa, Triticum aestivum
  unsure (1)..(131): unsure at all Xaa locations
  Clone ID: PAT_TA_100986.pep
RGRGRGDGVLTDQNRAMEVAVSXIYPETVHRWCKWHILKISKECLGPLYTKKNEFRAEFHDVVNHMLTVVEFENAWAMSLKMYNLKQHLYMTHIYEIRTKWAKPYFKGVFCTKMAITWWTESANRTCPGGR

SEQ ID NO: 206569 - protein, 76 aa, Triticum aestivum
  Clone ID: PAT_TA_100987.pep
EFLLTPPQREIEVQSYSGSHHPLKLQRVDWEKPPSIYKSSFLHLHYKKNKEYEKVTLDHNSRNVLLFAPFYLKYIL

SEQ ID NO: 206570 - protein, 60 aa, Triticum aestivum
  unsure (1)..(60): unsure at all Xaa locations
  Clone ID: PAT_TA_100988.pep
AWSRPRYQRTNRFVSXMENSMXXRMSEPIWLHKTLVHXIVDPLQHXXDLQNXXRPAWCLY

SEQ ID NO: 206571 - protein, 64 aa, Triticum aestivum
  Clone ID: PAT_TA_100989.pep
KMQLPHYYVVSQLHSNINQLKSIIRRYELNQLHACMHGIRCQRLTKFFSRDDDSIHQVIKKRKR

SEQ ID NO: 206572 - protein, 163 aa, Triticum aestivum
  unsure (1)..(163): unsure at all Xaa locations
  Clone ID: PAT_TA_100990.pep
EKKGGGALSPFFGAPFKFFHPPPPPPPNLPFPPPLPFLPLPPPPLAGGAQLNSPGPPGGPEPSTLGPISPFRXGFTIPGAPFYNRGTGKTPGLPPFIPFAQIPLFPIGEKTKKAPPFPLSKXLPPLMGNGPPPXRALKXGGGGGFPXGDPXPXXXXNPXSFFS

SEQ ID NO: 206573 - protein, 82 aa, Triticum aestivum
  unsure (1)..(82): unsure at all Xaa locations
  Clone ID: PAT_TA_100991.pep
HFSWENICCPIIQIGLLLFLSSYPKLSTRXSISTILHTGASNYMNGDKALFTELDENISSNVKFGDDPTMDIHLHRFIDGTG

SEQ ID NO: 206574 - protein, 63 aa, Triticum aestivum
  Clone ID: PAT_TA_100992.pep
LHEDLDSPMVRRTREDTVRLGPRSRTSVPFHLFASLGRNILLRVRHDWRLVRNLGLVPRPRPR

SEQ ID NO: 206575 - protein, 51 aa, Triticum aestivum
  unsure (1)..(51): unsure at all Xaa locations
  Clone ID: PAT_TA_100993.pep
SVVAAEVPVSASSLLAYVINLYFQPFLFMVSRTTPRKNERLXXNSNYLCCI

SEQ ID NO: 206576 - protein, 143 aa, Triticum aestivum
  Clone ID: PAT_TA_100994.pep
AWSRPRCGEVVNSLSFTYSDCNGQVHIAGPWGRTVESHDGSSHQILLGDSEFLMEISGTVGPSPDHSDVVSSLLFVTNASSYGPYGQGGGTRFQSPRQRDAVIVGFFANGREFIEAIGVYFSPQEGTNEEEEDVVSGTCPGGR

SEQ ID NO: 206577 - protein, 45 aa, Triticum aestivum
  Clone ID: PAT_TA_100995.pep
NNLSSNFLDTACSWKSCWHHLQVPFIVDDPTLEAMLAIDLGRDHA

SEQ ID NO: 206578 - protein, 81 aa, Triticum aestivum
  Clone ID: PAT_TA_100996.pep
SSRPGRYKGIAPQLLKGFLVQGILMMTKERVELLFVLLFRYVRKIRKEQLEKLAKIAAEKVDQAKGQLRPVVEQVKEQVKA

SEQ ID NO: 206579 - protein, 55 aa, Triticum aestivum
  Clone ID: PAT_TA_100997.pep
KLVHCISQQKKKKKKKKSLYKNFYMENTYRTKNIIFGVTIMEHTLDISSQNKLKT

SEQ ID NO: 206580 - protein, 68 aa, Triticum aestivum
  Clone ID: PAT_TA_100998.pep
TSSRKRHKWSRNIPSCWVCDLSPCSGTQQIQFKLQKYDHCNSDSKPYISNGRIRSYQQSAIGRFKHAS

SEQ ID NO: 206581 - protein, 88 aa, Triticum aestivum
  Clone ID: PAT_TA_100999.pep
RAHRQPEEMDAEIPPGEIARGCWCSLDFMQFCGVLCTHQMHTVIRHVELPLRPVFSSSSDECVCRGTKLLDCNDMFLVSDKKTCPGGR

SEQ ID NO: 206582 - protein, 107 aa, Triticum aestivum
  Clone ID: PAT_TA_101000.pep
GAARSSITSMRRMTISNRGPSLKTECYIQNGSVHVHRLPDAQSVLSLFHSSFLFLHPRSCLYSSLDVRCRDYVYSMAPLLLLDAPCSVLVHKPQTEADPCTSAATTL

SEQ ID NO: 206583 - protein, 121 aa, Triticum aestivum
  Clone ID: PAT_TA_101001.pep
AWSRPRYWIATIYWSSLMSLFTFVPAACVFGASKVDWQNALSHTIYCTSSNVVDYMISAPSHGAVIGAWLGAWPMPLDWERSWQEWPICVTYGAIAGHVIGMLVSLILIVAHQRRARVKAD

SEQ ID NO: 206584 - protein, 168 aa, Triticum aestivum
  unsure (1)..(168): unsure at all Xaa locations
  Clone ID: PAT_TA_101002.pep
SSRPGRYLRTTSNEVVAVTGDGTNDAXALREADIGLAMGIAGTEVAKESADVVILDDNFSTIVTVAKWGRSVYVNIQKFVQFQLTVNIVALLVNFSSACFTGDAPLTAVQLLWVNMIMDTLGALALATEPPNDNLMEKAPVGRTGKFITNVMWRNILGQSLYLGRDHA

SEQ ID NO: 206585 - protein, 122 aa, Triticum aestivum
  Clone ID: PAT_TA_101003.pep
MGNHVMSERTTLDHCYSKQIHQKGRSNVITEDPLQVKNKMTNYLMSTETTLDHYNVKPSNQKGRKNVKFEDLPEDVLRTILSKLPVKEVLKTSALSSQWRYSWTICPKLSFNSVAVPRPRPR

SEQ ID NO: 206586 - protein, 87 aa, Triticum aestivum
  Clone ID: PAT_TA_101004.pep
NSYSPMSQEETNVVVFSAFTNGSIDANPMEENFSFSKKISDGSSCEDDVDFSRRSVFAANKNKVVEWKETTLYDYLFNLKKYLPGGR

SEQ ID NO: 206587 - protein, 110 aa, Triticum aestivum
  Clone ID: PAT_TA_101005.pep
KIVRKLKNVWQFHKYVPVSKFCSKFQKCSGNVKTYSHFANLFANSKHIFVLKKISHIQKMFIFENLFTNSKCVRMFNFCSQIIKYLVFQKCSCCPDLFTYSKKGTCPGGR

SEQ ID NO: 206588 - protein, 54 aa, Triticum aestivum
  Clone ID: PAT_TA_101006.pep
RAAARAGTSWDVFLPTRKREALCGAPISLMHIDVLLAQHFGCFVMLGLVYSLFL

SEQ ID NO: 206589 - protein, 76 aa, Triticum aestivum
  unsure (1)..(76): unsure at all Xaa locations
  Clone ID: PAT_TA_101007.pep
XVVAAEVPAREQLIVDGDXXDNIMPMGIRAQKSNTVKVIFISGPKALGANFLPNXXHTEVCFELXXHCVPARAXXR

SEQ ID NO: 206590 - protein, 105 aa, Triticum aestivum
  Clone ID: PAT_TA_101008.pep
MEISSNEPSEVENIIGHEDDTELTPREGMEFESEDAAREFYSLYARHAGFRIRISRYTRSRRDNSIISRRIVCSKEGFHETRNCEGLHPDQKQQERTGTSAATTL

SEQ ID NO: 206591 - protein, 126 aa, Triticum aestivum
  Clone ID: PAT_TA_101009.pep
RAAARAGARGAKVTDICIIVVSADDGVQPQTNEAIAHAKAARVPVVIAINKVDKEGANPERVMQELSQIGLMPEMWGGDTPMVQISALKGENVDELLETVMLVAELLELKANPHRNAKGTSAATTL

SEQ ID NO: 206592 - protein, 134 aa, Triticum aestivum
  unsure (1)..(134): unsure at all Xaa locations
  Clone ID: PAT_TA_101010.pep
GEHSVFITPAHRVCHNENDIDRYIELRTTEIKGYKGDLENQALVKLTSLTDHALFLGYNNTMCFATKDFPTLKPNCVYITDDSFEYVNMCKHNWRKTGVWNIKNXXLQTFDGDLLTNSWMNWPSPXWITPSLFY

SEQ ID NO: 206593 - protein, 72 aa, Triticum aestivum
  unsure (1)..(72): unsure at all Xaa locations
  Clone ID: PAT_TA_101011.pep
SAEPIFTAKIFAPYTLIQERVDLQVNQQNSKNASLRDKILAQTSPIPGRSLXDSMEHRRPTSTXXTCPGGRS

SEQ ID NO: 206594 - protein, 108 aa, Triticum aestivum
  Clone ID: PAT_TA_101012.pep
SSGRPGRYLATAVQVDPERPVLVDKYLNDAIEIDIDALADSVGNVVIGGIMEHIEQAGIHSGDSACSLPTRTVSTKCLDIIRSWTTKLAKRLNVCGLMNCQYLGRDHA

SEQ ID NO: 206595 - protein, 58 aa, Triticum aestivum
  Clone ID: PAT_TA_101013.pep
MGQVHANKLELNDALPNKSKQFIIWNMKCSDLMFDVLSFIKIGSFIPFYPLGQESLLE

SEQ ID NO: 206596 - protein, 64 aa, Triticum aestivum
  Clone ID: PAT_TA_101014.pep
RGRGRGTSPPLLQCLISHHDELVSVSHNDRYFKRHSLPGSSKNVCALEQIDPVDFLVCYYNYEG

SEQ ID NO: 206597 - protein, 143 aa, Triticum aestivum
  Clone ID: PAT_TA_101015.pep
SVVAAEVHCPLAARINYIPQASCKEIEQASPVSVLEYPAEDFSDTENIKKDTKDPHAPQPRPELVYFPSAETVAEVVVDAALGNYSCSEMESTEHDETIQLVEDTPCEFEDEEEREFCYLLDILIASGIHGVEEDQLYLPGRP

SEQ ID NO: 206598 - protein, 90 aa, Triticum aestivum
  Clone ID: PAT_TA_101016.pep
AAARAGVHTGTQTYSTHPHDTDHTTPPSIPRERNTQPTDTHHGTARINSLTATPRLRARRRATKQLQISGNSVTTLPLHVFSFLPRPRPR

SEQ ID NO: 206599 - protein, 49 aa, Triticum aestivum
  Clone ID: PAT_TA_101017.pep
PIFQSNLATKYEQIPLYAYQGGRKLRRNMNNQYHVKYCSKQPQHQPVST

SEQ ID NO: 206600 - protein, 49 aa, Triticum aestivum
  unsure (1)..(49): unsure at all Xaa locations
  Clone ID: PAT_TA_101018.pep
NYLAPMLGDVWVGAKKTLAPNPKLNTLLVVMXXFLLYLKKMRSTCPGGR

SEQ ID NO: 206601 - protein, 107 aa, Triticum aestivum
  unsure (1)..(107): unsure at all Xaa locations
  Clone ID: PAT_TA_101019.pep
XAAARAGTMTLSPGFSEKPRIIFGSTCPHPAVNVTRVNNCSSPKIFKTVTHYDIVPWIFRETSNYLRRHLSSPCVSTPEILGQAVQSTARTLAAPFSSRRHLGITPG

SEQ ID NO: 206602 - protein, 66 aa, Triticum aestivum
  unsure (1)..(66): unsure at all Xaa locations
  Clone ID: PAT_TA_101020.pep
APRFXGVRQGLKFKFKQWPMYKGYFLNFLLSPNLVFDQRKFFVPKNLGLXEKRFWGKAGFKNKTPV

SEQ ID NO: 206603 - protein, 44 aa, Triticum aestivum
  Clone ID: PAT_TA_101021.pep
FFFWSKGVFGLWPKCTLSKFWTQRLVFVWMVAKFLACQMNSSQL

SEQ ID NO: 206604 - protein, 53 aa, Triticum aestivum
  unsure (1)..(53): unsure at all Xaa locations
  Clone ID: PAT_TA_101022.pep
VESLSILVXXXEPLRRIRRDIAVYVQREFENVEGEIINANKDLFXXTSAATXL

SEQ ID NO: 206605 - protein, 35 aa, Triticum aestivum
  unsure (1)..(35): unsure at all Xaa locations
  Clone ID: PAT_TA_101023.pep
AGISGASLPNXLLMAKFNRHGAPMLCFHLPGRPLX

SEQ ID NO: 206606 - protein, 203 aa, Triticum aestivum
  unsure (1)..(203): unsure at all Xaa locations
  Clone ID: PAT_TA_101024.pep
VVAAEVLKTLREADEHNRNRCIQLRDCFDWRGHICIVTPLLGLSVFDFLKGGGFVPFPGSHIQAFARQLLGSIAFLHDLNLIHTDLKPENILLINHTYQTFTYNRNIPSSSTLTTRSAKFRRVLLSPQINLIDFGSATFDDEYHSSVVSTRHYRAPEIILGIGWSHPIDLWSLGCILVECWTGDALFQXHDCCEHLGMMEXVT

SEQ ID NO: 206607 - protein, 83 aa, Triticum aestivum
  Clone ID: PAT_TA_101025.pep
IIDIAQPSRCISCYPGLPVITEVLLQAYKECILKAMKESSNVFHHKFLELWNKQKDVNGEAYLPAIYINLKLLSVVPARAAAR

SEQ ID NO: 206608 - protein, 48 aa, Triticum aestivum
  Clone ID: PAT_TA_101026.pep
AWSRPRYRQRSSMFLLIHMIYIDRSLLRIRAFLTVVVRSSYLSFFFFF

SEQ ID NO: 206609 - protein, 75 aa, Triticum aestivum
  Clone ID: PAT_TA_101027.pep
SVVAAEVPPLLMGIGPWKAIPVALEKAGITKDDVDVFEVNEAFASQCLWCANELGLDMSKVNPLGGAIAFGHPLG

SEQ ID NO: 206610 - protein, 65 aa, Triticum aestivum
  unsure (1)..(65): unsure at all Xaa locations
  Clone ID: PAT_TA_101028.pep
SSGRPGRSRSMDPARQERFINRWIDELSDPRLTXXIKAMWLSXXSQAAKSLGQKLASRLSSKPSM

SEQ ID NO: 206611 - protein, 197 aa, Triticum aestivum
  unsure (1)..(197): unsure at all Xaa locations
  Clone ID: PAT_TA_101029.pep
FEPGXXLQTFNIMISVYXXGGKLDKAAEMFAAAQELGLLIDEKIYTNMLNFYGKAGRHQEASSLFDRMKEVGIMPGKISFNSMINAYATSRLHDEAEIVFQEMQSHSQVPDSTTYLALIRSYSESRCCSKAEKAIQMMLSSGITPSCPHFSHLIFAFLKADQIDETQRICSQMQEIGVAVDLACCRAMMRAYLGRDH

SEQ ID NO: 206612 - protein, 93 aa, Triticum aestivum
  Clone ID: PAT_TA_101030.pep
SVVAAEVGRGPLTTESAMKKIEDNNTLVFIVDLKADKKKIKAAVKKMFLYKLFFFFFFFFAGKNPGKYRELGSDNYSKGLIERSILSNTTLMN

SEQ ID NO: 206613 - protein, 97 aa, Triticum aestivum
  unsure (1)..(97): unsure at all Xaa locations
  Clone ID: PAT_TA_101031.pep
MGILSFTPLFSFTCFSMAASSTTQSIMHLPDQDPIDSKLIAQFAGVANGVHGCFCISWCKVEQKDLVIIHMRFIEVLTTCVLFRTPCTPGTSAATTX

SEQ ID NO: 206614 - protein, 63 aa, Triticum aestivum
  Clone ID: PAT_TA_101032.pep
ERPPGQVQFLNHLLFQFQVLARPKFSSVMASSGLSQEKDNKREIVCINLLSCFGNPRRKTKGR

SEQ ID NO: 206615 - protein, 70 aa, Triticum aestivum
  Clone ID: PAT_TA_101033.pep
SVVAAEVPEYHLWFTFLDTLNFSKFHGNNFAHLNYGATPSDYVLMIIMDYGMVRYSEASDCYLHYCIFKT

SEQ ID NO: 206616 - protein, 79 aa, Triticum aestivum
  unsure (1)..(79): unsure at all Xaa locations
  Clone ID: PAT_TA_101034.pep
AAARAGTVTRPRPNNLVVGLTIHTAWNLQTRSGDQDXXGGGGGVVDVVVSAITGAVEECDEEQDAEEGEAVPQPRPRPR

SEQ ID NO: 206617 - protein, 95 aa, Triticum aestivum
  Clone ID: PAT_TA_101035.pep
ELNLRQQDQRSITDHGSVKEKKTKTKTERGSKTKRNHLSLPPTRTILLLLLMLSLRSGMTKDAAARRSSFAIRNCSTDHAGVASRPYMQPARAAA

SEQ ID NO: 206618 - protein, 94 aa, Triticum aestivum
  unsure (1)..(94): unsure at all Xaa locations
  Clone ID: PAT_TA_101036.pep
LIIIRRLYFLSFLLCMCFLILRNRNLPQRPARPREXGPQTNAFFNDVQCQSIHSMFEISPVTMIVACLCCFSNYTCDLITPKINRGATSAATTL

SEQ ID NO: 206619 - protein, 130 aa, Triticum aestivum
  unsure (1)..(130): unsure at all Xaa locations
  Clone ID: PAT_TA_101037.pep
HLQHRXXXXMIIDAAKTRPPPRHVSRCHHEWVQQKSLAGVAFCLAGPRTPSPMQARRSSGPNKTCHWVQQISLAGEVIRLPGPNTPSPPLRHRRSTSPCRSQQNMSPXPTKIFACRXLSISPCYLGRDHA

SEQ ID NO: 206620 - protein, 158 aa, Triticum aestivum
  unsure (1)..(158): unsure at all Xaa locations
  Clone ID: PAT_TA_101038.pep
RGRGRIPVXVGMRFRMLFETEESSVRRYMGTITGISALDPARWPNSHWRSVKVGWDESTAGERQPRVSLWEIEPLTTYPMYSSPFPMRLKRPWPTGLPSLYGGKEDDLTSSLMWLRDGANPGFQSFNFGGLGMSPWMQPRMDSSLLGLQXDMYLPGRP

SEQ ID NO: 206621 - protein, 45 aa, Triticum aestivum
  Clone ID: PAT_TA_101039.pep
MQNCRHFLRGIKWGLTRLIPIPIKKTISAENAICMLAMLIPARAG

SEQ ID NO: 206622 - protein, 49 aa, Triticum aestivum
  unsure (1)..(49): unsure at all Xaa locations
  Clone ID: PAT_TA_101040.pep
FGGPRPPGDHFRLRGGFPNNQGEVEGEFNGGFKLGXXPPPGKKPGVFGP

SEQ ID NO: 206623 - protein, 90 aa, Triticum aestivum
  unsure (1)..(90): unsure at all Xaa locations
  Clone ID: PAT_TA_101041.pep
XAAARAGTHTPERKMSPIPCLSHSKPKGKGFQILTHEKPTAAINIHGSIFLLHAPFPKLVAASPYHKWLFHFIVISHLCFFSCLSSPWCL

SEQ ID NO: 206624 - protein, 54 aa, Triticum aestivum
  Clone ID: PAT_TA_101042.pep
LIRACRHILSIEDLCIHATASHASISQSWRTACRPLGRTLSRRWSRRRTCRAAA

SEQ ID NO: 206625 - protein, 110 aa, Triticum aestivum
  unsure (1)..(110): unsure at all Xaa locations
  Clone ID: PAT_TA_101043.pep
RDEIIAWKLHDALFTXLNEFYAXXXTSKDNWTLKFPSMTDCIFSCADTGGCVLHVARHFGAHKLKMPLTKAHTFPIYVSHVSHIISASLLVQTIRQCTVYCVQNEMGCPA

SEQ ID NO: 206626 - protein, 74 aa, Triticum aestivum
  Clone ID: PAT_TA_101044.pep
LLNAEKQCCLAGDVASTRKDIVELSFKDGAWKMLNYQIVVLSKRRRASSKNGVTWEDGSGVPVFAEYLPGRALE

SEQ ID NO: 206627 - protein, 77 aa, Triticum aestivum
  unsure (1)..(77): unsure at all Xaa locations
  Clone ID: PAT_TA_101045.pep
RGKVYGGTKMGLKSQPKLRVFLLIKIMPRVAKKKRATKRSKKQKPVNNFVVVAAAAXXQQSCLNGVPPDDLPGRPLK

SEQ ID NO: 206628 - protein, 89 aa, Triticum aestivum
  unsure (1)..(89): unsure at all Xaa locations
  Clone ID: PAT_TA_101046.pep
GFPGVAGVPVFSPFPRGTQKSXGPKGPKRGPFWGSAFPGGLLKDFFILREATPRNYLYPPPGPGDHXFFFNFFFFGTTVGTRIGGKFCP

SEQ ID NO: 206629 - protein, 55 aa, Triticum aestivum
  unsure (1)..(55): unsure at all Xaa locations
  Clone ID: PAT_TA_101047.pep
AAARAGTFYVLSLDRFMXXQMSTIFTFLCVLXXQXXNSFXLLGLPTHSDLRRDHA

SEQ ID NO: 206630 - protein, 67 aa, Triticum aestivum
  unsure (1)..(67): unsure at all Xaa locations
  Clone ID: PAT_TA_101048.pep
QLATIFYTFLYRSTMPNITTQVIIITQHTRAPMFQIFYXXKKPKKNLPSSNNYSTHQGPISNIQTXA

SEQ ID NO: 206631 - protein, 57 aa, Triticum aestivum
  Clone ID: PAT_TA_101049.pep
QNLTTRKCTIHTPTREKKAKTILPHLTGTKRLKTHRAISCCACSDCPYLGHLGRDHV

SEQ ID NO: 206632 - protein, 95 aa, Triticum aestivum
  unsure (1)..(95): unsure at all Xaa locations
  Clone ID: PAT_TA_101050.pep
XXLGFVDLLWDDFIVKDXALGIFFNQDWVSMPGVIPGRXXXGIHVWHXXXLXXXXGDDCVLQFGGGTIGHPWXXASGAAXXRVALEACVPRPRPR

SEQ ID NO: 206633 - protein, 99 aa, Triticum aestivum
  Clone ID: PAT_TA_101051.pep
SRLMSRNQILRNLRRKVLDQAANLISRFDAMPMAHALQHLQPLLLTSQMLMNILNTLQRRRLVFITRNQQHRDFDRAEARILHVHNDFTMRSVPARAAA

SEQ ID NO: 206634 - protein, 114 aa, Triticum aestivum
  unsure (1)..(114): unsure at all Xaa locations
  Clone ID: PAT_TA_101052.pep
KVPLDGLXXHRWAHRRRAVVTWHTLKILENKMRIALDASCIGIFFSLGFVCVFRFPTWLXVFLFILYFFWVIWIFLVGVLVFFSCFTIFSELFCAPVLHTLIHXGSTSALHTGD

SEQ ID NO: 206635 - protein, 48 aa, Triticum aestivum
  Clone ID: PAT_TA_101053.pep
LRTYKKATLNKTFPEVTTSNTIPRPLRASNGRALPHISCFQYLGRDHA

SEQ ID NO: 206636 - protein, 71 aa, Triticum aestivum
  unsure (1)..(71): unsure at all Xaa locations
  Clone ID: PAT_TA_101054.pep
STTYKYTXXQACISSTXXYHNPRVKKSSSTIDLLPXXSTLLGLXANYQXXPYLGANARXXVAWPTSXATTL

SEQ ID NO: 206637 - protein, 93 aa, Triticum aestivum
  Clone ID: PAT_TA_101055.pep
YFQAVANQKRRKKQIAMLEGEDGPVEDPKENMETGGYGASSMGGSVLKRCKNPGLCCGEKPREACQRSSYADVARPPVDPFKLHVGAKLKKED

SEQ ID NO: 206638 - protein, 195 aa, Triticum aestivum
  Clone ID: PAT_TA_101056.pep
GNSISSRPGREINKARLKKIPSTFCWLYHLQILYAKNCRLECLPDDFGKLISLQKFESVGLTYYDGCRMYLGPDNKWRKITLMKNLNQFRGHLELIDVHLLSKDHAAELNLKNKKYLDELKLNMREDRPTGFPESDIEFDIDNNDVEVLEVLQPPISLKSLFLQNYDDSWLPSWFQPHNLLRLTSLTVVPRPRPR

SEQ ID NO: 206639 - protein, 113 aa, Triticum aestivum
  unsure (1)..(113): unsure at all Xaa locations
  Clone ID: PAT_TA_101057.pep
AAARAGTSCCLFGLPWLAACKPCPADSREACPSIGRSGNFKKFXXPMHNYNDLASLFFNTNDGTIRNLYSNGTDHEFHITSILVFFIASYFLGIFSYGLALPSGLFVPRPRPR

SEQ ID NO: 206640 - protein, 65 aa, Triticum aestivum
  Clone ID: PAT_TA_101058.pep
REHLDQFIDKNAKTFADLGMEPGDIANFTYKYLQGYRSSSYFDLPPMTEKEKREEKKYLHVLDDQ

SEQ ID NO: 206641 - protein, 68 aa, Triticum aestivum
  unsure (1)..(68): unsure at all Xaa locations
  Clone ID: PAT_TA_101059.pep
NVNVIFTSXPLNHKKIHLHNSETKRTVSYLTKKNLGIYVHVNVKGNXYLRNTPLAPGKGWKPARAAPQ

SEQ ID NO: 206642 - protein, 56 aa, Triticum aestivum
  unsure (1)..(56): unsure at all Xaa locations
  Clone ID: PAT_TA_101060.pep
QKPTQPKTGKTLFFKGFFTPHKIXKIILGQAFLXGKTRFFRKKMGVWTSFGEGKPK

SEQ ID NO: 206643 - protein, 87 aa, Triticum aestivum
  unsure (1)..(87): unsure at all Xaa locations
  Clone ID: PAT_TA_101061.pep
XXILGLDSPYADCGFATDFHLIVLQDECQPRLPPHVVNPIQPLEPSSPHXXMKSVDCSAHGSRAVGQHNSAIMAVVVDAKVPRPRPR

SEQ ID NO: 206644 - protein, 79 aa, Triticum aestivum
  Clone ID: PAT_TA_101062.pep
KNIHASTGKTEPLQPNYKMSRTRHSYYLLQLKKANVASITYFSPSSSIHLERRYLDSLVSICCHFFCNILHIYDADWMH

SEQ ID NO: 206645 - protein, 82 aa, Triticum aestivum
  Clone ID: PAT_TA_101063.pep
NVVAAEVSLLPSETDEHGNVNNVIRVGDIARIRPAPSQLQIKDPSVVKVIERALTEDERFSLAFAARLMAFAICPIRLAPKQ

SEQ ID NO: 206646 - protein, 61 aa, Triticum aestivum
  unsure (1)..(61): unsure at all Xaa locations
  Clone ID: PAT_TA_101064.pep
NXXXSPPLLSSNPGKNKPYWSQNLRELNNTNSTLHACLNSCSIHTPHXXHKLXLPGRALKN

SEQ ID NO: 206647 - protein, 64 aa, Triticum aestivum
  unsure (1)..(64): unsure at all Xaa locations
  Clone ID: PAT_TA_101065.pep
XXXGSCKCRNAVHCVCKPPWXXCGSSILRSXXRSKPFDCHXXVSCGXGSKPGLHIRCTSAATTL

SEQ ID NO: 206648 - protein, 104 aa, Triticum aestivum
  unsure (1)..(104): unsure at all Xaa locations
  Clone ID: PAT_TA_101066.pep
FFFECLSERSLKFHFQLSLVFLWVIYIVRSARIECRSTIPPLCIYCNAYLPGASITYCMSSAKSVFTKYKLKNIYMNLFISFGCTFLDNVNINICKYLPGRPXX

SEQ ID NO: 206649 - protein, 111 aa, Triticum aestivum
  Clone ID: PAT_TA_101067.pep
MCDSFRHCIHIIQGSLRSTNMQVQMLGIHVLKTCAQRELTEVSQTETHSFMILLGELLGDVFDLMQTALKNCSSQESVNVIDDCLKLLFLFHTLAQSQKYQQEATVPARRP

SEQ ID NO: 206650 - protein, 94 aa, Triticum aestivum
  Clone ID: PAT_TA_101068.pep
FERPPGQVQKETSSSLNYKIVHSLSSNGPRADGGGADGNSEVFAFFFENRAAFLSRRFEKKFVFFSSGDFFSSFGDVFFSSLATRFHTSAATTL

SEQ ID NO: 206651 - protein, 89 aa, Triticum aestivum
  Clone ID: PAT_TA_101069.pep
SSGRPGRYHFLKKKSSYQRWALSVLTSPVQQRKAWFWLVLFLMEGANSKPFWFSLSLYVLWITQMPWFWGHATSENGEIAQMYLGRDHA

SEQ ID NO: 206652 - protein, 99 aa, Triticum aestivum
  Clone ID: PAT_TA_101070.pep
ALSLRPRTSDFRTICVSLSISYVAAPPFANTLMQLANANTHTIINLSPTLYKNCHPTTPNPSKSVQPRLPLSLAAAPFLPCPFALPLTVGSLPKPNGRP

SEQ ID NO: 206653 - protein, 96 aa, Triticum aestivum
  unsure (1)..(96): unsure at all Xaa locations
  Clone ID: PAT_TA_101071.pep
QLERCLFKSDCEEDVEXRYXRVAXAIWHVKAAEVXCDSHSVKLSXXXVVIERCVLERAQWRNQSRYXXXXCLXASVNSSQAISXXSWPXXDVKPEX

SEQ ID NO: 206654 - protein, 65 aa, Triticum aestivum
  unsure (1)..(65): unsure at all Xaa locations
  Clone ID: PAT_TA_101072.pep
PRLAPKDPHQSFKXXKPIPRTRSIQTRGYQSPKKRGPNPTMSLPGRPLKIKSPRPPWGPGPCNXG

SEQ ID NO: 206655 - protein, 57 aa, Triticum aestivum
  Clone ID: PAT_TA_101073.pep
RKTMTKNVKMILHALLVNHLACTPLTDSWFVENGDLSEFDIRDIDDPELSLPRPRPR

SEQ ID NO: 206656 - protein, 92 aa, Triticum aestivum
  Clone ID: PAT_TA_101074.pep
RGRVGGTRETSRRRRRGNCQHVLIGHNVSSAEARSLQHVQISIPWSHFFSEEDHQEEEDEWEDFGTKKLSARSVWRQRLCVWRQLYLPGRPL

SEQ ID NO: 206657 - protein, 148 aa, Triticum aestivum
  unsure (1)..(148): unsure at all Xaa locations
  Clone ID: PAT_TA_101075.pep
KGGEQKGREPKFKTAPKTKKKEKKKKRPKKGTKAAPPGKRGPPPRGAQQRAPPQKTAPPGGPAKKKPPGPPGGPGTRNXGPKXPQRXTNPKPGAPGXKPREGETPGXPQLKRPEKQPXFPRGGKTKKAPPEGPSQXXRXRXXKGPPPE

SEQ ID NO: 206658 - protein, 110 aa, Triticum aestivum
  unsure (1)..(110): unsure at all Xaa locations
  Clone ID: PAT_TA_101076.pep
XXXXGRYETGTVSSLSCLVQRVVWGFLTYNIMCMCIYIAIGSIHIRACFLESCREHGHTHILILGTNKKDKWKRKTQSNVRVDKTAMALYMWPVVSELFRPCRTPRSPVA

SEQ ID NO: 206659 - protein, 85 aa, Triticum aestivum
  Clone ID: PAT_TA_101077.pep
AWSRPRYLAVLDLSGLPIETISHSIGELFNLKYLCLNDTNVKSLPKTVSRLQNLETLSLKRTQLISFPAGFAKLKKLRHVPARRP

SEQ ID NO: 206660 - protein, 72 aa, Triticum aestivum
  Clone ID: PAT_TA_101078.pep
RGRGRGTGKGKNRKKIKNSGSGRLFTEYSFACSELAAFGRNSEIACSLRNFARHLEEICGEPHDCLVPARAA

SEQ ID NO: 206661 - protein, 107 aa, Triticum aestivum
  Clone ID: PAT_TA_101079.pep
AAARAGTICGDTVQGSETFCSYCLKNEAVVATVVTGRTSKLEREIQHLAAVCGHCGGADWIMESGVKCVSLACPVFYERRKIQKELRVVSESAGEAGYYPFCCGELF

SEQ ID NO: 206662 - protein, 195 aa, Triticum aestivum
  Clone ID: PAT_TA_101080.pep
SEHSFIYSGSAHGLGDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEVDDLDAFKKNVESATKYLLSKLKDLQFFVGESMHDDGGVVFAYYKEGAADPTFLYNKEENPRVPIVVTGNDFSTLYLGRDHA

SEQ ID NO: 206663 - protein, 59 aa, Triticum aestivum
  Clone ID: PAT_TA_101081.pep
HLSDYPLFCFMFLQKSVRMNCKQQLSDFLQFDASTWPKNVWSIHMPRGVHLLFQRSPHM

SEQ ID NO: 206664 - protein, 109 aa, Triticum aestivum
  unsure (1)..(109): unsure at all Xaa locations
  Clone ID: PAT_TA_101082.pep
RGRGRGTAQLISYELILSSAILLVVLLSGSLNLTVNIEAQRAIXFIMPLLPIFIIFFIGSVAEXNSSXXFDLAEAESELVSGFMTEHAAVIFVFFFLAEYGGIVPARAA

SEQ ID NO: 206665 - protein, 134 aa, Triticum aestivum
  Clone ID: PAT_TA_101083.pep
RGRGRGTVSKKSGKGKHTTRHVSLLPIVDGGFLADTPGFNQPSLMKVTKRGLAETFPEIRKMLEENESSGCLFNDCVHLGEHGCVVKGDWERYPYYLQLLDEIKIRESFQLRTFGTKREGDVRYKTGTCPGGRS

SEQ ID NO: 206666 - protein, 58 aa, Triticum aestivum
  Clone ID: PAT_TA_101084.pep
TRIHLMLVQRMALSTMMLTIATMKAAMMRRTLVVTITIVASILMVSPEKDLTSHLHGN

SEQ ID NO: 206667 - protein, 56 aa, Triticum aestivum
  Clone ID: PAT_TA_101085.pep
AWSRPRYLKKEHSKTPLGRSGKPMEIASAVSFLSMPAASFITGQVICIDGGRTISA

SEQ ID NO: 206668 - protein, 115 aa, Triticum aestivum
  Clone ID: PAT_TA_101086.pep
GRPGRLIKLDLEMTILTEDDIKLIGSLSKLFTLRIKLLQDSKVHFCVKEAGLEVPTYQMVKVLDIGFNSNFEVTFGTNTMRSLELIKAHCCNGSSVKFSGLNNVTELKVPRPRPR

SEQ ID NO: 206669 - protein, 64 aa, Triticum aestivum
  Clone ID: PAT_TA_101087.pep
GRPGRWRMESRRRARWRSLLLRAVGKSFLTDVCKAPSKYQSMRDSQHRTISKSDHLNESIHSDG

SEQ ID NO: 206670 - protein, 127 aa, Triticum aestivum
  unsure (1)..(127): unsure at all Xaa locations
  Clone ID: PAT_TA_101088.pep
VNLSFSPPYARTSITYIVSHENDLWYVCCQFTRSCTIWFISIVLRDVYLFPCHTSHAAKRAEISPVPTSLEQVHVAKSFVFFCTNNXXEDLHKNTPLALDXDXXTSDMDLQVCFHDVFSXXFESRSK

SEQ ID NO: 206671 - protein, 58 aa, Triticum aestivum
  Clone ID: PAT_TA_101089.pep
DEGLLLHQLGRGHHHNPTSPPPLHQLLKNLDISGNGRFKPGFSPNKYAEHSSISNKMK

SEQ ID NO: 206672 - protein, 149 aa, Triticum aestivum
  unsure (1)..(149): unsure at all Xaa locations
  Clone ID: PAT_TA_101090.pep
SSRPGRSALRPRLNPLLSPXXASLQKSFLSTETRQAIDKAVASAPVVLFMKGTPETPQCGFSRASIQLLGLQGVDPAKFTAFNVLEDEELRAGIKEYSEWPTIPQLYVEKEFVGGTDIMMSMHQDGSLASLLEEKGVLAAVEGEGGSSS

SEQ ID NO: 206673 - protein, 79 aa, Triticum aestivum
  Clone ID: PAT_TA_101091.pep
GFFFFFFFFFFFFFFFLEGKTLIRWLDLIFLFLFSRGFNFNLHPPQPKLGGAYILLLFFSHLSKTKSKTEKANPPTNGN

SEQ ID NO: 206674 - protein, 140 aa, Triticum aestivum
  unsure (1)..(140): unsure at all Xaa locations
  Clone ID: PAT_TA_101092.pep
LSHSQTIFYDVNHFQKKEMAKQNSNHKAEPQFPNLLLQDSNFSMMLDFQITHIRIQHLVLRQAGVEQVIFIPQLILQSIHNIAQITKQHAHKISAVDSQCFAAVVVLDAGMARCEFAISNRTLFLLPFSDEELYLGRXHA

SEQ ID NO: 206675 - protein, 118 aa, Triticum aestivum
  unsure (1)..(118): unsure at all Xaa locations
  Clone ID: PAT_TA_101093.pep
XRGRGRGTASTTPRXXGAGQCETPPAVTLAVYSSYQLSSGRITRGELIHKDIYTPALLSVQQPVEDRLFRDDSVGVFFLRLHGGIYSVADHGVEVHPQLRVVDEQVRQHLRCLFISEA

SEQ ID NO: 206676 - protein, 96 aa, Triticum aestivum
  unsure (1)..(96): unsure at all Xaa locations
  Clone ID: PAT_TA_101094.pep
VYEGERPVGKIGHAIFICQTLVNEFASSNDLMNVFVQAFFFFFFFFFXLNFHFIHSXRGRNREHGTGAXSXXTGAKTXRNLRDGARSXXPARAGAR

SEQ ID NO: 206677 - protein, 97 aa, Triticum aestivum
  Clone ID: PAT_TA_101095.pep
GRPGRYNNGADGSCKTKFSGPVAVIDENMKLTLANSHDAICLMLMICITKKHQLVMSNRRLPCLDTYLDKALIYLWPRFKTVFDMYIQSLYLGRDHA

SEQ ID NO: 206678 - protein, 72 aa, Triticum aestivum
  unsure (1)..(72): unsure at all Xaa locations
  Clone ID: PAT_TA_101096.pep
AWSRPRYLQVFPPPNTSVLYSVSYEDXXLTPPCGGDNNLKPLNVGHIFKLKVSFFLKFKLKIRFAQSYHYAT

SEQ ID NO: 206679 - protein, 71 aa, Triticum aestivum
  unsure (1)..(71): unsure at all Xaa locations
  Clone ID: PAT_TA_101097.pep
XXQGILETRELSFSICYAKSLALAKIIGPQFNFFPPGRNXPPPKXXPTKPFNFFLPPTKTIITCPGGXSKT

SEQ ID NO: 206680 - protein, 70 aa, Triticum aestivum
  unsure (1)..(70): unsure at all Xaa locations
  Clone ID: PAT_TA_101098.pep
RPDEAQVLNIPGSYFCRYLSFSRYLSSAKDLVRDSVSDLHHCLLFRFRLANPHIAGHRPCCSCTSAATTX

SEQ ID NO: 206681 - protein, 51 aa, Triticum aestivum
  unsure (1)..(51): unsure at all Xaa locations
  Clone ID: PAT_TA_101099.pep
TNLKGPKPPRPFWGPLYPNWGRTSPKXXLGPPKNPGRNPPKKIPPAPMGGG

SEQ ID NO: 206682 - protein, 138 aa, Triticum aestivum
  Clone ID: PAT_TA_101100.pep
RPPGQVYALPDNGYIVGTHLGMSLDVMLIEIDERFNALKLLLAVVFRQARDMPGLSNPSVTDLQWEHELQLEIIGITVAECIAGLQEELERKLYEQISVTNIMSKNWQEAVSQFAAMREDLGALSKLLLPSVPRPRPR

SEQ ID NO: 206683 - protein, 142 aa, Triticum aestivum
  unsure (1)..(142): unsure at all Xaa locations
  Clone ID: PAT_TA_101101.pep
RAAARAGTKAXXXTCSMQELWSQSSLPERLHQCSGXTXESELIEKLGMYREVNDXXCSISMHILMVXVSCHRGRCAXTGVNISXXQIYWNISSLFLHFXGETVFQHILXXCTRKYEDNHVRILHHFXYHXKVAGXVPRPRPR

SEQ ID NO: 206684 - protein, 149 aa, Triticum aestivum
  unsure (1)..(149): unsure at all Xaa locations
  Clone ID: PAT_TA_101102.pep
MEGSEVCGSRISESSGAQPVEEETRIADSDVEYYPTDDFSYMEWGGIHETSELHVSRTPPRCSSSSCSDDVAGRSVNCVTGEASPVLKAGSDDGNLFFHEIDVVDLVTPVARYARDCSKVASICPKIIDLTNSPIVXSCPVCPAPLNNS

SEQ ID NO: 206685 - protein, 103 aa, Triticum aestivum
  Clone ID: PAT_TA_101103.pep
MNATHHTVKSSLHCFHAVLHIIILVILLYTIPHIRSHSTCASSVYTPPPPFCTLQSRTPEIRKHTRQLALRKNLTNLRQLQHLIIQTQRDKVRHELIPRPRPR

SEQ ID NO: 206686 - protein, 42 aa, Triticum aestivum
  Clone ID: PAT_TA_101104.pep
AKKSLHLLKFNPPSYFQGVYQKTLCFYKNNPALVTILPAILN

SEQ ID NO: 206687 - protein, 74 aa, Triticum aestivum
  unsure (1)..(74): unsure at all Xaa locations
  Clone ID: PAT_TA_101105.pep
TKMVAATSGQGRGYGYRHLLPASHCNHYQHHGGHFYQQAYMTPSSYCHHVPLTVLVIXXXXXPXXXXXXXXXXX

SEQ ID NO: 206688 - protein, 74 aa, Triticum aestivum
  Clone ID: PAT_TA_101106.pep
AWSRPRYRFSFLQHRPEVIMIGNGHQAKGVSLCQVYCSSLSRPAYNWLSRSPDSWRFMCVSSKALYCCSLERSN

SEQ ID NO: 206689 - protein, 107 aa, Triticum aestivum
  unsure (1)..(107): unsure at all Xaa locations
  Clone ID: PAT_TA_101107.pep
SVVAAEVMPLLSSLLLCACDEKETLTFQALKPISKRLLRLIIRGGWADGTLKCPIFQGHGKNIKXXALSWCNLGNEDPLQLLAFHLPALXXXSLNRVSSAGTCPGGR

SEQ ID NO: 206690 - protein, 63 aa, Triticum aestivum
  unsure (1)..(63): unsure at all Xaa locations
  Clone ID: PAT_TA_101108.pep
SGRHGGRGNLILXXRPGRYTNDGEAGAAKKKMFVKKYRYXSVGEXXFLWRERGSRAFSRLRAP

SEQ ID NO: 206691 - protein, 107 aa, Triticum aestivum
  unsure (1)..(107): unsure at all Xaa locations
  Clone ID: PAT_TA_101109.pep
MDREVPNNAVSTMLATMMGEKETKVMLHHCRMGHMSFEKMSKVFPDVMCGVDKNKLVCDACEFAKHTRTSYVSKGLRSISPFMLVHSDXXTCPVISLSGMKYLPGRP

SEQ ID NO: 206692 - protein, 151 aa, Triticum aestivum
  unsure (1)..(151): unsure at all Xaa locations
  Clone ID: PAT_TA_101110.pep
GPFSFPPKQKEKGRGQKNPNGGGGPTKGGPKNPEPPPRGQNQGPPPGGPPKKKSPGPPGGREXTXTGPNPPKRXGXKKKRAXVXNXGKGKNPGVPQIKALEKNPPFPTGGKKKKPPPKPXPPXVPPPXGKRAPPXPPQKPGGGGXXPXEPP

SEQ ID NO: 206693 - protein, 40 aa, Triticum aestivum
  Clone ID: PAT_TA_101111.pep
STHCDILTFCANIKHLELLLLNVCPALAKMPYRSIETLLF

SEQ ID NO: 206694 - protein, 76 aa, Triticum aestivum
  Clone ID: PAT_TA_101112.pep
QMRLEDGEERVRGEVQLGWCLFEINMLLYLGGDVMASAEIRVGLRGADAGRLGGDVMMINCILHMKGDLFGQEINN

SEQ ID NO: 206695 - protein, 81 aa, Triticum aestivum
  Clone ID: PAT_TA_101113.pep
YIMCMCIYIATDCIHIRARFLEPCCYMNMDIHIFLGTSKKDKWRRKTQSNVRVDKTAMALYMWPVVSELFKPCRTPRSPVA

SEQ ID NO: 206696 - protein, 36 aa, Triticum aestivum
  unsure (1)..(36): unsure at all Xaa locations
  Clone ID: PAT_TA_101114.pep
RPPGQVLDMNNLDXRHHRNLARFIFFTPEEGQSYLF

SEQ ID NO: 206697 - protein, 51 aa, Triticum aestivum
  Clone ID: PAT_TA_101115.pep
SSGRPGRYDYWGEPRNTEKVKLERDVERHNQQIIGDAKKWCETSYLGRDHA

SEQ ID NO: 206698 - protein, 104 aa, Triticum aestivum
  Clone ID: PAT_TA_101116.pep
RLIGLMPTFGKSKVVKIWQVFVSLTRNKPITSQHLAFAKPWHAKFWYQTNHALNPLKSLNPYIPTELVTSVKTWMSHQLSCNLIPGVLHIYRCDVDVYSFIFNT

SEQ ID NO: 206699 - protein, 97 aa, Triticum aestivum
  Clone ID: PAT_TA_101117.pep
AWSRPRYTTFEAYTQDAAEFPEVFGDATQTVGKLSNGGKPKYMNMDIHIFLGTNKKDKWRRKTQSNVRVDKTAMALYMWPVVSELFRPCRTPRSPVA

SEQ ID NO: 206700 - protein, 78 aa, Triticum aestivum
  unsure (1)..(78): unsure at all Xaa locations
  Clone ID: PAT_TA_101118.pep
TFEPWKTXFTCPRLCQLKKQLNNVPTTRFHATCPRPIILNLQPLKWNFSRLTNAPGNSRIGESXSCSCPLQPAQAAVX

SEQ ID NO: 206701 - protein, 106 aa, Triticum aestivum
  Clone ID: PAT_TA_101119.pep
RGRGRGTSPIENLMVVIMLHGACSRLAPLAAFGYVMATHLSLYPAILILPVALLLGYGPDTPPTKVFLQKGLSASKIDMLDNGKGGEHLHAGARGTLGGTCPGGRS

SEQ ID NO: 206702 - protein, 67 aa, Triticum aestivum
  Clone ID: PAT_TA_101120.pep
WMGGEPPFSVAFFSWIAHVHTSLDDLPHGPEREEARSPCPPCASSPLHRRRSLATSLPAYTYLPGRP

SEQ ID NO: 206703 - protein, 74 aa, Triticum aestivum
  Clone ID: PAT_TA_101121.pep
RAAARAGAGFIIPEALNKFGANCGPEAVWFKTGALLLDGNTLNYFGNSIPINLILAVVAEVVLVGGAEYLGRDH

SEQ ID NO: 206704 - protein, 86 aa, Triticum aestivum
  unsure (1)..(86): unsure at all Xaa locations
  Clone ID: PAT_TA_101122.pep
RGRGRGPYXGLPRTIFGRGDWHPLTMLTRDPCHEICAGNHRSVAWLWHALEAGQLLVMQSSTXXPHPSPGFDMLLKPIAAVRDHWF

SEQ ID NO: 206705 - protein, 118 aa, Triticum aestivum
  unsure (1)..(118): unsure at all Xaa locations
  Clone ID: PAT_TA_101123.pep
DARLERYYQSFSVLALELHFSRSLLHFQDDSHEVSGRSCLPSXXHASSRCNKIRAAYAPHFEPHQSKVLISCSGPYSNTTSEQNFSNSFAHIFILSARTPFPSPAVGPARSTCPGGRS

SEQ ID NO: 206706 - protein, 49 aa, Triticum aestivum
  Clone ID: PAT_TA_101124.pep
HTLKPQTGGWCFNGRDGVKRKDGASRSQLSVEFFFFKTERHLYNGDLNE

SEQ ID NO: 206707 - protein, 35 aa, Triticum aestivum
  Clone ID: PAT_TA_101125.pep
RGRGRGTELEREARLKEQFRTQLARNPKKPILKME

SEQ ID NO: 206708 - protein, 117 aa, Triticum aestivum
  Clone ID: PAT_TA_101126.pep
FERPPGQVGTIEQLRNLGSGGMDNIFSPGRLSRQNSFGSVSTPRTPRTPMFHTTSNAALKEALEATIASLQSDISESKARCASLTSTGDESRAEDIRQLTDKLESMQSLVTRMRTLI

SEQ ID NO: 206709 - protein, 46 aa, Triticum aestivum
  unsure (1)..(46): unsure at all Xaa locations
  Clone ID: PAT_TA_101127.pep
NIQSFSITDFNFTHFNSKQYXFSELNDQIQKSLNETQTARTCPGGR

SEQ ID NO: 206710 - protein, 78 aa, Triticum aestivum
  unsure (1)..(78): unsure at all Xaa locations
  Clone ID: PAT_TA_101128.pep
NVVAAEVRRGQXINWGTFXXTLTDALIDXLQPIXXLYDEIMSDXXXXDSALLDGARKASDISYSTLNNVYQAMGFLRR

SEQ ID NO: 206711 - protein, 89 aa, Triticum aestivum
  Clone ID: PAT_TA_101129.pep
GLLHVWYMDPHDYELSVWVLKNYVSGEWILKHTVDVPKLFEEMDSNEEKDRDQEDGSCKYEMFAIHPEYNVIFLTDRKMVSLSYLPGRP

SEQ ID NO: 206712 - protein, 80 aa, Triticum aestivum
  Clone ID: PAT_TA_101130.pep
SSGRPGRYYSQNVYSTRSDVFSFGILVLEIISGKSAVGSYQLSGRSYELRKYAWQLWREQRCDELVDDSLGEEYLGRDHA

SEQ ID NO: 206713 - protein, 161 aa, Triticum aestivum
  unsure (1)..(161): unsure at all Xaa locations
  Clone ID: PAT_TA_101131.pep
SVVAAEVLYEILTGRRSMDKNRPKNEQKLLEWVKQYPAGSKQFSKIIDTRLEGRYSRQGTREIAKLANTCLAKRSRDRPTMRQVADSLKQVMQLKQLDGESVTSGGNSPPHDVQGKPTADDIAVASARRRMLHLAXLGENGNSIARRRFMFMXXAAAPTPT

SEQ ID NO: 206714 - protein, 50 aa, Triticum aestivum
  Clone ID: PAT_TA_101132.pep
VLRFTLTQKTYKINKLKTNYRVIASHESYRRLGGIALEAPTFQTSAATTL

SEQ ID NO: 206715 - protein, 89 aa, Triticum aestivum
  unsure (1)..(89): unsure at all Xaa locations
  Clone ID: PAT_TA_101133.pep
AWSRPRYLLIGVGEVFTSIGQAEFFYNQSPDSMRSLCSAFALVTVSLGSYLSSFILTLVSYLTTRGEQMGWIXXNLNEGHXXRFFXXXA

SEQ ID NO: 206716 - protein, 48 aa, Triticum aestivum
  unsure (1)..(48): unsure at all Xaa locations
  Clone ID: PAT_TA_101134.pep
XPPXXVHXWVRXEFYPTIGAIQKWGLHWXDSKMEVSSXDMYDXXISPF

SEQ ID NO: 206717 - protein, 167 aa, Triticum aestivum
  Clone ID: PAT_TA_101135.pep
SVVAAEVPVLTPGFSWIEISYARPYSLECLQKEGNLSSSHATNDNFGPSPCGGTFVYVGDLSSTASSVKLSPYRPRWAFFLLIADVPYILENCLSCLLHVSAALAAVNCLPVYFLDGDVILETALRYVAWFNRRQQRVIIKVCRFLWTVLSIIMFSRFLYSMTVYYG

SEQ ID NO: 206718 - protein, 100 aa, Triticum aestivum
  Clone ID: PAT_TA_101136.pep
SVVAAEVLFWARRRRKTTDEESLRVLQEEDCFEWRPYLHNSLNWTEPGWFSKETVLVSSRGKDKPEWLEDYLAIIRQAALTGLCGDGMYNTAMYLPGRPL

SEQ ID NO: 206719 - protein, 70 aa, Triticum aestivum
  Clone ID: PAT_TA_101137.pep
SSGRPGRYSGTLRLHSSYRIVQATTADVPRVSHLFKTSRWIQTNHRPTQQLASQHRKPYFQILYLGRDHA

SEQ ID NO: 206720 - protein, 48 aa, Triticum aestivum
  unsure (1)..(48): unsure at all Xaa locations
  Clone ID: PAT_TA_101138.pep
XXXXDKXIVLMXXXFQLSCAKFTSIHVGLEILRHLALDEHVCEPKSVG

SEQ ID NO: 206721 - protein, 112 aa, Triticum aestivum
  Clone ID: PAT_TA_101139.pep
AWSRPRYAQTVVYASDSWKMAHLVLGLLLKSDSPGFLLRRHSRARVSVLEFDGMSGNMLVRSDSFNGNGFASRKLFLRCVKLLISDGAASSSCEEVICLLFLGGEGHVLVFA

SEQ ID NO: 206722 - protein, 55 aa, Triticum aestivum
  Clone ID: PAT_TA_101140.pep
SDQLFLKKMIFAVNHLSSEWKAFLCHIFQLFMSTRCQTQQQPDTLTDRMRYNYFR

SEQ ID NO: 206723 - protein, 49 aa, Triticum aestivum
  Clone ID: PAT_TA_101141.pep
GIKEGTTNEWIQCNIGLPYTYEIPSSIPYHLNLTTRGYRALVYLGRDHA

SEQ ID NO: 206724 - protein, 187 aa, Triticum aestivum
  unsure (1)..(187): unsure at all Xaa locations
  Clone ID: PAT_TA_101142.pep
PXXXRDTEDELNLYCEQETESPTSVLDVAFSDHPAASSENHIMLDDSSLVEKTAHSNEVHDHSVGSDDDLDSSTSVKPPTSSLTLENILQENNLSDLNALQEAAADPKNEAELAYVKDIFNKSSFRDEALFEAWCSQNRAALQEDDCQHYDAAAAAIDFTDMSADELLLFDLTNEALLDVYLGRDHA

SEQ ID NO: 206725 - protein, 87 aa, Triticum aestivum
  Clone ID: PAT_TA_101143.pep
SSGRPGRLRLDREGSSLSKEQLAKLATKCKKIYQAELAHMDGGDKKGKERPGKAGTDDAEYDSDDTIEMTEEEIDLACRQFSGISSS

SEQ ID NO: 206726 - protein, 111 aa, Triticum aestivum
  Clone ID: PAT_TA_101144.pep
SSGRPGRYETGTVSSLSCLVQRVVWGFLTYNIMCMCIYIAIGSIHIRACFLESCREHGHTHILILGTNKKDKWKRKTQSNVRVDKTAMALYMWPVVSELFRPCRTPRSPVA

SEQ ID NO: 206727 - protein, 138 aa, Triticum aestivum
  unsure (1)..(138): unsure at all Xaa locations
  Clone ID: PAT_TA_101145.pep
HXXXXEGGDTPWXXPVQNLHVSRGVRVFLLAQPLVKGGGXQEDPRRHDGGHVDVIVALTHLVLPTXHTNVIECYCGLNALSNFCLTFWFCKLGCMFQFLHGIFHVELKPHLVGPKANNHMFPFEIIGQKVMLKKKKKT

SEQ ID NO: 206728 - protein, 68 aa, Triticum aestivum
  Clone ID: PAT_TA_101146.pep
DQNHKRPTDSQPCSSDQSNTQTQDGSSINLQDQKSYTLQRKPRTRYELYISMNSYTYSHRQTCPGGRS

SEQ ID NO: 206729 - protein, 61 aa, Triticum aestivum
  Clone ID: PAT_TA_101147.pep
FERPPGQVQYFFGTAMCLCASKLDRKWLTTSLSKRSSARPERGDLNNSRMQPRTNYLDDEA

SEQ ID NO: 206730 - protein, 93 aa, Triticum aestivum
  Clone ID: PAT_TA_101148.pep
KLIFFFYFSNQYKWHLCSQNAVTHFSFQLLFLTNSTGGLNMDRFFYQYNRHSPQDWFKKAQQASLHKKTSMTGHTLFTTSNLQFCYFGGTHLG

SEQ ID NO: 206731 - protein, 74 aa, Triticum aestivum
  unsure (1)..(74): unsure at all Xaa locations
  Clone ID: PAT_TA_101149.pep
AWSRPRYFIEKDRARXLFDTQDWVSMPRVIPGTTCGIHVWHMPXLTXXSGDXXXLQLGGGTLGHAWGNAPGAGP

SEQ ID NO: 206732 - protein, 96 aa, Triticum aestivum
  Clone ID: PAT_TA_101150.pep
AGIGGPLINFDGAFVGMNHYDGSEVTPFLPRRGIVQILKGEINWRRQSGLSMDILHGVGYRSQIDRRRWPVPEPYWHHDLLGMDKYDLHPHVGRQL

SEQ ID NO: 206733 - protein, 72 aa, Triticum aestivum
  Clone ID: PAT_TA_101151.pep
RYIYSLNYVQVWRLDSEHPEYSLIGHFEGVRCLDFIRRGDKHYLVSGSMDCTAKIWNLQKRKCICTSAATTL

SEQ ID NO: 206734 - protein, 98 aa, Triticum aestivum
  Clone ID: PAT_TA_101152.pep
AWSRPRSATQFLCRYMRRDGHEGDGGTQGQDEPIMFGPDDDDGAKIPTQVETLVRGTATVDAPEYKPLPDLDYLQELLAIQQQGPRSIGFFGTCPGGR

SEQ ID NO: 206735 - protein, 63 aa, Triticum aestivum
  Clone ID: PAT_TA_101153.pep
MKQLQGNMPPPIPTRTPWAKHRRRASKQITPPPPLARLHQIKPSLFKYTFTPSHVRTCPGGRS

SEQ ID NO: 206736 - protein, 106 aa, Triticum aestivum
  Clone ID: PAT_TA_101154.pep
KRTLSTFLVVNSLALEDFKNARIEELSLNPSQEGALSNFINYFWDRLCDHKQRFTYKHEKHTCRLLEFQRPNKQPPRWMLIKLMKDAARAGIYMRSDNVPARAAAR

SEQ ID NO: 206737 - protein, 112 aa, Triticum aestivum
  Clone ID: PAT_TA_101155.pep
RAAARAGTVVGKLEGEREMTLGFVDLLRDDFIEKDRARGIFFTQDWVSMPGVIPVASGGIHVWHMPALTEIFGDDSVLQFGGGTLGHPWGNAPGAAANRVALEACVPRPRPR

SEQ ID NO: 206738 - protein, 71 aa, Triticum aestivum
  Clone ID: PAT_TA_101156.pep
SSGRPGRWRFEQSGGWIRALLEEAENERMHLMTFMEVANPKWYIFLVMTYSNCYFFSLRWQPKRTSAATTL

SEQ ID NO: 206739 - protein, 60 aa, Triticum aestivum
  Clone ID: PAT_TA_101157.pep
NNTHILFFNQKEVSVNKKICHDHHKEKQLSNDKGKRIFAQITIHAPEKSTQSKANKVLSQ

SEQ ID NO: 206740 - protein, 103 aa, Triticum aestivum
  Clone ID: PAT_TA_101158.pep
KKTPKKKKNGGGKPFVFSLGTQKTTKIFFFTGAQNRENPLSKKVPQIAPTFSPPQKIPGGEKKKSNKGVPPLPGGAVKKKFPRPPWGAGKFKMGPHFPLKGGF

SEQ ID NO: 206741 - protein, 68 aa, Triticum aestivum
  Clone ID: PAT_TA_101159.pep
DCAIFPNWQRYISALHVNRDMTIADIDNLREPQVVDMTIAATNQSAPVTRFFYDSHWASQVYARNRSQ

SEQ ID NO: 206742 - protein, 56 aa, Triticum aestivum
  Clone ID: PAT_TA_101160.pep
CWASHDKRKNNYLPDCTALLFRMWCPLTQWSKSGACFYQVISFLPSYDMLVNCQAS

SEQ ID NO: 206743 - protein, 64 aa, Triticum aestivum
  Clone ID: PAT_TA_101161.pep
AWSRPRYRQRSSMFLLIIHMMYYHILAIICIPYTFHIITHTDEPYQPPLQIHKYIILIKWKRNK

SEQ ID NO: 206744 - protein, 115 aa, Triticum aestivum
  Clone ID: PAT_TA_101162.pep
GRPGRYHRRAEDRANTADTTAEAARFLPGSPAPGALMNLSCKNKIKFVLIKFFGGWTRRIILLACLITAMIHLKLSSMLMSAYGSTPVALSPPLTWMPLLLLSVAAYCTSAATTL

SEQ ID NO: 206745 - protein, 105 aa, Triticum aestivum
  Clone ID: PAT_TA_101163.pep
AWSRPRYGLPEGVAALPPMPNDGDYWSTLHSWVMHTPSFLKFIMFTRMFVDSLHSLNGNNTEPASCLLGASQPEKRHCYCRILEILVNIWAYHSGRKMVYLPGRP

SEQ ID NO: 206746 - protein, 83 aa, Triticum aestivum
  Clone ID: PAT_TA_101164.pep
RGRGRGTLLPRKLYILFSYLRFRVSISLTHILCESLAHPLGYFSSELTTSSEKIPQADSRPLQGKTIKTSSRRRTVLFVSSPC

SEQ ID NO: 206747 - protein, 119 aa, Triticum aestivum
  Clone ID: PAT_TA_101165.pep
ERPPGQVQPRRAHYDDAQYKLLTCKYPGERFASSSPVQVQALALQVFSRRSATVLRSVLLHCQWRFSSNNTQIIYTSNKPPGTRKGKLDSVFSTSSQTKQKVNLSTDQCSRSTSAATTL

SEQ ID NO: 206748 - protein, 151 aa, Triticum aestivum
  Clone ID: PAT_TA_101166.pep
FEPGQVLRSRVFPELRGDKLALIPFADLINHNGDITSKESCWEIKGKGFLGRDTVFSLRTPMEVKSGEQIYVQYDLDKSNAELALDYGFTEENSSRDSYTLTLEISESDPFYEDKLDIAELNGMGETAYFDVVLGESLPPQMITYLGRDHA

SEQ ID NO: 206749 - protein, 109 aa, Triticum aestivum
  Clone ID: PAT_TA_101167.pep
RGRGRGTFGSTYAAYLSELAGSSAPAFLSHYYNLYFSHTTGGLAIGKKTCDKILDGRLLEFYKWDSDPEILLKDAREKLNELSKHWSRKDRNLCLKEAAKCFQYLPGRP

SEQ ID NO: 206750 - protein, 65 aa, Triticum aestivum
  unsure (1)..(65): unsure at all Xaa locations
  Clone ID: PAT_TA_101168.pep
FXNDFLNQLQLTLTKTQGGVKNYLPXMNQSLIQQGSNHIGPGGLFALVWFFGGYLLAKFSKXLFW

SEQ ID NO: 206751 - protein, 185 aa, Triticum aestivum
  unsure (1)..(185): unsure at all Xaa locations
  Clone ID: PAT_TA_101169.pep
TFDRXGXXAGXXQKMVDGFGTILLSADDVEESTIXXANRHLVEALESAHAIGCTADFLSQMLDGWACKLEGDARRIWQGEKCRVYIFLFSNAYDVLLIMRGRGAAFSNEELESMLSAMFRRYKASYLDECWAPLMNHLDRLDKFSAEFCIICRRQMTCKVNANLRYKLRKGIVGLIVPPYLPGRP

SEQ ID NO: 206752 - protein, 79 aa, Triticum aestivum
  unsure (1)..(79): unsure at all Xaa locations
  Clone ID: PAT_TA_101170.pep
IKKKVLTCHWDVNYCLEFQITMHNIWSSIGVNSHMHTHTNKEALVQPGNEILPTHSXXELVQSHCHSVSLAXVHLXXXX

SEQ ID NO: 206753 - protein, 69 aa, Triticum aestivum
  Clone ID: PAT_TA_101171.pep
NETALMLAVAHQPVSISLDGSSDVFRYFGTGVYGSASKRLEPGAPNKPCNNTDLNHAVTVVGYLGRDHA

SEQ ID NO: 206754 - protein, 41 aa, Triticum aestivum
  Clone ID: PAT_TA_101172.pep
GRPGRYPDAYVRVIGFDNLRQVQCVSFIAFRPPGCEESGKA

SEQ ID NO: 206755 - protein, 85 aa, Triticum aestivum
  Clone ID: PAT_TA_101173.pep
AAARAGTSTAPLLPRVLGGLFGGRSSFSGTPWNRVRHNIREPQSTLVLNHVPIRLAPVNLPVARPELVEEQNIKGTGTVPRPRPR

SEQ ID NO: 206756 - protein, 116 aa, Triticum aestivum
  Clone ID: PAT_TA_101174.pep
TGPTNYHTSLRYASLVGRRPQTSRYPSAELLDQVALSLDCTAQAITNFHGLVVRLVLLQKLNGNQEEQTAPALNTKQAQLQPRVAIRSIRPSSHPLQDQTCSPISSIDFLPLSVIL

SEQ ID NO: 206757 - protein, 164 aa, Triticum aestivum
  Clone ID: PAT_TA_101175.pep
FERPPGQVPGPVLRADPVVTNRGEGSESDKEKKEQAFRSWMLLLASLVATVTFTAGLTPPGGFWSTDDKDNKFIAGEPIMRDKSRSRYAIFQTGNIMAFYTSLMIIGLLAKNRNDKTVISLGFILLVALCFVCLVFSFISGSWQGPIQGAVNVVLVLVPRPRPR

SEQ ID NO: 206758 - protein, 87 aa, Triticum aestivum
  Clone ID: PAT_TA_101176.pep
SSGRPGRCRIASPPAAITRLTHRRSSGRMFDVSCVTGVGKCSWCNSGQWCTANAALPDFFSDGWVYQILARCCRPVKWQLYLGRDHA

SEQ ID NO: 206759 - protein, 80 aa, Triticum aestivum
  Clone ID: PAT_TA_101177.pep
FERPPGQVRKAQCVIFTSFHELEPSSMNTIAELLRSPIYPIGLSILRAPDKGESARDEEHRRWMDAQPENSVLYLGRDHA

SEQ ID NO: 206760 - protein, 83 aa, Triticum aestivum
  Clone ID: PAT_TA_101178.pep
TNADYSIDIMSYGTKQGLVPVSKLRSVKLIQVSSKIHGPCIAHSHANLLSSVTAFCWPGRIIIHRIMHQSAALLSAQCSLLHK

SEQ ID NO: 206761 - protein, 53 aa, Triticum aestivum
  Clone ID: PAT_TA_101179.pep
SERAINPCGVKESHKKNLNRFLRKSGALFFKNINHVIYYLQKINMSSTNQLDH

SEQ ID NO: 206762 - protein, 125 aa, Triticum aestivum
  Clone ID: PAT_TA_101180.pep
SVVAAEVLTLMKQRDISSRYIPQMVASGRVGHPGLCNKPNSSGSCGHPLCSTPILVTSPVGETISNLIRNGLFGVEEALRCCHDCLSALAAASSAGIRHGDIRPENVIRVSNGSRQPHFVPARAA

SEQ ID NO: 206763 - protein, 119 aa, Triticum aestivum
  Clone ID: PAT_TA_101181.pep
SWSRPRYTDCKILLVDKIISDPRELLRVCFSAVKEDFPLLIIAEDVEEEALATLTRNKLSGMIKVAAIKAPSFGEQKTQCLEDIAIITGGTSVECQNGMRKSSGGMAMNLNVPARAAAR

SEQ ID NO: 206764 - protein, 206 aa, Triticum aestivum
  unsure (1)..(206): unsure at all Xaa locations
  Clone ID: PAT_TA_101182.pep
XESPKIVAQKMTIAXLRHIRQIAHESSGEIPYGAGRQPAVLRTFSQGLSRGFNDAVSGFPDDGWSLLTSDGAEDITITVNSSPNKLVGSHVSPSPLFSAIGGGILCAKASMLVQDVPPALLVRFLREHRSEWADPGVDAYSAASLRASPYAVPGLRAGGFMGNQVILPLAHTLEHEEFLEVLRLEGHGFSHDEVLLARDMYLPGRP

SEQ ID NO: 206765 - protein, 92 aa, Triticum aestivum
  unsure (1)..(92): unsure at all Xaa locations
  Clone ID: PAT_TA_101183.pep
XXXPGQVHPRYTXTCRSRGIIXPESPEXGXXSXXXXHTRSRAYQQQYXXHTKPLWHLSTRKPPLEYHDSWRPPWCGTHQRGCGFHQICSSSW

SEQ ID NO: 206766 - protein, 89 aa, Triticum aestivum
  Clone ID: PAT_TA_101184.pep
AAARAGTGPQEVSSSAEHMIPEVQEPIQDTHGECHVSNDELPNMIVEKRTELVDNNHNNFTNGAPQVISSGAEQMISEVQEPVPRPRPR

SEQ ID NO: 206767 - protein, 75 aa, Triticum aestivum
  unsure (1)..(75): unsure at all Xaa locations
  Clone ID: PAT_TA_101185.pep
SIRPWRTFYRLYGIAAILEAIPSLCRQFXXGMKHLMTMVKVAFLLVIELGVFPLMCGWWLDVCTLKMLGTCPGGR

SEQ ID NO: 206768 - protein, 46 aa, Triticum aestivum
  Clone ID: PAT_TA_101186.pep
RGTHGGWVRYSWWQKRWHLPCILLAKGRKGHFADGRGCCRAVTLKE

SEQ ID NO: 206769 - protein, 71 aa, Triticum aestivum
  Clone ID: PAT_TA_101187.pep
RSGPQEHVRVGYGGLRGPEDVVLPRTLSAFLLPLSLPGFQRATGLLACFRFSFLLLSTKWWWRRIVWLYLG

SEQ ID NO: 206770 - protein, 96 aa, Triticum aestivum
  unsure (1)..(96): unsure at all Xaa locations
  Clone ID: PAT_TA_101188.pep
VRKGNAKLTLGFVDLLRXDDFIEKDXARGIFFTQDGVSMPGVIPVASGGIHVWHMPALXEIXFGDDSVLQFGGGTLGHXWGNAPGAAANRVALEAC

SEQ ID NO: 206771 - protein, 51 aa, Triticum aestivum
  Clone ID: PAT_TA_101189.pep
RAAARAGAPAGLRACVESISLPAAYLNQLYYYFSPPALASAVKHLMVSNFQ

SEQ ID NO: 206772 - protein, 68 aa, Triticum aestivum
  Clone ID: PAT_TA_101190.pep
RGTSFFFFFFFFFCFFFFFFFFFFFFFFFFFFFFFFKKKKPPKKLVLTLLEKGALEFKIGNPQTLNNG

SEQ ID NO: 206773 - protein, 51 aa, Triticum aestivum
  unsure (1)..(51): unsure at all Xaa locations
  Clone ID: PAT_TA_101191.pep
IKLKIKKRRFKKKKKKKKXXVRIIGFDNMRQVQCVSFIAFKPPGCEESGKA

SEQ ID NO: 206774 - protein, 45 aa, Triticum aestivum
  Clone ID: PAT_TA_101192.pep
FEKQFITEIPWFLACKQRPKEDKKRKKKNAVPLQYEAIPNNGLHA

SEQ ID NO: 206775 - protein, 66 aa, Triticum aestivum
  unsure (1)..(66): unsure at all Xaa locations
  Clone ID: PAT_TA_101193.pep
ELFXXWXHGXXXTALKNICFFXFXAXHXPSVWIXETXPDQNXTXLXLKKKKKKKKKKKKKXACTPR

SEQ ID NO: 206776 - protein, 93 aa, Triticum aestivum
  unsure (1)..(93): unsure at all Xaa locations
  Clone ID: PAT_TA_101194.pep
FXXRFVXXXGXFXPLKLGFGTFGILAKPQDNYFGNGGGIVKLMFLXXTSFQHWXRXLKVVGASQLITPNCEIVKDXDNCPHTRPPKFLAQPXX

SEQ ID NO: 206777 - protein, 155 aa, Triticum aestivum
  unsure (1)..(155): unsure at all Xaa locations
  Clone ID: PAT_TA_101195.pep
RXLDLPRGXLXPCLVPXMLFAPXRSXREPQRXCLSLFGVPFVDLRISPLHTKFHSPLSHSSELVSRAFPPLFGDFHFQPDSPPTCPLRPVIPKNTCPPRLTAAAGTELAGASSSSPVMIAHSTKELYKRHCPSSLTRYCWIGLSPIVQDSPLLTS

SEQ ID NO: 206778 - protein, 62 aa, Triticum aestivum
  Clone ID: PAT_TA_101196.pep
RSGRPGQVQNIAMPQLYQQSNDKHNYIIIPIDVSEHSYTLLQRKLVSCSSQQNSQCLKQGMH

SEQ ID NO: 206779 - protein, 86 aa, Triticum aestivum
  Clone ID: PAT_TA_101197.pep
RGRGRGTIKPKLGLSAKNYGRACYECLRGGLDFTKDDENVNSQPFMRWRDRFVFCAEAIYKSQAETGEIKGHYLNATAGTCPGGRS

SEQ ID NO: 206780 - protein, 62 aa, Triticum aestivum
  Clone ID: PAT_TA_101198.pep
SSGRPGRYIARLNNSTVLYTVHNNHASVRSQSVHASLCWPWEEEGGSNGNGSRCAYLGRDHA

SEQ ID NO: 206781 - protein, 71 aa, Triticum aestivum
  unsure (1)..(71): unsure at all Xaa locations
  Clone ID: PAT_TA_101199.pep
SXGRPGQDCEXSGSLXXDPAGMSFPKXDGIPCLLPKDGLSLEDHXRESGHDTISRDYSDRIHLGVPRPGXR

SEQ ID NO: 206782 - protein, 52 aa, Triticum aestivum
  Clone ID: PAT_TA_101200.pep
GRPGRYPLLSCSGLWIWNLSRGNKSGVKSCFQRSRGMEHSMQILEGTPLDSS

SEQ ID NO: 206783 - protein, 79 aa, Triticum aestivum
  Clone ID: PAT_TA_101201.pep
RAAARAGLVPRRRGLEDGAPAEAGGAQVAADMGVPRHGGVPLLPPSLRLCRKRRKFFLNWQERCIFVKRKICTSAATTL

SEQ ID NO: 206784 - protein, 48 aa, Triticum aestivum
  Clone ID: PAT_TA_101202.pep
YINQTVGASTTKFLVRLFLVCALAKAPARRHPADNLQLSAALSTVRCD

SEQ ID NO: 206785 - protein, 86 aa, Triticum aestivum
  Clone ID: PAT_TA_101203.pep
AAARAGTIKPKLGLSAKNYGRACYECLRGGLDFTKDDENVNSQPFMRWRDRFVFCAEAIYKSQAETGEIKGHYLNATAGTSAATTL

SEQ ID NO: 206786 - protein, 57 aa, Triticum aestivum
  Clone ID: PAT_TA_101204.pep
SVVAAEVPLRIKIYAKQSSLEHLKHIGHSYARLAQRLKWNGLGHNKFFCSTCPGGRS

SEQ ID NO: 206787 - protein, 87 aa, Triticum aestivum
  Clone ID: PAT_TA_101205.pep
SVVAAEVLKASMLTMSPASGPPDPHSLSLVLAWRKNKKKKENSYLLMDFECYVTCFLAQGIGLYVAYLFSKIKSAKKISVSFSGKLC

SEQ ID NO: 206788 - protein, 71 aa, Triticum aestivum
  unsure (1)..(71): unsure at all Xaa locations
  Clone ID: PAT_TA_101206.pep
AQNRCKIAKLAMSASTNAVMAHFLRASSAFFSSSLASFGPLATSSFPFPWXSGFTXXRILHLXGRXXNXXX

SEQ ID NO: 206789 - protein, 74 aa, Triticum aestivum
  Clone ID: PAT_TA_101207.pep
FFYFQKLIFFFHFSDYFVFFYKFTGFNKCSKIHKFIHYSKIIRVDYFLKNNQNVFISHMFIGNKTNILARLSPS

SEQ ID NO: 206790 - protein, 97 aa, Triticum aestivum
  unsure (1)..(97): unsure at all Xaa locations
  Clone ID: PAT_TA_101208.pep
XIHVXHMPAXXEIFGXNSVLQFGGGTLXXPWGNAPGAAXNRVALEACVQARNEGRDLAREGNXIIRAACKWSPXXAPAXXVWKAIKFQFDPVDTTDK

SEQ ID NO: 206791 - protein, 74 aa, Triticum aestivum
  Clone ID: PAT_TA_101209.pep
ISSRSPFYTTLKPTKKSASPPNYKRTLKNRMEINIHVDRSYGDAVGYPFPREPLLLAGHIREQERVRHLGRDHA

SEQ ID NO: 206792 - protein, 77 aa, Triticum aestivum
  Clone ID: PAT_TA_101210.pep
FFFLAMNTYPTHVTNSHEHIYIQHISMNTYPTHITRSQRREPIPKERTSTTLAHGIFLQLGHCTHKHLGLVPARAAA

SEQ ID NO: 206793 - protein, 80 aa, Triticum aestivum
  Clone ID: PAT_TA_101211.pep
YIHVDMIQSFQTPVLQIFQPKSIHVFSHCIQTRPRSTQQRSILVKHTHLLTGSPLERTPSRHGSSPSSPKQSSDVSIPQP

SEQ ID NO: 206794 - protein, 83 aa, Triticum aestivum
  Clone ID: PAT_TA_101212.pep
AWSRPRSRGIFFTQDWVSMPGVIPVASGGIHVWHMPALTEIFGDDSVLQFGGGTLGHPWGNAPGAAANRVALEACVPARAAAR

SEQ ID NO: 206795 - protein, 76 aa, Triticum aestivum
  Clone ID: PAT_TA_101213.pep
AWSRPRLHDYLTGGFTANTTLAHYCRDNGLLLHIHRAMHAVIDRQKNHGMHFRVLAKALRMSGGDHIHSGTCPGGR

SEQ ID NO: 206796 - protein, 81 aa, Triticum aestivum
  Clone ID: PAT_TA_101214.pep
AAARAGRGIFFTQDWVSMPGVIPVASGGIHVWHMPALTEIFGDDSVLQFGGGTLGHPWGNAPGAAANRVALEACVPRPRPR

SEQ ID NO: 206797 - protein, 54 aa, Triticum aestivum
  Clone ID: PAT_TA_101215.pep
GRPGRYKVINMDQWMGFLRFCNEISFPSLDNYDADQAWPLILDNFVEWLRASEN

SEQ ID NO: 206798 - protein, 50 aa, Triticum aestivum
  Clone ID: PAT_TA_101216.pep
RAAARAGTIHIVWCIFWFAAQASRSQCTSIVDKKSTTQQNSRKRPRPRPR

SEQ ID NO: 206799 - protein, 50 aa, Triticum aestivum; identical to SEQ ID NO: 206798
  Clone ID: PAT_TA_101217.pep

SEQ ID NO: 206800 - protein, 77 aa, Triticum aestivum
  Clone ID: PAT_TA_101218.pep
TTKLPCIKKSTISLQDVDFTLQFLNKQKNHKPNYHCKQNKKSHLHHLGCRSFLHDSLLSHRRPSCSKPAAAPRPRPR

SEQ ID NO: 206801 - protein, 38 aa, Triticum aestivum
  Clone ID: PAT_TA_101219.pep
KNLTLIRELQVTVVDTGQKNPQLIWEMGRYKNSGGTTL

SEQ ID NO: 206802 - protein, 84 aa, Triticum aestivum
  Clone ID: PAT_TA_101220.pep
FERPPGQVRNRSHDWHGKVQEEKQIGFQEGPESYHLLQVQGVRALPQQLPKKETSILVRSNCFSCNGAGHFARECPKEKETCAR

SEQ ID NO: 206803 - protein, 101 aa, Triticum aestivum
  unsure (1)..(101): unsure at all Xaa locations
  Clone ID: PAT_TA_101221.pep
PXGGIGFTQGGEKLKKTPPPPQKIYPPLGLKQKKNKPPLLPYMAGTYPAQKKKVQTLIKXNTRPGGRLKKKSPGPHGGREHSKLGPNSPKRXGXKNXWAXV

SEQ ID NO: 206804 - protein, 29 aa, Triticum aestivum
  unsure (1)..(29): unsure at all Xaa locations
  Clone ID: PAT_TA_101222.pep
TTARAGTCEEMIKRXVFARELRVXXVKHK

SEQ ID NO: 206805 - protein, 72 aa, Triticum aestivum
  Clone ID: PAT_TA_101223.pep
ELACSRPPWGPGEFIFNRPPGQVQVFNKGGVFVSKGNEIFRPACKWILELPPVFKVWKGFKFGFNPVNIFVK

SEQ ID NO: 206806 - protein, 41 aa, Triticum aestivum
  Clone ID: PAT_TA_101224.pep
AWSRPRYMACICYAFFLMLGMVGFRAALFFVRHIYKSIKCE

SEQ ID NO: 206807 - protein, 53 aa, Triticum aestivum
  Clone ID: PAT_TA_101225.pep
YSSKIVGFNSYKSRCIPVLKICLIITIDGIIFTEPRRESQTGLINQYLPGRPL

SEQ ID NO: 206808 - protein, 86 aa, Triticum aestivum; identical to SEQ ID NO: 206785
  Clone ID: PAT_TA_101226.pep

SEQ ID NO: 206809 - protein, 76 aa, Triticum aestivum; identical to SEQ ID NO: 206795
  Clone ID: PAT_TA_101227.pep

SEQ ID NO: 206810 - protein, 54 aa, Triticum aestivum
  Clone ID: PAT_TA_101228.pep
GRPGRYKVINMDQWMGFLRFCNEINFPSLDNYDADQAWPLILDNFVEWLRASEN

SEQ ID NO: 206811 - protein, 79 aa, Triticum aestivum
  Clone ID: PAT_TA_101229.pep
SSGRPGRCVVRFTRLCTEGSWSPSACSFDSCSSACPVQLSFCRHAMRHFAWCSSAAVRHHMLFCSWCHCVRILVVGRPV

SEQ ID NO: 206812 - protein, 41 aa, Triticum aestivum
  Clone ID: PAT_TA_101230.pep
AWSRPRFWISRSRNTPIRDKEGLPKFRATRSREIVPNSKKN

SEQ ID NO: 206813 - protein, 76 aa, Triticum aestivum; identical to SEQ ID NO: 206795
  Clone ID: PAT_TA_101231.pep

SEQ ID NO: 206814 - protein, 41 aa, Triticum aestivum
  Clone ID: PAT_TA_101232.pep
GRPGRYPDAYVRIIGFDNMRQVQCVSFIAFKPPGCEESGKA

SEQ ID NO: 206815 - protein, 45 aa, Triticum aestivum
  Clone ID: PAT_TA_101233.pep
EKVGAADVMNHMSGGGGASLEWLQAKELLGVVAREEGVIRRSVSV

SEQ ID NO: 206816 - protein, 66 aa, Triticum aestivum
  Clone ID: PAT_TA_101234.pep
AWSRPRYSLKLVHNHNPIQVKFGCEKTRFCSSISFIHFTCGRTPPRPPPCCCRWCRRWSATCPGGR

SEQ ID NO: 206817 - protein, 57 aa, Triticum aestivum
  unsure (1)..(57): unsure at all Xaa locations
  Clone ID: PAT_TA_101235.pep
FEGPPGQVQVCNKGGVFVWEGNEIIRAVCKWSLELPPVXXVWKGIKFEFEPVDIXDK

SEQ ID NO: 206818 - protein, 59 aa, Triticum aestivum
  unsure (1)..(59): unsure at all Xaa locations
  Clone ID: PAT_TA_101236.pep
XPXKRGVPFPFKVGKFLKRGMGGAFFFLTXXGKRGFFSKXLNLVNPRFFPSPRFKKPPP

SEQ ID NO: 206819 - protein, 60 aa, Triticum aestivum
  unsure (1)..(60): unsure at all Xaa locations
  Clone ID: PAT_TA_101237.pep
RQXXMKAKREDENGEDEGVEWEEEQPAGNTSEEPYKFVDLNAEAPESGDDEEDEIDWEEG

SEQ ID NO: 206820 - protein, 67 aa, Triticum aestivum
  Clone ID: PAT_TA_101238.pep
RPPGQVEGLTWGASKLMPVGYGIKKLQIMLTIIDDLVSVDTLIEEVLCEAPINEYVQSCDIVAFNKI

SEQ ID NO: 206821 - protein, 123 aa, Triticum aestivum
  unsure (1)..(123): unsure at all Xaa locations
  Clone ID: PAT_TA_101239.pep
AWSRPRYGSLGKASRKSDVFSYGIMLLEVFTGRRPTDVMFGTQLTLRQWVHHSFPAELVRVVDGQLLQGSSLSSCRLDDGILASVFEXLGLRCSSDSPRQRMTMRDVVVTLKKIKAEYLPGRP

SEQ ID NO: 206822 - protein, 54 aa, Triticum aestivum
  Clone ID: PAT_TA_101240.pep
SVVAAEVLFNGYSSTNFPGDNYVKLPKNMSISRQSHITCNPDIRVVVPARAAAR

SEQ ID NO: 206823 - protein, 87 aa, Triticum aestivum
  Clone ID: PAT_TA_101241.pep
DTPQDRFSMFEDRIEMIFSCSETLLKPFLRLGTQKLLLRHALHPTRRPLTPFVNKESQRRDSFISGWPNGTAARPSPIHMYLGRDHA

SEQ ID NO: 206824 - protein, 34 aa, Triticum aestivum
  Clone ID: PAT_TA_101242.pep
RGRGRGLAWGSIGHIVAYYILATTSNGYDPPFFG

SEQ ID NO: 206825 - protein, 65 aa, Triticum aestivum
  Clone ID: PAT_TA_101243.pep
MPGVIPVASGGIHVWHMPALTEIFGDDSVLQFGGGTLGHPWGNAPGAAANRVALEVCVPARAAAR

SEQ ID NO: 206826 - protein, 47 aa, Triticum aestivum
  Clone ID: PAT_TA_101244.pep
RAAARAGTHIHVYTRWIPRALLRDMLRELLNIKRIGFSNHKKVVFLY

SEQ ID NO: 206827 - protein, 55 aa, Triticum aestivum
  Clone ID: PAT_TA_101245.pep
FERPPGQVPCSKGIGALKFNNFLQVSSRLLMFTITASNHMVFHRQLRNIIFQEDK

SEQ ID NO: 206828 - protein, 54 aa, Triticum aestivum; identical to SEQ ID NO: 206810
  Clone ID: PAT_TA_101246.pep

SEQ ID NO: 206829 - protein, 48 aa, Triticum aestivum
  Clone ID: PAT_TA_101247.pep
AKQHHILLQISRRKAQDMIQLHICILRHGTYVNFRVKVIYVPARAAAR

SEQ ID NO: 206830 - protein, 46 aa, Triticum aestivum
  unsure (1)..(46): unsure at all Xaa locations
  Clone ID: PAT_TA_101248.pep
NVRARGATDNAMXLRKNLSMVYXRERQAKIPGEILKIVAGADALSG

SEQ ID NO: 206831 - protein, 63 aa, Triticum aestivum
  Clone ID: PAT_TA_101249.pep
FERPPGQVRAGLCYLFLFFSYLLKCSLVRSNSYIADGKTGCFHQMRELRCAVINARTSAATTL

SEQ ID NO: 206832 - protein, 77 aa, Triticum aestivum
  Clone ID: PAT_TA_101250.pep
AWSRPRLHDYLTGGFTANTTLAHYCRDNGLLLHIHRAMHAVIDRQKNHGMHFRVLAKALRMSGGDHIHSGTCPGGRS

SEQ ID NO: 206833 - protein, 57 aa, Triticum aestivum
  Clone ID: PAT_TA_101251.pep
ERAIDLVPLVVLQVIRQNISCIFRPPFHYVALCYFCHANIIHDLQNMTTETSAATTL

SEQ ID NO: 206834 - protein, 84 aa, Triticum aestivum
  unsure (1)..(84): unsure at all Xaa locations
  Clone ID: PAT_TA_101252.pep
XXFRAAARAGRDLRSMSESDTVDYVARKMWYYHERSLHFCCPSLFLDSNARLACLLASVFLFCFCQRNGGGGGLCGCTSAATTL

SEQ ID NO: 206835 - protein, 76 aa, Triticum aestivum; identical to SEQ ID NO: 206795
  Clone ID: PAT_TA_101253.pep

SEQ ID NO: 206836 - protein, 81 aa, Triticum aestivum; identical to SEQ ID NO: 206796
  Clone ID: PAT_TA_101254.pep

SEQ ID NO: 206837 - protein, 76 aa, Triticum aestivum; identical to SEQ ID NO: 206795
  Clone ID: PAT_TA_101255.pep

SEQ ID NO: 206838 - protein, 55 aa, Triticum aestivum
  Clone ID: PAT_TA_101256.pep
RPPGQVQARNEGRDLAREGNEIIRAACKWSPELAAACEVWKAIKFEFEPVDTIDK

SEQ ID NO: 206839 - protein, 65 aa, Triticum aestivum
  Clone ID: PAT_TA_101257.pep
SSGRPGRYSSLSPLFSRCSRCNLSMFRRCHLRIGWTSGWETIREFNVLCLFVNVKEFVNQIYEFL

SEQ ID NO: 206840 - protein, 57 aa, Triticum aestivum
  Clone ID: PAT_TA_101258.pep
AWSRPRYRHELDNFALRRLAQKQQRSKRQGLLPGSLLTTPGRRRPPSSSRTCPGGRS

SEQ ID NO: 206841 - protein, 81 aa, Triticum aestivum
  unsure (1)..(81): unsure at all Xaa locations
  Clone ID: PAT_TA_101259.pep
RARAGTVVGKLEGEREMTLGFVDLLRDDFIEKDRARGIFFTQDWVSMPGVIPVASGGIHVWHMPXXTEIFGDXXVLQFGGG

SEQ ID NO: 206842 - protein, 64 aa, Triticum aestivum
  Clone ID: PAT_TA_101260.pep
SVVAAEVQVLRCAKFCRQRCLHHCPLERCCFCVCIFIYLVLCSFVCPIDPCVNVCIRCAFLIPW

SEQ ID NO: 206843 - protein, 77 aa, Triticum aestivum; identical to SEQ ID NO: 206832
  Clone ID: PAT_TA_101261.pep

SEQ ID NO: 206844 - protein, 59 aa, Triticum aestivum
  Clone ID: PAT_TA_101262.pep
RGRGRGEQEAWQESPEEDLHCVSLTTAPMLGGFIDVAVFSFFVRNAHIPPGFVPARAAA

SEQ ID NO: 206845 - protein, 52 aa, Triticum aestivum
  Clone ID: PAT_TA_101263.pep
RGRGRGLRLEDLRIPPTYSKTFQGPPHGIQVERDKLNKYGRPLLGCTCPGGR

SEQ ID NO: 206846 - protein, 52 aa, Triticum aestivum
  unsure (1)..(52): unsure at all Xaa locations
  Clone ID: PAT_TA_101264.pep
XGRFRAPRGAGGIXFEGPPGKVWLLGVGSERFGPPLNVTPPPFGVPGSVPVG

SEQ ID NO: 206847 - protein, 74 aa, Triticum aestivum
  unsure (1)..(74): unsure at all Xaa locations
  Clone ID: PAT_TA_101265.pep
PPPXGGXXEFNFKPPPRQGAVLKGEIPGVFRKXPPVPQNKNGVGGASLGIFSPPLKRVGTILPRGGFWPKKFGP

SEQ ID NO: 206848 - protein, 42 aa, Triticum aestivum
  Clone ID: PAT_TA_101266.pep
KIIKPEKNLDDLISGPENSTGRLIFYNGPRLKSLPFQLWVFL

SEQ ID NO: 206849 - protein, 39 aa, Triticum aestivum
  Clone ID: PAT_TA_101267.pep
LVRAWDTQNGNKSCPHLLLQGPNQQISSRDVPLYLPGRP

SEQ ID NO: 206850 - protein, 69 aa, Triticum aestivum
  Clone ID: PAT_TA_101268.pep
SVVAAEVLDKYNEDNGLVGDLAYELEDIVRHKACFDGKDCIYRSYAHFNLTMKTKGAANKDLYLPGRPL

SEQ ID NO: 206851 - protein, 70 aa, Triticum aestivum
  Clone ID: PAT_TA_101269.pep
MLHKYCTFKSYALTLQGDSCRQFIFFPFSFSFSFFYLIKPLRHATTWARLDTPVFYAFYQGLTRKKRATY

SEQ ID NO: 206852 - protein, 96 aa, Triticum aestivum
  Clone ID: PAT_TA_101270.pep
HAYIQCCLHGKPLVCIITCRDREEIPESPLLTCARSSAWLTDVSELAGSNHCTPLSILQFLSLKNHPEKAPMRHLSLQFERCIPMVLFRYLGRDHA

SEQ ID NO: 206853 - protein, 92 aa, Triticum aestivum
  Clone ID: PAT_TA_101271.pep
SSGRPGRYQIQTEGALVATMMLIQQMTLGTELQDHCHRQIKRKEMGRSTTNREKVTYYGLSKKTTFCTIFRRQGHEGTMCPDCGDVPRPRPR

SEQ ID NO: 206854 - protein, 86 aa, Triticum aestivum; identical to SEQ ID NO: 206785
  Clone ID: PAT_TA_101272.pep

SEQ ID NO: 206855 - protein, 100 aa, Triticum aestivum
  Clone ID: PAT_TA_101273.pep
GRPGRYNNNTNPSSQPTYNTAAKATASPATIVMTATSRPFAAPFLFPPFPDEPLLLFCCPSTSLSLVVTPLLKSGSVSDCPPAVCDPSPASPTAPRPRPR

SEQ ID NO: 206856 - protein, 36 aa, Triticum aestivum
  unsure (1)..(36): unsure at all Xaa locations
  Clone ID: PAT_TA_101274.pep
GLVDILSTGKLXCRLPNMNKHKRPESNTAIMRIHLT

SEQ ID NO: 206857 - protein, 93 aa, Triticum aestivum
  Clone ID: PAT_TA_101275.pep
VEYLAAEVLELAGNAAKDNKKTRIVPRHLLLAIRNDQELGRLLSGVTIAHGGVIPNINPVLLPKKAAEKAEKAGTAAKSPKKATKSPKKATKA

SEQ ID NO: 206858 - protein, 93 aa, Triticum aestivum; identical to SEQ ID NO: 206857
  Clone ID: PAT_TA_101276.pep

SEQ ID NO: 206859 - protein, 93 aa, Triticum aestivum; identical to SEQ ID NO: 206857
  Clone ID: PAT_TA_101277.pep

SEQ ID NO: 206860 - protein, 133 aa, Triticum aestivum
  unsure (1)..(133): unsure at all Xaa locations
  Clone ID: PAT_TA_101278.pep
RALPQGRYAQRVGSGAPVYLAAVLEYLGRTGRVWNVTKRAIGAEINKQVGNRIIKKRIHVRVEHVQPSRCNEEFLQXKLNNDKLXXEAKARGEVISTKRQPAGPKPGFMVEGTTIEXVTPIPYDVVNDLXXGY

SEQ ID NO: 206861 - protein, 93 aa, Triticum aestivum; identical to SEQ ID NO: 206857
  Clone ID: PAT_TA_101279.pep

SEQ ID NO: 206862 - protein, 70 aa, Triticum aestivum
  Clone ID: PAT_TA_101280.pep
HLEEEAVHSYTEFLKDLDDGKIDNVPAPAIAIDYWRLPANATLKDVVTVVRADEAHHRDVNHFASDVYLP

SEQ ID NO: 206863 - protein, 82 aa, Triticum aestivum
  unsure (1)..(82): unsure at all Xaa locations
  Clone ID: PAT_TA_101281.pep
PKKIQILFINKLXHKPTFHGSKQTQGKKKLPRINPHKKGGKLCFETQKEKKTLLPKNLGPVGLKKPPHPSSKRLWGLCKTPP

SEQ ID NO: 206864 - protein, 89 aa, Triticum aestivum
  Clone ID: PAT_TA_101282.pep
SSSESDVLFNSTFKVYRLNFSIEPAKWVKLEKLENHALFVSLDRRDPTFCCISPERWGGKSNCIYFARLSDDPDETWTAVELGQPVPAR

SEQ ID NO: 206865 - protein, 93 aa, Triticum aestivum; identical to SEQ ID NO: 206857
  Clone ID: PAT_TA_101283.pep

SEQ ID NO: 206866 - protein, 93 aa, Triticum aestivum; identical to SEQ ID NO: 206857
  Clone ID: PAT_TA_101284.pep

SEQ ID NO: 206867 - protein, 66 aa, Triticum aestivum
  Clone ID: PAT_TA_101285.pep
VPRAEHERGAILLGDEGAELLPGLLDGLLVWKQHLIHMWVAEGFIHEKQGRSRYEIGESYFNELIN

SEQ ID NO: 206868 - protein, 93 aa, Triticum aestivum
  Clone ID: PAT_TA_101286.pep
VEYLAAEVLELAGNAAKDNKKTRIVPRHLLLAIRNDQELGRLLSGVTIAHGGVIPNINPVLLPKKAAEKTEKAGTAAKSPKKATKSPKKATKA

SEQ ID NO: 206869 - protein, 93 aa, Triticum aestivum; identical to SEQ ID NO: 206857
  Clone ID: PAT_TA_101287.pep

SEQ ID NO: 206870 - protein, 75 aa, Triticum aestivum
  Clone ID: PAT_TA_101288.pep
KKTAIIPPPNQNTIPRGDQGPKTNKVAANKKGSEGLNKNIPLLLCKPKGTSHFKGGRFTHTQQPFFFYPKSFLSP

SEQ ID NO: 206871 - protein, 104 aa, Triticum aestivum
  Clone ID: PAT_TA_101289.pep
TGRVWNVTKRAIGAEINKQVGNRIIKKRIHVRVEHVQPSRCNEEFLQRKLNNDKLKAEAKARGEVISTKRQPAGPKPGFMVEGTTIETVTPIPYDVVNDLKGGY

SEQ ID NO: 206872 - protein, 93 aa, Triticum aestivum; identical to SEQ ID NO: 206857
  Clone ID: PAT_TA_101290.pep

SEQ ID NO: 206873 - protein, 114 aa, Triticum aestivum
  Clone ID: PAT_TA_101291.pep
RPFSYGLVICNVYDSGSVFSPEVLDLTEEDLMDKFASGVSMVASLSLAISYPTMAAAPHMFLNAYKNVLAVALETDYSYDHADKIKEYLGRTQGWRPQEEVGDAVRQGRAPVPC

SEQ ID NO: 206874 - protein, 99 aa, Triticum aestivum
  Clone ID: PAT_TA_101292.pep
YVLALTAENFLARRLQTLVFKAGMAKSIHHARVLIRQRHIRVGRQIVNVPSFMVRVESEKHIDFSLTSPFGGGPAGRVKRKNQKKASGGGDAGGDEEEE

SEQ ID NO: 206875 - protein, 93 aa, Triticum aestivum; identical to SEQ ID NO: 206857
  Clone ID: PAT_TA_101293.pep

SEQ ID NO: 206876 - protein, 93 aa, Triticum aestivum; identical to SEQ ID NO: 206857
  Clone ID: PAT_TA_101294.pep

SEQ ID NO: 206877 - protein, 93 aa, Triticum aestivum; identical to SEQ ID NO: 206857
  Clone ID: PAT_TA_101295.pep

SEQ ID NO: 206878 - protein, 93 aa, Triticum aestivum; identical to SEQ ID NO: 206857
  Clone ID: PAT_TA_101296.pep

SEQ ID NO: 206879 - protein, 58 aa, Triticum aestivum
  unsure (1)..(58): unsure at all Xaa locations
  Clone ID: PAT_TA_101297.pep
KRXXXXMVISSPGKAANEKFNHKLVIXXRLLLXLYRPSAEQQNXXVLFVXXPXRELCT

SEQ ID NO: 206880 - protein, 136 aa, Triticum aestivum; identical to SEQ ID NO: 116005
  Clone ID: PAT_TA_101298.pep

SEQ ID NO: 206881 - protein, 176 aa, Triticum aestivum
  unsure (1)..(176): unsure at all Xaa locations
  Clone ID: PAT_TA_101299.pep
APPRRXXGAAAPPPSIRGTPPPPRIRRRQPEQPRPGPPAKRGGPPWKPPSWPDPGEHGPPKRGHPAAPMPGTAGHRTPPPPXSPGPPPRHARAGQPPSPPPAESGGRRRHHEKEPPPAPFGSGGPPPPRRRCRRQRRRGSTGGGLLDGCAVAPPESPGERLGRPRGRLSDFFLNPR

SEQ ID NO: 206882 - protein, 175 aa, Triticum aestivum
  unsure (1)..(175): unsure at all Xaa locations
  Clone ID: PAT_TA_101300.pep
ARGSPPLYPPTRSATRARVRGEMPGGPDRRPRVRRVRRLHLAAPPALAPPVRVPVEQLPEINSASPEARAEMLRVVMGRFPDRSEWPDRCIQVIQTSTFAERAPFTGDDGGVEYKLLFWAIQEAESTVPVTARRWARFKTTSPSRLNIRPPPVVQLANIPREFLPPGEXXPEAXX

SEQ ID NO: 206883 - protein, 159 aa, Triticum aestivum
  Clone ID: PAT_TA_101301.pep
FSIGAHTTMVFSLLLLPPYGLDLGELGLHHRVSRGGVLPDGEHPAAQTAHTGERARRPDVQASGGREVVGDSFFGNVVSASHMARSSRDCTNPSSAVLLVVAAWLWLLLSASGVLADGGKGTMCLCMGPQCVPPCPVPGTPTPTMSPTQFPFCPQRLPA

SEQ ID NO: 206884 - protein, 163 aa, Triticum aestivum
  Clone ID: PAT_TA_101302.pep
MFGFGHHGHHGQNPPAHAPAAAGGNQPTFKIFCKADEGYCLSVRDGNVVLAPSNPRDEHQHWFKDMRFSSQIKDEEGNPAFAIVNKATGLAVKHSLGQSHPVKLVPFNPEYLDESVMWTESSDVGKGFRCIRMVNNIRLNFDALNGDKDHGGVHDGTTVVLWE

SEQ ID NO: 206885 - protein, 75 aa, Triticum aestivum
  Clone ID: PAT_TA_101303.pep
MKKKKPVLFLALDALLVAALLLPGQCQGSQGANLTVTGTVFCDACSSSSFSNHSYFLPDVKVRIDCAIRVSSASN

SEQ ID NO: 206886 - protein, 143 aa, Triticum aestivum
  Clone ID: PAT_TA_101304.pep
MHDDEGKLQLEDVCLHVSYNKRGYLQELWNIPLDSCVDASPLLVLNNGMINIFIGSHSHLFLCIDGCNGSVRWSVKLEGRVECSAAITGDFSEVVVGCYKGKIYFHDMLTGKLSWTVQTDGEVKMQPVVDRTRNLIWCGSYDH

SEQ ID NO: 206887 - protein, 154 aa, Triticum aestivum
  unsure (1)..(154): unsure at all Xaa locations
  Clone ID: PAT_TA_101305.pep
KYCVAEHSGRLASLLGDGVDGVDDTRDVPEEGQQEADPELVLQERNQETIISNQNLLCTLPSEFHLYMSLSILLSTYASINLWIEPEKGRRKKRERGKNLVPMLTPHPNLRKTPRGGRMMARMMSMQLAVPAMVVDLXXERRAFSLDRWTEGKQ

SEQ ID NO: 206888 - protein, 177 aa, Triticum aestivum
  unsure (1)..(177): unsure at all Xaa locations
  Clone ID: PAT_TA_101306.pep
ARGPTRPSSVSKSPKTWTATGGLRRRRRPPHRRHQCSATTISSARSSSASASPTASSAPPSSPSGGSSTPPTRPSSAASASATRPASSASAPATRXDRSSSCRSHSPRSSPPSRGARPPPAPTPLPEEASASSTAGTAASSSSPSAREHSSTPSSRRCSTGSPRRSSHRSRRPAVIR

SEQ ID NO: 206889 - protein, 118 aa, Triticum aestivum
  unsure (1)..(118): unsure at all Xaa locations
  Clone ID: PAT_TA_101307.pep
ARRTSWRPGAPVAGRPPTRPPRAPPRRPPPPPRRPRRRGAXAGTPSARGGGSRPAAAPARRPGRRRPRPRSPARSPPPPRPSPPSRRPGSGLRGKGERWGSGGGRGHATRQCQRLAVM

SEQ ID NO: 206890 - protein, 146 aa, Triticum aestivum
  Clone ID: PAT_TA_101308.pep
RAPGRRRRPQEESVSRSVKAGLQFPVGRIGRYLKHGRYAKRVGSGAPVYLAAVLEYLAAELLELAGNAARDNKKNRIIPRHVLLAIRNDEELGKLLAGVTIAYGGVLPNINPVLLPKKAAAAATKEPKAGTTKSPRKSPAKKAADA

SEQ ID NO: 206891 - protein, 154 aa, Triticum aestivum
  unsure (1)..(154): unsure at all Xaa locations
  Clone ID: PAT_TA_101309.pep
ARGKSAVETVTLEVESSDTLQSVKAKIFDQTCMPPGGHRLFLSGKLLEDSCTLADYNIENDSILDSDVRSPWPSEMLRLSVKTPTSMSSSMXCMRSETVHDLKAKVYVELGIPPNEQRLLSGGVDGVPLEDGEPLLGEGTSICRSSDLLLVVDR

SEQ ID NO: 206892 - protein, 120 aa, Triticum aestivum
  unsure (1)..(120): unsure at all Xaa locations
  Clone ID: PAT_TA_101310.pep
LGFWPPPLTSLGSTTSGDGEARSPPPTPSGGAFHHPHPRPSSPHRHSVPTPLDPFPFLSSVFSSRRPTLHALARLCGSVDTEISQCVEKAEAAKQEATVVTLNAXXRRAKAKLLEEDLPK

SEQ ID NO: 206893 - protein, 58 aa, Triticum aestivum
  Clone ID: PAT_TA_101311.pep
ARGREREYCGRSWNRHRAVLAHDYFSNPWTSMSAAAAVLLLVLTVVQTVYTVLPYYHP

SEQ ID NO: 206894 - protein, 132 aa, Triticum aestivum
  Clone ID: PAT_TA_101312.pep
PKGKKGVAGRKAGGPRKKSVSRSVKAGLQFPVSRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPRS

SEQ ID NO: 206895 - protein, 120 aa, Triticum aestivum
  unsure (1)..(120): unsure at all Xaa locations
  Clone ID: PAT_TA_101313.pep
XARGSRMXXGGMALQHEGGGRSLAPLVAGYAAQHGKAGSGRRPSSEEVVSPWISPQRRSYNTSQXAPXPRGARRWXYCSAXRELSPAATIVALQCSPRLSKLQCIXXXSXVLLXGXXAST

SEQ ID NO: 206896 - protein, 149 aa, Triticum aestivum
  unsure (1)..(149): unsure at all Xaa locations
  Clone ID: PAT_TA_101314.pep
HEALLTSHXXEWALNIAIVEAEGRLGMFGIFHETAGDLCYYVKGNKGESSQWQIDKTISIGSGHRHYIKAASKRYLLLGKYVVRRNVSPSVSDSTSILPPLDMPGEECISIDIKTLQLERVCVRSFGFGRYGMHIYTNFPPSLLSAPTI

SEQ ID NO: 206897 - protein, 163 aa, Triticum aestivum
  Clone ID: PAT_TA_101315.pep
MLPVWINPSLVQNLTSLWFNLKEVKARDMEILGSFPELVTLRLTDMLLGLSESQDFLPDVMGGLFPKLRYFSTPAPLRFLEGAMPSLESLVYSYLQVDQFKRDSSFVFEFGSWENLHSLHKVQAHFRPGAPQENEDEAVVALELAANQHPNRPNLEVLSPIGK

SEQ ID NO: 206898 - protein, 80 aa, Triticum aestivum; identical to SEQ ID NO: 133878
  Clone ID: PAT_TA_101316.pep

SEQ ID NO: 206899 - protein, 149 aa, Triticum aestivum
  Clone ID: PAT_TA_101317.pep
HEVYDHVRDEHALAPAPNCDTGGLLRGASVTLRRDEPAVHALLHGDRVSVILLLNGGDVLAGRSLSLVRICPHPKPGQEDEEVEYRMVVTRDEPEPGTGSPSLAASGKVQYVRRLEGYRPRHFLFVPDAFWGSSGSVVVTVTTTVTVHL

SEQ ID NO: 206900 - protein, 134 aa, Triticum aestivum
  unsure (1)..(134): unsure at all Xaa locations
  Clone ID: PAT_TA_101318.pep
MADAAALVAVPPTPQQRHPLSQIAASGTHRLLLKQWLKEEDLLARRVALREARLDGARKEIAFLYCAFFAFHAASVLVLFLSASIPSPGPYSSSCRRSWIPCLVSLLASLAMLWALRYKADTEAVLERVLAREX

SEQ ID NO: 206901 - protein, 164 aa, Triticum aestivum
  Clone ID: PAT_TA_101319.pep
GRHHMLFSSCRKSTKPRRTMKGTVFVEKNCDIQRMRGRGLPWVDGSREPNDNGPEMSGGRKEGPNRGGRRPIGKDSAPPASDHAEHEKRKRALPAESTSPLICPVSHGRWASLARRLCSPSESCAGGAVSAVHRRWRWHAAVASSPWPYACHQLHTDKRSELKG

SEQ ID NO: 206902 - protein, 176 aa, Triticum aestivum
  unsure (1)..(176): unsure at all Xaa locations
  Clone ID: PAT_TA_101320.pep
MKLMYKVGEYGPPPSGVIHAISPRLYQSTMEQLAAAGAVDVLHNKVPQVIKAQTEGLHEGCSAQRLAGQVSTKFMRLLDPQVGSSAAAEGDLDGRLDEEAIDNLLNGEGMEDIVKTSIPKAYSKEILYDLIVECVAQYRKWLLDNRDKLDKEKYKQCLKQLLPMAKLTSVYDKXPE

SEQ ID NO: 206903 - protein, 101 aa, Triticum aestivum
  unsure (1)..(101): unsure at all Xaa locations
  Clone ID: PAT_TA_101321.pep
PRXALSPAPRAXRSTPPARPTPPXXHRPRVATPGHWRCRHRRRLPAASGGPTTGTSGASWPGCSSSDPPPSWLIGVRNYQLTTGKDLNRKGILQVLVASRS

SEQ ID NO: 206904 - protein, 94 aa, Triticum aestivum
  Clone ID: PAT_TA_101322.pep
VQPGVYGSICPIDCSEACGSVSTSPAALPPSTLPLAMGGSCSASVAIAGKCSGSIGSWLSLTSSITDVLLIGCSRNSIAKSAAYFCSTADLQAR

SEQ ID NO: 206905 - protein, 181 aa, Triticum aestivum
  unsure (1)..(181): unsure at all Xaa locations
  Clone ID: PAT_TA_101323.pep
HEVVFSDYYATGKLDVDLAEKVIKGILDGCEQSGRNLIGGETAEMPGFYAEGEYDLGGFAMGVVDKDKLIDGKNIVEGDILIGLPSNGVHSNGFSLVRRVLDKSGLSLTDQFPGNDGKTTTFGETLMTPTIIYVKQVLEIISKGGVKGLAHITGGGFTDNIPRVFPXGLGAXXFTGXWEVP

SEQ ID NO: 206906 - protein, 140 aa, Triticum aestivum
  unsure (1)..(140): unsure at all Xaa locations
  Clone ID: PAT_TA_101324.pep
MAPKAEKKPVEEKXREDHGXXRRPRXXKRPPASKEGGADKKGKKKAKKSVGTYKIYIFKVLKQVHPDIGISSKAMSIMNSFINDIFEKLAAESAKLARYNKKPTITSREIQTSVRLVLPGELAKHAVSEGTKAVTKFTSS

SEQ ID NO: 206907 - protein, 167 aa, Triticum aestivum
  unsure (1)..(167): unsure at all Xaa locations
  Clone ID: PAT_TA_101325.pep
MEAAFKENGTRWGHLKDLHHALRLCKNALLFGTPSTQPLGKLYEARVFEIPEQKVCVAFLSNHNTKEDGTVTFRGQNYFVPRRSVSILGDCKTVVFSTQYVNAQHNQRTFHFTDQTVQNNVWEMYTEGDKVPTYKFSTDRSEXPXEAYNMTKDKTDYLWYTTSFLLD

SEQ ID NO: 206908 - protein, 177 aa, Triticum aestivum
  unsure (1)..(177): unsure at all Xaa locations
  Clone ID: PAT_TA_101326.pep
XPHKNDHVCIVQGNCPCTREFTGKPSTPWAKLHVPLVKLHSYVRKTSHPRLMSTSPGILFIGFGSGEERATVTSTPHGRSHLGGRIRWVLVVNPRPDAVLGYPCCTKEVLVARGGRAGRRWLEPRWPGRERSGGVGARKKVGSGVSGGAGAPAEKKVGERWFWWHDGPDGEEGGGAR

SEQ ID NO: 206909 - protein, 182 aa, Triticum aestivum
  unsure (1)..(182): unsure at all Xaa locations
  Clone ID: PAT_TA_101327.pep
ARGGAEVMLELSNSNGWCVAVKLHGVTRVSLKPSEQRFYVVNRHTHAYVWAVEDGWKLEFPDKWDWLLFKELHIEGRERNSQGKIIPIPGVHEVSDGMGGTVADPFSRPVPDYIRTADDEVARALSRDSAYDMDSEDEEWLIQLKHGASDXKTXRLSQISYEDFEKLITVFEKDAYNNPEEX

SEQ ID NO: 206910 - protein, 115 aa, Triticum aestivum
  Clone ID: PAT_TA_101328.pep
MERRDNSYYARFTEPRCTMQCIGKCTEICYKDPVLEDRQWSAYIDRSPGEDSYSLECFNACISGCGYRFDIPAEKVGLIKPNRPSKPPPPPVVERAKPGSGPPAAAGEDVPGTSA

SEQ ID NO: 206911 - protein, 183 aa, Triticum aestivum
  unsure (1)..(183): unsure at all Xaa locations
  Clone ID: PAT_TA_101329.pep
ARGKNSTWRNALESALAQAPSVASTVGQNPIFNADGTESSEASTEQSEDKSSVIGRPAQFALVEADGSPAFLEKALRFIEDYGCKGEGILRQSADVEEVKRRFRDYEKGKKEFSPDEDGHVIGDCIKTILREMPASPVPAACCTALVTAYRTDKTKRLDALNKVVYEXXXEPNRQLLQXILKM

SEQ ID NO: 206912 - protein, 93 aa, Triticum aestivum
  unsure (1)..(93): unsure at all Xaa locations
  Clone ID: PAT_TA_101330.pep
XLPPAPPCDNGDRAEVVVRGSRYSDPYLIRPLPPVLCGAAACGPAKGRAGPGPGAHGSPCAVLWRVGRPEVWIFFFSFSVFLTLVLIIVFVQF

SEQ ID NO: 206913 - protein, 73 aa, Triticum aestivum
  unsure (1)..(73): unsure at all Xaa locations
  Clone ID: PAT_TA_101331.pep
PCMDHTLSNPVISLQNIFANPLTTYLLTTPPPTTNXXKNRTRMQVQRTPVDRPXXSPKKKNWRXVLSLSLSLV

SEQ ID NO: 206914 - protein, 173 aa, Triticum aestivum
  unsure (1)..(173): unsure at all Xaa locations
  Clone ID: PAT_TA_101332.pep
ARGNGAFVEQFQIFYSELKDFFNAGSLFEQLESIKESLNDSGLEALSSFVKTKQSLDQVDAANIQVVMKTLQSLSSLRSVLMKGLESGLRNDATDAGIAMRQKWRLCEIGLEDYSFVLLSRYINGLEASGGSASLAQCVAGNTSVWDDTLDALIIGVNQVSFSGWKPEECIAX

SEQ ID NO: 206915 - protein, 99 aa, Triticum aestivum
  unsure (1)..(99): unsure at all Xaa locations
  Clone ID: PAT_TA_101333.pep
FKNQFFQTPSQKSECRQQLIFLLHTTVKKIVKNNAADSKFICYKLLKHTTSRSISTFCIYVVTFXXTXHILLLTXXXIAVTITIKFMHREGEKNTCISP

SEQ ID NO: 206916 - protein, 127 aa, Triticum aestivum
  unsure (1)..(127): unsure at all Xaa locations
  Clone ID: PAT_TA_101334.pep
MVVASKEPFPAVRKCDASRRGDHTVVSDLDGTLLRSRSAFPYYALVAFEAGGVPRLALLLLLAPLAGLLYHAVSESAGVRMLVFAATAGARVADIESAARAVLPRFYADDVHPDAWRVFXXCGRXWV

SEQ ID NO: 206917 - protein, 171 aa, Triticum aestivum
  unsure (1)..(171): unsure at all Xaa locations
  Clone ID: PAT_TA_101335.pep
MRGARFNLPELQVRDGIGRGHPLPLISSSASPFPQAFHALIRPSTPGGSRRSTTTAGIGGGTPSTPRSRSTGGPFSPEPNLPPSAAAARPCLSFHLGCFHRXPRSADXQPVVQHRVPKIGTPPTDNQLLEISEIVQLRSFWLCLFRSATRTSAMATSVSPYHDLQLEWQPP

SEQ ID NO: 206918 - protein, 89 aa, Triticum aestivum
  Clone ID: PAT_TA_101336.pep
HEGSPQAIFKDPFRRGDNLLVSRCYYFLSSLFLSNFLCTIDAGCHKVGKVRCRWAWSLKKLQENIVFWALLRFNLVKILLFTVAKLYRC

SEQ ID NO: 206919 - protein, 141 aa, Triticum aestivum
  unsure (1)..(141): unsure at all Xaa locations
  Clone ID: PAT_TA_101337.pep
MGGIVIDYVXXIDVLHRTRCCNDCNMLSTETLLAKGHLQSSQTKNQEGVKVCGYLQRPNEARLAEQSVDRLMVFHTSAWSTHSSLLSSEPSSFPALHSAPPHLYSPSLPRATPGLFPSSRLHLQLAHRASSAASSLSTSIP

SEQ ID NO: 206920 - protein, 90 aa, Triticum aestivum
  unsure (1)..(90): unsure at all Xaa locations
  Clone ID: PAT_TA_101338.pep
SQSXQPXKNKHEAXKLSIDRRVSCSEGDHGLEAADAVEXXREPHLPLTLRRRALVHLQLLLLFLRGFLWLLPSCLWIVIELHVYFCWLLN

SEQ ID NO: 206921 - protein, 87 aa, Triticum aestivum
  Clone ID: PAT_TA_101339.pep
RSQTRQEILHETILFHTYETLCQRLPLIPSPNTWSFKAHASPHTLLNYSHMEIRLQEGNIEEHILGLIDSNMSYSGCLVRCMITSMN

SEQ ID NO: 206922 - protein, 80 aa, Triticum aestivum
  Clone ID: PAT_TA_101340.pep
ARGTVAVFFIGGLIIVGQCRPEPENIYDEGKLTLKWCLQKDCKTKGDPWTWKRECICCVTLPDVPCYHSQNECQKNCPIR

SEQ ID NO: 206923 - protein, 61 aa, Triticum aestivum
  Clone ID: PAT_TA_101341.pep
ARGKIFLMYGLAYLKLFFLSLLTASCFFFFGLHFAYHLCSEGVHGLYLSKRVLHNVVQPCC

SEQ ID NO: 206924 - protein, 65 aa, Triticum aestivum
  Clone ID: PAT_TA_101342.pep
NKMNPSYRRHHPSQKLENGSDTAASVNIHLESHKSSRKINSFVHLWSGLQPHCITQQQNSDSKIR

SEQ ID NO: 206925 - protein, 43 aa, Triticum aestivum
  unsure (1)..(43): unsure at all Xaa locations
  Clone ID: PAT_TA_101343.pep
QGMQMPTFXRVLIFGVPTILLIMNTIWVAKILXXLKKTLTQXG

SEQ ID NO: 206926 - protein, 157 aa, Triticum aestivum
  unsure (1)..(157): unsure at all Xaa locations
  Clone ID: PAT_TA_101344.pep
ENMSALIRNLRPALSGLLRPKPAARTTVPPPPTARRYYHAPSTRRSHEALKSPGRDSLVRRPPPSPQAPAVPRPRYYSSRRPRSSNEVKVQIVIAGVVIVGGVGGHDLLRHLRDRALHXTAATSSSSRTRESLSSXXRSSTTRRXXLGDXXLPPSHP

SEQ ID NO: 206927 - protein, 154 aa, Triticum aestivum
  Clone ID: PAT_TA_101345.pep
MPGAVIVHHHNRYKTYPGDVTGFVFYSCLVASVGGCIFGYDIGMAASLTSTESFLLLFFPDIYQQQKDQVITNQYCKFDSQELSLFGSSLFLSAATASLFASPMARAFGRKWTLFYAAVAYITGACMGGIATTFAVLITGRLLLGSASASTPRL

SEQ ID NO: 206928 - protein, 71 aa, Triticum aestivum
  Clone ID: PAT_TA_101346.pep
SLGHLIHTYMTTTTHLLACRSARVHSLYLCAADPAATPCCRACNFLCTWLTNASLRGYYMQQIKHDLILNA

SEQ ID NO: 206929 - protein, 83 aa, Triticum aestivum
  unsure (1)..(83): unsure at all Xaa locations
  Clone ID: PAT_TA_101347.pep
GSKTKEGARRVAAKIVDGSNGDVAVDSYHLYKEDVRLMKDMGMDAYRFSISWTRILPDGTLXXGVNXXXVEYYNNLINELLXR

SEQ ID NO: 206930 - protein, 158 aa, Triticum aestivum
  unsure (1)..(158): unsure at all Xaa locations
  Clone ID: PAT_TA_101348.pep
RTRPTTPPKTEREVVGVHIVVVRDAWXMGSPPLRRPPHKEVHSDATCTARHPRRRALRPFLLAGPAAAAAHEARPLRLHSCTWSIAVRQNHRGLGRIGLRDDAMSCPACVXXXAHWRLARWGSSNTDXXCCTHXXAAXXICTLSXXSTGSTSTGSSAX

SEQ ID NO: 206931 - protein, 142 aa, Triticum aestivum
  unsure (1)..(142): unsure at all Xaa locations
  Clone ID: PAT_TA_101349.pep
QXXQETSHSRRIQASCGGRDRHPHRLHGGRLQRQSTSTSSPPPSRNGYSGPATPPSPFTGPRDPRPRGTGGSKPAVVESHSVAVPLTLDVGCVQVRTIKKEMRGASDQSSHAVDRSWTGFPHGSSREDKNTRLEKGESEPRA

SEQ ID NO: 206932 - protein, 151 aa, Triticum aestivum
  unsure (1)..(151): unsure at all Xaa locations
  Clone ID: PAT_TA_101350.pep
MSRPSPAPALDGGVLLEEILLRLPPQPSSLPRASLVCTRWRRILSDPGFRRRFREHHGRNNPPPLLGFFEKEFRVDKPPIFNTTATGERDRIPPARFSAPWSLGEGWEFLGCRHGLALLICRARREAIVWDPLTGHRRRVAFPXSPSRTPR

SEQ ID NO: 206933 - protein, 46 aa, Triticum aestivum
  Clone ID: PAT_TA_101351.pep
KRLFTCLFRYWGQQIHGQSCRINLMWPYLARIIFIPRCENSYLPSI

SEQ ID NO: 206934 - protein, 160 aa, Triticum aestivum
  unsure (1)..(160): unsure at all Xaa locations
  Clone ID: PAT_TA_101352.pep
RTHMLQRSKTTEASHTEETIDLRQTMGLSISYPPDDYLPADDDNSDRLFVRSLSLHNLGSLETPDSPPEISDAVSSTKPARKGSLNARRKEGPPLHVDTTKPRASPKPDTECCTHKHNHSLPKYGANYLPPNSPVVGMVSPQHQAAAVRVQXXYXSFXTX

SEQ ID NO: 206935 - protein, 127 aa, Triticum aestivum
  Clone ID: PAT_TA_101353.pep
MSMAEEQYYGGPRGAPHGLLLAVVVGLVVAGPLFLGDGGEAVTDAIAELLSPVGLLLLPVGLLLLIRLLSSDRGAAALADVFAFGGSPDAVHRVGGSPIGVALMLLLILALLYYRSALFGGGGDDDE

SEQ ID NO: 206936 - protein, 203 aa, Triticum aestivum
  unsure (1)..(203): unsure at all Xaa locations
  Clone ID: PAT_TA_101354.pep
ARGTLSAFEVIKDLLPDVVIYQFAPLDCPDAIESFIGYWKPSLILLMESELWPNLIMSAAEKGIAVALLNARMSLKSFNRWSVPLGLPLVSLMLSKLSLVIPLSTIQAVRFQLLHTPPYKIHFAGDLKYAVGDVEVREKELNTIKDLQRQFNDRPIWMAASIHXXEXXVLLRVHDELIKAYASLLLXLVXXHPXXIKNVSLAL

SEQ ID NO: 206937 - protein, 144 aa, Triticum aestivum
  unsure (1)..(144): unsure at all Xaa locations
  Clone ID: PAT_TA_101355.pep
XSHTDLRRKLHLKHIIMKIDIQTTENSDMQTFKIYILYWIGPKLSVGKYSNVHCGQNREECDTMECGLTSFQPLVHGQKLRNHQPISLDLRPGRHPVHKHAAPASAPSQASLWRERRGRAAGDGHHRTRMWIREARIQEKSSGR

SEQ ID NO: 206938 - protein, 177 aa, Triticum aestivum
  Clone ID: PAT_TA_101356.pep
IKISKFYGLLLNQSSPAAWGSSSQSIARRPGVRSPFLCTPWFLPCRTVHLCSRPLPALVPVLLLLSSTSADRPQRLRLPCTSSFLLAPPGRMPHARRRCRVTQPPASLHKGRRIAEPIPGPFLLPPISPLIPSRIFDAGRGCCWIHSVRERLKPPLSRSSSALCSPTGDRHLLRPRA

SEQ ID NO: 206939 - protein, 60 aa, Triticum aestivum
  Clone ID: PAT_TA_101357.pep
FFYLYIQNNSPVGSLPIFCFQIFVLGSINIYQLGINLKWCGVSCARSGVQGSPDKHRPVF

SEQ ID NO: 206940 - protein, 197 aa, Triticum aestivum
  unsure (1)..(197): unsure at all Xaa locations
  Clone ID: PAT_TA_101358.pep
TRPPSPSRFKPSDDALAMEDELNSESDSESGGEVHPWNEQDLVVVDDDDSHSNRLEHSTSAPDESIIQADNFSRLPSMKTFNRSHNIVSFKDYTSLLEEPINQKMLTKTLSHSERLGMIWPEQPLDMLAQCLPDSTPPFASGKALKTYLSSKSVNEXSCAFPXXSALHGLNIGSVVAKGKRPYFVRIISKQMVGVFX

SEQ ID NO: 206941 - protein, 180 aa, Triticum aestivum
  unsure (1)..(180): unsure at all Xaa locations
  Clone ID: PAT_TA_101359.pep
HEGRTHAPWRPRSSPCWCSSSSSSRRPAAPAPTTWPPTRPRSGPPAAAASTSRRSWPSSRSSPSSTTSSARRAWPRTSTAATPSPCSPPSTPTSTGCSAAARACRGPPSSSSSPSTSSSTTTTPPSWLPCPAAAAPSPSSPPRSTXPSAPPTATSPASSPSPPRPXXXPSSPRXXPARSS

SEQ ID NO: 206942 - protein, 169 aa, Triticum aestivum
  unsure (1)..(169): unsure at all Xaa locations
  Clone ID: PAT_TA_101360.pep
MAPAMRPEQEASCKATEDHRSEFDAAKPPPFRIGDVRAAVPAHCWRKSPLRSLSYVARDVAVXXXXWPPPRGRADSWALWPLYWAVQGTMFWALFVLGHDCGHGSFSDSGTLNSVVGHLLHTFILVPXXGXXISHRTHHQNHGHIEXXXSWHPITXXXYXXLEPRXXXL

SEQ ID NO: 206943 - protein, 212 aa, Triticum aestivum
  unsure (1)..(212): unsure at all Xaa locations
  Clone ID: PAT_TA_101361.pep
HEGETQAILPEVFKALSGFEMGSEFSEEMVSKLRDYGQSIVENKAKEEASKILMHMKERFTVVFSHDKDSMPRTWTGKEDVRAIAKEARSAALKLLSVLAVIRWDDKPDRIENILISKLLDGSVASKSSSASSGDPLASTNWEXXHPKHTLITPAQCKSVWKQFQSETEFTITQAVSTQQAHRRGNGRLPPPWALVAMAVLXXDXXMMLLTC

SEQ ID NO: 206944 - protein, 81 aa, Triticum aestivum
  unsure (1)..(81): unsure at all Xaa locations
  Clone ID: PAT_TA_101362.pep
QLEDFMALINXQPSKKFKKKGGKKKGTVLKSPAFTIFGRGTNYFKTIQQFFLFNNNGGGGFFFILQAFXXXKKNLSPTRAH

SEQ ID NO: 206945 - protein, 71 aa, Triticum aestivum
  unsure (1)..(71): unsure at all Xaa locations
  Clone ID: PAT_TA_101363.pep
FFFFFXXQQKTGRLECHIYFHILSVGTKNTAFDAPFFYNIKYKNGFPYTSFLSSISHEILEPKVSNGSTSS

SEQ ID NO: 206946 - protein, 120 aa, Triticum aestivum
  Clone ID: PAT_TA_101364.pep
ARGFKVAPSSNWRDFIKQTPVNYILWKVFWYKLIPNFNTLPYFNLLGSIIKYHRHLVHHGPDHARDGKVTTMSSTDDSELLAAAHDQDCLAECIKNLLQQKKVTSDVSVVLDAYAVTWEL

SEQ ID NO: 206947 - protein, 140 aa, Triticum aestivum
  unsure (1)..(140): unsure at all Xaa locations
  Clone ID: PAT_TA_101365.pep
MTVSVHDMDVEGLLARGQQLRQLIDRFLACRPTGAARRSRVVLATLWPVVKESGRLYEDVAVVLAVLLDRFFDMEYPECVKAFEAHVSTARLVDDLLAFYSWCDDAGVARSSDFPXXKRIDDKLLETLEQFVRERGSPRQ

SEQ ID NO: 206948 - protein, 65 aa, Triticum aestivum
  unsure (1)..(65): unsure at all Xaa locations
  Clone ID: PAT_TA_101366.pep
KNGGNHRPKGGKKFFFIPXKTLFQLMKQQQQQIIFEKPQKKIRKRSDFLGCRLNESIIQKWNQSG

SEQ ID NO: 206949 - protein, 210 aa, Triticum aestivum
  unsure (1)..(210): unsure at all Xaa locations
  Clone ID: PAT_TA_101367.pep
XSSXSXPGTAITTYXXVLYPGMRRARXXXLSPRRAPXXTXXARAPSDMHAHXWARRARDGPAQRAHPRSPTTXXHHGPAAPDTPGARPYTRLTHPTRAPRLCATHLHRCRAEPPRRARRAVVVVEAATTQVLRGLLNVPPQPPWPPRRAANLHRPTHGPEHRAAAAELRHRRHASGKKNDAQDEPTHDTKCCCQAWPSCSLSLSSLSLVP

SEQ ID NO: 206950 - protein, 120 aa, Triticum aestivum
  unsure (1)..(120): unsure at all Xaa locations
  Clone ID: PAT_TA_101368.pep
HEGSLDLLPSKNVAPPPPPPPPTISXPPPAPPPRWFATSSRPPXSSPPPIPPPSPSPSPRRSPSSHPXXPPXXSRTPTSTSTSAXXALPTRSSPRRXXSPLPPPLAPTSSSSDARSTPPL

SEQ ID NO: 206951 - protein, 161 aa, Triticum aestivum
  Clone ID: PAT_TA_101369.pep
MEMLGKWMLTAEGPAETIAQQLPSNSTVVPVEEPNADPTNHGVLCIVGLAGVGKTTIARSLYQNFSDQFDRRAMVTVSQKSDVEAVLRSILYQIMPQVREGTRQQRWWDTSHGSISTLKKARDQTLKLQKLELHLEKYSYLLVLDDVWSTDMLELKSLPKS

SEQ ID NO: 206952 - protein, 221 aa, Triticum aestivum
  unsure (1)..(221): unsure at all Xaa locations
  Clone ID: PAT_TA_101370.pep
SGPGPGSIEIVIRRGHIVEDGYRQLNCLRSKLKSCIHVSFVSECGLPEAGLDYGGLSKEFLTDLSKAAFSPEYGLFTQTSTSDSSIIPSSSAKLLDNGIDMIEFLGRVVGKALYEGILLDYCFSQVFVQKLLGRYSFLDELSTLDSELYRSLMQLKHYDGDVEELCLDFTLTEELGGKRIVHELRPSGKNISVTNENKLHYVHAMADYKLNRQXXPFXNAF

SEQ ID NO: 206953 - protein, 170 aa, Triticum aestivum
  Clone ID: PAT_TA_101371.pep
QEHAIVKRLFAAVPDRFLPIIGTIEQLGDVKKMSVAEAIGRLRAFEENESGRRQDRSDDGEKLMLVSRAELEALIQKEKKKGEGSSSSGKDGDGRGGGRDRDDDRKKVRGKFDKSKITCFKCGEKGHFKSECEAWKKEKALLVAADVYDEPALLMAMACELAPDGTVEPM

SEQ ID NO: 206954 - protein, 191 aa, Triticum aestivum
  unsure (1)..(191): unsure at all Xaa locations
  Clone ID: PAT_TA_101372.pep
MPXXLVLLLLLVLRAVTGDXXGDSADPCAGRXIHIRDLPPRFNTHLFRHCDXXFPLADPSSXATSTPTCESLANHGLGPRTHARSCXWYRTDARLLEPFXXRRLLXRRXLXXDPGLADAVFLPYYAALDSIPYVLDPSLLNCXAXXXASLAQFLARDRPQILARRHGHDXXXVLGGSAWDHSQPPRARLTS

SEQ ID NO: 206955 - protein, 125 aa, Triticum aestivum
  Clone ID: PAT_TA_101373.pep
RTGGAKGDFHNLTPKAKFDTNQITKEARTAARGAWPASRRRPPWMFYSDFVVNNMTRNKSTPSCMCYRSRSLWRIAVGKKLTIYPSWKKMLKICLEDAICRSFCLQVSLWHIVECHPVLPSCRIH

SEQ ID NO: 206956 - protein, 94 aa, Triticum aestivum
  unsure (1)..(94): unsure at all Xaa locations
  Clone ID: PAT_TA_101374.pep
FFFFWXXFKSLFXXXRXXSPSKTSKIFFQYPKQMPHPFFLXPLLKKDFPFPSPPRGKQPPNSXXGPFPLXXLLFPGFFPPGFKAFKGGIFSFKS

SEQ ID NO: 206957 - protein, 141 aa, Triticum aestivum
  unsure (1)..(141): unsure at all Xaa locations
  Clone ID: PAT_TA_101375.pep
NKGRAPNRRSISMEVSRKAKRAGGGFDDRLSDLPDCLLHDILSRLKARQVVQTCVLSXRRWQHLWPTSPCLDVDIREFRPDATLGPRRWPLSPAQLADYGKEPAELADFEDFVDSLLVHRIRSAGAAPLQTLRLRIPPWWL

SEQ ID NO: 206958 - protein, 61 aa, Triticum aestivum
  unsure (1)..(61): unsure at all Xaa locations
  Clone ID: PAT_TA_101376.pep
KHWLINNFLIFQVWTGCFXSIIPKSAFSLHQLLTHLNKHYVQLSLVGNFLSWXXXIXXIYX

SEQ ID NO: 206959 - protein, 68 aa, Triticum aestivum
  Clone ID: PAT_TA_101377.pep
SGGERQLQILFAIHCGRSRGGLLAVYKDAIKISEDIVQQWHDMCTEDVRETSSNRRAPCPIRSNYFAY

SEQ ID NO: 206960 - protein, 206 aa, Triticum aestivum
  unsure (1)..(206): unsure at all Xaa locations
  Clone ID: PAT_TA_101378.pep
ARGARSSRWRTALDRRRPRPPLPLVHAVTRPSPPRSPSSSAVSDRLPCRESSSSAAIRPPKHAGCVDSLPPRPPLPNFGSPGSLAESITEMEANQTPRSMPMVPTMRPRLPWRVHHRDGGALLAGLANQTLRSSVMAPTTREEVSGSMEAQPEAAPPSQRGKXKKTSADSSPAASQPGKSEALEPSXXERRKRTHKSDDEXXATTS

SEQ ID NO: 206961 - protein, 88 aa, Triticum aestivum
  unsure (1)..(88): unsure at all Xaa locations
  Clone ID: PAT_TA_101379.pep
QQHTSWXXNEXXTTASGAQIENRNLGCCSLTEHRENELREEGDRMVANAGGTRRREHGGGCLGFSGGGGGVSPQRSAAAASPLGGRRR

SEQ ID NO: 206962 - protein, 186 aa, Triticum aestivum
  unsure (1)..(186): unsure at all Xaa locations
  Clone ID: PAT_TA_101380.pep
SNSTPENGSPRLPSPPPQPPPRRRPPPHAXAPPPLRPPSRPRPPRPASAASTTPTAPSPSSRPSTPPPSPPALRAMRSPLPHAASPAPDGMLMPRRSSPPTSQLPQPSRISRPSSAHTPPPASLRRPSKPSAPPRRPSRPPSPRCPSTPSYRPSSGAAATAASRSSSXSSPXSSPSPPTPPPTPYW

SEQ ID NO: 206963 - protein, 95 aa, Triticum aestivum
  Clone ID: PAT_TA_101381.pep
YLTKRLLSSAMGGTAQSLFLVVKLPLFFVFSLKTPNSPKRILFIIIFFVCAKYCSLRSNISAVVLVLDSCFLLSKVCNMKQTPGVFMLLEYFRPR

SEQ ID NO: 206964 - protein, 100 aa, Triticum aestivum
  unsure (1)..(100): unsure at all Xaa locations
  Clone ID: PAT_TA_101382.pep
PGRSPAATSRSNRRQSRSHSRSRRRPSGCRRRRRPSGCRSRRGKSRRRRXARAAEYQRRIVRWRGRQQAAGRRRGAGGRAEPHREHPAQRIPRACAPSHV

SEQ ID NO: 206965 - protein, 113 aa, Triticum aestivum
  unsure (1)..(113): unsure at all Xaa locations
  Clone ID: PAT_TA_101383.pep
PPPXXLRXXIKGRXKEKKKKNSPRGVAPXXGQAPWGPSPGGGRNLEGPNQRVLSPLPFGIXLWVWFSEPLGPSRXPVKIFHQKAPPPGEALCVIKNLXXXXGFFYEKRKIEGP

SEQ ID NO: 206966 - protein, 77 aa, Triticum aestivum
  unsure (1)..(77): unsure at all Xaa locations
  Clone ID: PAT_TA_101384.pep
XPHVSFLYGDLXXQEKEPPRKKVKEMGSEIFGLQFEISEVALYQTEIEEKXLESWEMVEVSPLGKKGSVPPQKKVLL

SEQ ID NO: 206967 - protein, 94 aa, Triticum aestivum
  unsure (1)..(94): unsure at all Xaa locations
  Clone ID: PAT_TA_101385.pep
NTGGCLRNSRRILRKIETVDTAEQRKARRTAACVRPSERRLQHYTTTHTLCTIHRVAAPHALHTTSDGHKAGRSYLASXXXKXSASXXAIXXYD

SEQ ID NO: 206968 - protein, 176 aa, Triticum aestivum
  unsure (1)..(176): unsure at all Xaa locations
  Clone ID: PAT_TA_101386.pep
MEHNRETPAVSGKEEVDIEAVAGLRGDGSGVSSQDPAWKRFLRHIGPGFMVSLAYLDPGNLETDLQAGANHRYELLWVILIGLIFALIIQSLSANLGVVTGRHLAELCKSEYPVWVKICLWLLAEVAVIAADIPEVIGTAFAFNLLFNIPVWXXXLIAGSSTLLLLGXXRYGVRKL

SEQ ID NO: 206969 - protein, 189 aa, Triticum aestivum
  unsure (1)..(189): unsure at all Xaa locations
  Clone ID: PAT_TA_101387.pep
TRGALTTMDEQIKHATGPDQEDELATQIHSEYEAKVAAKRIFQNVAKPGSKHIYLSDLMRFMRQEEALKAMDLFEGAQEQNRVSKRSLKNWVVNAFRERKALALTLNDTKTAVNKLHHMANVVVALIVFALWLLILGFATTKTFVFLSSQLLVAAFIFGNTLKTIFXXIIFLFVMHXXDVGDRCXXDGM

SEQ ID NO: 206970 - protein, 188 aa, Triticum aestivum
  unsure (1)..(188): unsure at all Xaa locations
  Clone ID: PAT_TA_101388.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLXVANPANTNALILXXFAPSIPEKNISXLTRLDHNRALGQISERLGXXVSDVKNAIIWGX

SEQ ID NO: 206971 - protein, 99 aa, Triticum aestivum
  Clone ID: PAT_TA_101389.pep
TRKEAAVTPYSPRKGRTAVRPPTPSPRAVGVVRPVQCGTRVRGCAVLARSKNSLFLVPWPIQGAPRRRTGKQWERRRGWSFGSLILFFAVENRQGLIIL

SEQ ID NO: 206972 - protein, 160 aa, Triticum aestivum
  unsure (1)..(160): unsure at all Xaa locations
  Clone ID: PAT_TA_101390.pep
MAAVNLGAWLCALLAAVAGVLPAADALGMNWGTQATHPLSPRIVVQMLKDNGIKKVKLFDADQGTLNALAGSDIEVMVAIPNNLLDLMNDKDNARDWVRHNVSRYHFDGGVNIKYXXVGNEPFLASYNGTFDKVTFPALQNIQNALNDAGXXEXXXTVPX

SEQ ID NO: 206973 - protein, 109 aa, Triticum aestivum
  unsure (1)..(109): unsure at all Xaa locations
  Clone ID: PAT_TA_101391.pep
XXXATXXXXXRXLXXYICYNAEDDDGVRXNGXXGGRIFEKIXXLIGHCRSSCLNWLGLSLTVKTKEATSIVQTAQSEVKPPDLTNQTLEICRLIGHCRSFQKFCRLDDH

SEQ ID NO: 206974 - protein, 90 aa, Triticum aestivum
  unsure (1)..(90): unsure at all Xaa locations
  Clone ID: PAT_TA_101392.pep
RRGGLVLLPSPDPCQPSIWPGAPPPTPPPAPLPVGRSARXAASGAGACEVSPRPRTPSPHVEAPPPPPLGSDLALRGRAPPPTAAVRLLV

SEQ ID NO: 206975 - protein, 184 aa, Triticum aestivum
  unsure (1)..(184): unsure at all Xaa locations
  Clone ID: PAT_TA_101393.pep
MNETNRDGIAHPRKRPAEARRIQANSGSQLRKPLCSLLPASMPSPSLRLAVVGAGAAGLAAARELRREGHAPVVFERAAAVGGTWLYASPAPAAAADPLGAAATHSSLYASLRTNLPREVMGFLDFPFTAARGSVVDARRFPGHQEVLRYLEDFTQRFDLYGLVRFQXXXVXXXXEAGGRWAVT

SEQ ID NO: 206976 - protein, 136 aa, Triticum aestivum
  Clone ID: PAT_TA_101394.pep
DLRLGHYRQPTSKNVYGLDYFRLSPPYWLFLSPFPVRVPWSKQGGRRKMAAAPPPRADELRAWAHSTHPLPRPSIWTVGSRTSWCLTSGMGTRFPATRRTSGRSRRRGSAEGRGQVAVRRKEMRGHAWRRRGRPRA

SEQ ID NO: 206977 - protein, 84 aa, Triticum aestivum
  Clone ID: PAT_TA_101395.pep
PSCIGGLWIGHGVVPGSQFLNLPFIVMILEDHVCLYIGIKWQTISDVYKFSRWIVSCCCFEHLSVLKITFINFKLFVSVLNTSC

SEQ ID NO: 206978 - protein, 95 aa, Triticum aestivum
  unsure (1)..(95): unsure at all Xaa locations
  Clone ID: PAT_TA_101396.pep
EPLRGFFPHRKNGQFCYYSTYLGSAVGTYRFAQHDIVCQHQPFYYXXNSMETYTVPCSSLEVXSKNSHTSCLFCSSNINSSQNEPPFLSTDFXXM

SEQ ID NO: 206979 - protein, 70 aa, Triticum aestivum
  unsure (1)..(70): unsure at all Xaa locations
  Clone ID: PAT_TA_101397.pep
FISPLQFFEVGCEAQTGFSFPLKFLGREFFPISPIVXSLVPPSFFFPFVWDPLXXXXVLSFXXXFXXXXX

SEQ ID NO: 206980 - protein, 143 aa, Triticum aestivum
  unsure (1)..(143): unsure at all Xaa locations
  Clone ID: PAT_TA_101398.pep
GVFSSCVLMQVHGLGVRESLSCSFLGEFLRLFAIYPKVLKLWEPATGSTGGISKRRPASALLWVVXGGRSTPLGFDIRVRWQAKSSVQLGFFFFGSRFVTVFHSGFHGEQTYHLQLFVSEIHVLTSNFGRKVNPANKSMLWVY

SEQ ID NO: 206981 - protein, 162 aa, Triticum aestivum
  unsure (1)..(162): unsure at all Xaa locations
  Clone ID: PAT_TA_101399.pep
MSTTTAAAMSMKLLVDTKAGRVLFAEAGKDVVDFLFSLLALPVGTAVKLLGPDSMVGGAGDLYASVQKLDGSYVLPGANTDALLCPAVPSPAAVPSISLSLLGLPSPSPAFFRCGYCHSPGYVTEVRGAKCPRCGNHMADAIQCVRPDSGDSGQAAAXXARW

SEQ ID NO: 206982 - protein, 140 aa, Triticum aestivum
  unsure (1)..(140): unsure at all Xaa locations
  Clone ID: PAT_TA_101400.pep
MEMVLAAAANCTGALSSNHPKTFLKSRRSSLQMRACRSGPDAPLAVSSAAAPXPRPVRLGIMGCGSIARKVARSMLLVPAADVAAVASRSXXKARLFAADNGLRSGTRIHGSYXXLLDDXDVDAVYMPXXXSLXXXWXXX

SEQ ID NO: 206983 - protein, 150 aa, Triticum aestivum
  unsure (1)..(150): unsure at all Xaa locations
  Clone ID: PAT_TA_101401.pep
MQRRPGRPRGRHSLLPVAAGVLRCIVLAGAVAVVAAGAHADAVAAPAILDTVCGSRQAADPESFDVSFVNTLELIYQNVTRSGFGAASSGSGNFSVFGLGQCLAYLSPTDCQLCYAQSRVKLPHCLPADGGRIYVDGCXLRYGAGNFTAD

SEQ ID NO: 206984 - protein, 218 aa, Triticum aestivum
  unsure (1)..(218): unsure at all Xaa locations
  Clone ID: PAT_TA_101402.pep
HEAPSKYTNSLGRQVYDVSDSVNILSVKIASSDVGFPLKVYGTVIARDYLDFKCVYLFRRRREDYQLINSEDQSLILTXPTRGLVLLDSIYFEVDLKIKDDQGKRDQELSKGLCAIDGILMGGEEHGHVGCEDLDSRLSTVEVKFAVVKLAVEATLEIKVLKGDFYGEITACTSRIXXRLVLHDSKXXGVICDGTGMLQLXRRVVTVGMXXMLLLTIA

SEQ ID NO: 206985 - protein, 202 aa, Triticum aestivum
  unsure (1)..(202): unsure at all Xaa locations
  Clone ID: PAT_TA_101403.pep
MAWFTPHLVALFLLFSHLVIPSSSATTRLGADLLGAARAPPFESWLRSLRRRIHQHPELAFQEHRTSELVRAELDALGIPYVWPVAQTGVVATIIGGGGSGPVVALRADMDALPLQELVDWEYKSLEDGKMHACGHDAHVTMLLGAAKLLQSRKEDLKGTVKLVFQXAXXXYAGAYYILXXXVLDDVSAIFGLHVFXXXXXX

SEQ ID NO: 206986 - protein, 80 aa, Triticum aestivum
  Clone ID: PAT_TA_101404.pep
RLRDGRRLDLWPVTDHSRASPTLAGQRQQKGRAVAVDVTMGCTACIFFPGHDRSSKSNPKAQGIICPSQDISVVSRKRKI

SEQ ID NO: 206987 - protein, 63 aa, Triticum aestivum
  Clone ID: PAT_TA_101405.pep
LQVHDLVLHILTFFCQCCYVHCTFTVSTNVVLLLFPGGAAKFVGIVHTCAFSSSLLQHNNHRK

SEQ ID NO: 206988 - protein, 162 aa, Triticum aestivum
  unsure (1)..(162): unsure at all Xaa locations
  Clone ID: PAT_TA_101406.pep
XPIHAWLSLPDHNTLRGTNFFFLGQVASASESYYFASKRITYPPLHIVGAHNDGGKPAYSSPLSEPWEPSPKNSTCNVLMSTEKKPGFSCKDGVYCACMSAYPLATPNRKTSYFSSNGMTFSECHWLFLRTEYSSRYGPSWLCPSLITRSSPSIPCAASTTT

SEQ ID NO: 206989 - protein, 49 aa, Triticum aestivum
  unsure (1)..(49): unsure at all Xaa locations
  Clone ID: PAT_TA_101407.pep
VTRCTFXGWGENMCTYQFTRSXXXLLXXVATXXHRWVFVVXXXTSXTLR

SEQ ID NO: 206990 - protein, 159 aa, Triticum aestivum
  unsure (1)..(159): unsure at all Xaa locations
  Clone ID: PAT_TA_101408.pep
TRGICGGAVEAGGHARHAVALHAAAAAFAFVSLVXXSSNHHGDWMXFDRYQEYMYLLAIAALAFAYSLAQALRHAHRMRGGADPISAPSARLFDFIADQVLAYLLMSALSAAIPITNRMRTAVINNFTDATAAAISMAFLAFVALALSATVSGYKXSYM

SEQ ID NO: 206991 - protein, 153 aa, Triticum aestivum
  unsure (1)..(153): unsure at all Xaa locations
  Clone ID: PAT_TA_101409.pep
MAPKADKKPAAENKVEKAAEKTPAXXKPKAEKRLPAGKTASKEAGGEAKTRGRKKGSKAKKGVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 206992 - protein, 75 aa, Triticum aestivum
  unsure (1)..(75): unsure at all Xaa locations
  Clone ID: PAT_TA_101410.pep
CRWXXAERGLRSWPMSLSMVRLRIFILFLQRNIARYVLALQHFICMRNANSNFHHQSTHSFPILLKTSXYLHVXX

SEQ ID NO: 206993 - protein, 92 aa, Triticum aestivum
  Clone ID: PAT_TA_101411.pep
RLGFLRTFRRAECSALILYSPLEIDVARQCSIRCSNNPDLGLGLLQKGQPYFSVLQLWYIPGPWVLIFNTTFSSNDSTFPSITSSPDSYRTH

SEQ ID NO: 206994 - protein, 115 aa, Triticum aestivum
  Clone ID: PAT_TA_101412.pep
TRMCTTTRCDAKFDDDHVPLPLLEHEHLLPLRIVNLYFHYDPRVPLLPLRTRTAAKLHASKGITIETTARGPNACVLNEMGPVFAPCPSCHFLGPPRLPVTHGTPRVQDHPTILA

SEQ ID NO: 206995 - protein, 72 aa, Triticum aestivum
  unsure (1)..(72): unsure at all Xaa locations
  Clone ID: PAT_TA_101413.pep
GKSISVDWVFFTGKGYFSKFVXELKLLEKXLISNKRIQFFIGGAPPPNLXITPQVKXNYLHLGWLKFQQKIP

SEQ ID NO: 206996 - protein, 176 aa, Triticum aestivum
  unsure (1)..(176): unsure at all Xaa locations
  Clone ID: PAT_TA_101414.pep
MSGLYGQQGFSPSRNLSPQIRSNPDVDSQYLAELLAEHQKLGPFMQVLPICSKLLSQEIMRVSNSAHNPGFSDFDRHRFRSPSPMSSPNPRSNLSGNGFSPWNGLHQERLGFPQGNSMDWQGAPPSPSSHVMKXXYAWRXXVDSYPSFNFVGRILGPRGNSLKRVEASTGCRVFIR

SEQ ID NO: 206997 - protein, 58 aa, Triticum aestivum
  unsure (1)..(58): unsure at all Xaa locations
  Clone ID: PAT_TA_101415.pep
MEYSQHSTCLLSSLYDHSPANLLQAYSCTIRCLVCSSLARRRLCNVMSHSASSXXWTM

SEQ ID NO: 206998 - protein, 137 aa, Triticum aestivum; identical to SEQ ID NO: 181666
  Clone ID: PAT_TA_101416.pep

SEQ ID NO: 206999 - protein, 168 aa, Triticum aestivum
  unsure (1)..(168): unsure at all Xaa locations
  Clone ID: PAT_TA_101417.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYXXGAADPTFLYFAHGLKEXKC

SEQ ID NO: 207000 - protein, 135 aa, Triticum aestivum
  Clone ID: PAT_TA_101418.pep
SATNINNPSSSLIIYSLGAHSQVYAARSLNKGIKRKNSTNNRPAMEPSCSCSDLALAQLRRGSRSIRRRLRRARGSWARPRTGSGGSWRCRCRPCCPRPARPRSRCRPGRSASPAAAAGTRPPRTPRTKRSTRPL

SEQ ID NO: 207001 - protein, 100 aa, Triticum aestivum; identical to SEQ ID NO: 170998
  Clone ID: PAT_TA_101419.pep

SEQ ID NO: 207002 - protein, 63 aa, Triticum aestivum
  unsure (1)..(63): unsure at all Xaa locations
  Clone ID: PAT_TA_101420.pep
KVLYLGMEGVIGTYMVTITNHQLLGAIIQTSXXKSDLNSYVTRPKSETLCKKLLFLTIYFYSV

SEQ ID NO: 207003 - protein, 77 aa, Triticum aestivum
  Clone ID: PAT_TA_101421.pep
TRGLWRDTNYGEGVIIGVVDTGIYAAHPSFGDSGIPPPPSKWKGSCHGTAAAHCNKMIKLQDCCATWERQSHQWGGF

SEQ ID NO: 207004 - protein, 113 aa, Triticum aestivum
  Clone ID: PAT_TA_101422.pep
GQIPAPARGAVSMRTPPPLHGAASPDPWITAATATQSARKGPRRHLPRSHPNFAGGRLGRRRGEKGAAGEEDAGRWQWRGDPALGGGGGSGARSRLACVSRESPQLQFVLSSC

SEQ ID NO: 207005 - protein, 99 aa, Triticum aestivum
  unsure (1)..(99): unsure at all Xaa locations
  Clone ID: PAT_TA_101423.pep
MRVYHDKLSGDELLSDSFPYRELENGVLWEVDGHWVLQGXXGVDIGANPXAQGGGDDEGVDDHAVKXVDIVDTFRPQEQXXFDKKQFXSHMKRYIKNLT

SEQ ID NO: 207006 - protein, 141 aa, Triticum aestivum
  unsure (1)..(141): unsure at all Xaa locations
  Clone ID: PAT_TA_101424.pep
HEVSPLLPFLSPTCNRAATATDLPVPVPTVIVFVWEDVQKTRIRRLRPSRAPNQAGMARTLAIAVVFSAYIAGDRHRLPLFRSTSTLPEHATGLAIPRLLATHSSTTVLMTPLSCQSXXEPDDTTDDYCYPRVLLLXXXXR

SEQ ID NO: 207007 - protein, 103 aa, Triticum aestivum; identical to SEQ ID NO: 107316
  Clone ID: PAT_TA_101425.pep

SEQ ID NO: 207008 - protein, 43 aa, Triticum aestivum
  Clone ID: PAT_TA_101426.pep
FFFLGKHHDQLTISSSSQCPSSFNNSGPWAIAITVYYKFQIQP

SEQ ID NO: 207009 - protein, 204 aa, Triticum aestivum
  unsure (1)..(204): unsure at all Xaa locations
  Clone ID: PAT_TA_101427.pep
TRILDVRWLFGAVGSTXXHMFLQARPRCWLHHNVLCSGSGIWCRLRRVIVSLRRGRLALLMAPSSYRMWPGTIGQYSLLHECTRTCDMTTLCGRAAKKIGLEEGWNEHRHSESEGLKPSEDVKRLVFERVRKILKSTYEVDKDEEAAYSMNDVTTFWGQAAAKRRRRKLRXXRLAFGHEFXEDILVWHIATQVFLSDDGYATKH

SEQ ID NO: 207010 - protein, 95 aa, Triticum aestivum
  Clone ID: PAT_TA_101428.pep
TRQDFQESAKELSALRGQLKIVTDERDLSWQEAKQLRKTTSMMQNEVASLKKKIESLEEDILVKEGQISILQDNVYKPPLDFICSPRTMKQFGME

SEQ ID NO: 207011 - protein, 152 aa, Triticum aestivum
  unsure (1)..(152): unsure at all Xaa locations
  Clone ID: PAT_TA_101429.pep
TRLPLWSSPPPPPXXXGNLHLELPPLDDRMRCAAAARSLLPLPPAAAPXTPTPHPLPWPPSSPPPTPSTRCSPRSRPLCPPSSPASPSSRPASPRTPSPMRSCGPTSLPHPASASSSSPPSPRVSAPRCSTPAPSPCSFPATPMPQCSTPSP

SEQ ID NO: 207012 - protein, 176 aa, Triticum aestivum
  unsure (1)..(176): unsure at all Xaa locations
  Clone ID: PAT_TA_101430.pep
XXXXXXELVASSSQLAQPFDSPPNIHPKISPIQSHXFPRRRAELLASLLPEGRAMYDVLRDQLARDVDRSFAESKTRLENAVETVFGDLHTKLDRTIDDLRWKVRSDDRRRCATVAVASVSSATSSTSSLHRTASTTNWDVPRCGTNGKSGVTNSRSLLSPQVMASPHSIYSIGFS

SEQ ID NO: 207013 - protein, 195 aa, Triticum aestivum
  unsure (1)..(195): unsure at all Xaa locations
  Clone ID: PAT_TA_101431.pep
HEASTSTMATTFRNIFLKAAEAFCCLIGTVSGMFLLVLALTLFASTSSTHPSPSSAPTASSTSYHGTCDEDELHRLMATHVGYVVCAMAIAMLLMVFVRKVADGAAKDHERVAASEDAAYKAAYDAAEVAKEAIGRAEKEVKELNDPRRVNLALGVLEGDQALADARKKLDACVQEYXRATDKXERLKPXXXXAR

SEQ ID NO: 207014 - protein, 83 aa, Triticum aestivum
  Clone ID: PAT_TA_101432.pep
CIIWKNALRSVGSSELKLIVHLHLMVTGFGGGGAAAPMMVDSSDSPSCIHGDEARPRLEPPPVSSSSPLIPLLLACWFYALPL

SEQ ID NO: 207015 - protein, 92 aa, Triticum aestivum
  unsure (1)..(92): unsure at all Xaa locations
  Clone ID: PAT_TA_101433.pep
HEATTFSAATLHLPAPPRRPPPRALPQPAATASPPSFPFPGDLPPSALPSASDPVRSDDSCPPWPDPAPPRPDQAGPLTARATAXPPSAAPD

SEQ ID NO: 207016 - protein, 83 aa, Triticum aestivum
  unsure (1)..(83): unsure at all Xaa locations
  Clone ID: PAT_TA_101434.pep
MLDKLWXXVEAGPXPETGLDKLGRAAATQPLTINTAAGEAIKXSPSMPXXPTTPVTPSSSTPPHGGSVWRGVFHPGSNLSATS

SEQ ID NO: 207017 - protein, 182 aa, Triticum aestivum
  unsure (1)..(182): unsure at all Xaa locations
  Clone ID: PAT_TA_101435.pep
ARGHACLISRSRRRSLQEQWQPRVFSLGGSCWGGLCSPPSPGRLPXKSPFVVRASSSPPAKQNDNRQLWFASKQSLTYLDGTLPGDFGFDPLGLSDPEGTGGFIEPRWLAYGEIFNGRTAMMGVVGMIAPEALGKVGLVPPETAIPWFQAGAIPPAGTYQYWADPYTLFVFEXALIGFAEHR

SEQ ID NO: 207018 - protein, 64 aa, Triticum aestivum
  Clone ID: PAT_TA_101436.pep
PPPTPDSPSAPPQPFHPTTPPPPRNSHPHRSPARPAPTGLARSGGDLPRPRFPPPTVVTNPNSP

SEQ ID NO: 207019 - protein, 139 aa, Triticum aestivum
  unsure (1)..(139): unsure at all Xaa locations
  Clone ID: PAT_TA_101437.pep
MAAPMASPLTAVARAARLHPVSCSASSSSPKNPKQSSSSSSSSPPAVPSLRSAAVALAGAVPLLAALPPPDALAVGGELGIIEGRTVALLHPAIMGGLFAYTLWAGYLGWQWRRVRTVQDEITELKKXXRPAAAAXXPR

SEQ ID NO: 207020 - protein, 137 aa, Triticum aestivum
  unsure (1)..(137): unsure at all Xaa locations
  Clone ID: PAT_TA_101438.pep
SSMDFDLLLSSSPEAQLALMNTMLQLEQALNDQSLMMAEASPPISPVQTPSHSLSPPPHVSTACAAADAGYFYHQDLHAQAAPAGYAGTGGVHQEYVVSPGAAVFDGAGGAPQGYSSPSSPDAMREMIFHIAXLQXG

SEQ ID NO: 207021 - protein, 146 aa, Triticum aestivum
  Clone ID: PAT_TA_101439.pep
HEGQSPPPLPHSIFSLHISTSYQLKHTSTKAGSLHGRGGVIVALLPALAAPQAEDDRLRLLWVTIVAGQQRGEAAHRRWQGQVEATRGGRGGVQVRPAQLRAQLRRRRQCRRHGSRGCGLPAQKLQLAPPSLTRAGLPSRRHRLKS

SEQ ID NO: 207022 - protein, 149 aa, Triticum aestivum
  unsure (1)..(149): unsure at all Xaa locations
  Clone ID: PAT_TA_101440.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALGXXGLVPPETAIPWFQAGAIPPAGTYQYWADPYT

SEQ ID NO: 207023 - protein, 78 aa, Triticum aestivum
  unsure (1)..(78): unsure at all Xaa locations
  Clone ID: PAT_TA_101441.pep
GPLGWQAAVFDDLIPPRYVWHMPEFGGLQKELKIFFGQAPAFVGICIQGGAKVPGKYKAPLGVXXXXPSSLKGGEMVV

SEQ ID NO: 207024 - protein, 104 aa, Triticum aestivum
  Clone ID: PAT_TA_101442.pep
MERVTRLSTEKAVVIFTPSNDCPMSYTVTTLFSGLGVCAAVHELDKDPRGRDMERDLARRLGRTPAVPAVFIGGKLVGSTDRVMSLHLGGKLVPMLKAAGAIWL

SEQ ID NO: 207025 - protein, 112 aa, Triticum aestivum
  unsure (1)..(112): unsure at all Xaa locations
  Clone ID: PAT_TA_101443.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVX

SEQ ID NO: 207026 - protein, 65 aa, Triticum aestivum
  unsure (1)..(65): unsure at all Xaa locations
  Clone ID: PAT_TA_101444.pep
DXXNLQLQLINQGGNATNYLQQGEKERGRGSGWGGGRERLATHRESMLVCEHGHTHILRNKQASC

SEQ ID NO: 207027 - protein, 37 aa, Triticum aestivum
  Clone ID: PAT_TA_101445.pep
YNNKELKKGIVSLLDPDPLQVGPALRPSYPLGTCPGG

SEQ ID NO: 207028 - protein, 173 aa, Triticum aestivum
  unsure (1)..(173): unsure at all Xaa locations
  Clone ID: PAT_TA_101446.pep
MSGDRLFRLRFPKPEWMNSANTRNAGVYLSGALFSIALFVLIDSSVYSNSRLNGADLHINFVDWIPGIFSFLGMIVINSIDKTRLTGDTFAYSGDGVAWKARVILFLGFAAMAGGXXGGISVLVLKYITAGAEGMTLWFGVSNLIANALVMFSSVVLWVSQNMEDDYTYNLAL

SEQ ID NO: 207029 - protein, 117 aa, Triticum aestivum
  Clone ID: PAT_TA_101447.pep
AAARAGAIKSMENHILAHIRQFCANLAGNVESSTHPQYSDSVAPHTSKAFGPTVDITDQSNYLAFDIMGDLCFGKSFNMLTHPDNRFPIDLIASASHRHLICGTYLPIHTYLGRDHA

SEQ ID NO: 207030 - protein, 113 aa, Triticum aestivum
  Clone ID: PAT_TA_101448.pep
PKKSWSCSRVDSITCLLQRFHSSNVSYICFHSTWIWETIPVSTTTTSTKPANRHVFDSSDSILSSAEAATTLLVVSPAISSVVLSASSAMEGRAVFFLHQINGLFGTSAATTL

SEQ ID NO: 207031 - protein, 72 aa, Triticum aestivum
  Clone ID: PAT_TA_101449.pep
SSSTPIKIGNSSTTTGETLSFTTPAVELASWCHARLETKRTRIKPRRISCTSRNLVDILPLVSLAHAELTTS

SEQ ID NO: 207032 - protein, 116 aa, Triticum aestivum
  Clone ID: PAT_TA_101450.pep
RAAARAGTTREISMMLSGFWIFSPLDIVYTFAFANPRLLPPAILYLQYPTSTWPYSVFSHPGSHALCVSPLSSRSARPAALPPLPRPRAPRVEHSRLFGDPIHGPETRCTSAATTL

SEQ ID NO: 207033 - protein, 64 aa, Triticum aestivum
  unsure (1)..(64): unsure at all Xaa locations
  Clone ID: PAT_TA_101451.pep
CGRGRGTLMRPWSTFKKLVSILMARSSQQTMMRTYQPHLMMSRSSTTKDCSXDFCVVPARAAAR

SEQ ID NO: 207034 - protein, 108 aa, Triticum aestivum
  Clone ID: PAT_TA_101452.pep
ERPPGQVRVERYATAYLRASWTGALFQLSDQAMNTNSVKKSMKKFNSALREISRVQTTWKVPNPQLRQHLRLVILQHVFPAYRAHLRRQWPGFHMEKHVKYLGRDHAN

SEQ ID NO: 207035 - protein, 85 aa, Triticum aestivum
  Clone ID: PAT_TA_101453.pep
AWSRPRYTARTPSLFFVLHTNVRHIDGVMLTSWCGRNACAALTIAAVGMACRLVRMGFEDILARRNRIVVRRQPAAAERTCPGGR

SEQ ID NO: 207036 - protein, 51 aa, Triticum aestivum
  Clone ID: PAT_TA_101454.pep
SSGRPGRYTTRWVALQTLSFLCFLVSLAAAVASIEGVTESLKNYVPFKTKS

SEQ ID NO: 207037 - protein, 76 aa, Triticum aestivum
  unsure (1)..(76): unsure at all Xaa locations
  Clone ID: PAT_TA_101455.pep
SSGRPGRYPGHGGGGGGNTALKEPCAKPALDLDAKRAWGHSQIVEIETKKHDLFYQLAELDSRFPSSNKYLGRDHX

SEQ ID NO: 207038 - protein, 202 aa, Triticum aestivum
  unsure (1)..(202): unsure at all Xaa locations
  Clone ID: PAT_TA_101456.pep
KCEMFLKIAIGIARGLEYLHQGCNARXIIHFDIKPNNXXLDDEFCPKIADFGLAKLCHLKDSVLSMAEARGTVGFIAPEVFSRGFGVVSTKSDVYSYGMMLLEMVEGKKDQKGKADSSSEAFFPHWVWDNLARELHGSEEKYGTEEIVRRMTLVGLWCIQMNPESRPSMSRVIEMLERKMGELEMPPRPFLCSPVYLGRDHA

SEQ ID NO: 207039 - protein, 103 aa, Triticum aestivum
  Clone ID: PAT_TA_101457.pep
RGRGRGVRRALKTFIPDSPEYERLLPHVKDNVGFVFTNSDLKETRDKILSNRVAAPARAGAVAPDDVFIPAGNTGMEPGKTSFFQALGVPTKIARGTCPGGRS

SEQ ID NO: 207040 - protein, 106 aa, Triticum aestivum
  Clone ID: PAT_TA_101458.pep
SVVAAEVHSSFNILQISSRLLMVFGPLVALQLFSSWRQRNGNRMWDSLLTVIPGYLPEWLRVSVDPQAINHLTRQLNLERTNRMLLDIEAAHGYRMRRVPARAAAR

SEQ ID NO: 207041 - protein, 77 aa, Triticum aestivum
  Clone ID: PAT_TA_101459.pep
SVVAAEVHNQLPSYSLECSLPVRLMAHHHFCLTSLLIQSHFHHPPPSIPRSLTSPWRGQQRCCPGRRRSSTCPGGRS

SEQ ID NO: 207042 - protein, 133 aa, Triticum aestivum
  Clone ID: PAT_TA_101460.pep
GLPGRYQDSEDLLGAWFKQNPGKREKIFLATKFANCSDAEGNRWVDSTPEYCRKACEKSLKRLGVESIDLYYAHRLDGKTPVELTVRELKKLKEEGKIKYIGLSECDSDSLRRACKVEHIDAVQIEYLGRDHA

SEQ ID NO: 207043 - protein, 165 aa, Triticum aestivum
  unsure (1)..(165): unsure at all Xaa locations
  Clone ID: PAT_TA_101461.pep
LTKLPDPQSPIPYQKEKNESPVHPLQLKKNKLSSLVRDDSDHHHRLHHSAGYSIGEVMAALTMIESPSHMAIISDKPPAYADSPDAPLEKEPLMPSEAEADVEVMLVHSKPITSKISTTMAHLYKIDGFRGKFRGARVSVMYHLXXAWFPTSSSPSSTRDLLATP

SEQ ID NO: 207044 - protein, 66 aa, Triticum aestivum
  unsure (1)..(66): unsure at all Xaa locations
  Clone ID: PAT_TA_101462.pep
XXGHFRARARGGACRRLTGGNREHDDXEGESXLIDLSLGHKHMPPPTPCSFIPXXXRGAAXXGVIR

SEQ ID NO: 207045 - protein, 58 aa, Triticum aestivum
  Clone ID: PAT_TA_101463.pep
MPFTGSDIIKIIFAIFIPPIGVFLERGCGADLLINILLTILGYIPGIIHALYLGRDHA

SEQ ID NO: 207046 - protein, 78 aa, Triticum aestivum
  Clone ID: PAT_TA_101464.pep
RGRGRGTMNTEPLEHIVEVKSDLYSYSRSPIPASPMPPDLSRQQRLNVPRHMNTGLSAKSSLDSLQTPAILREMGMGV

SEQ ID NO: 207047 - protein, 114 aa, Triticum aestivum
  unsure (1)..(114): unsure at all Xaa locations
  Clone ID: PAT_TA_101465.pep
FERPPGQVRGISGGEKKRLSLACELIASPSVIFADEPTTGLDAFQAEKVMETLRQLAEDGHTVICSIHQPRGSVYSKFDDIVLLSEGEXXYMGPAKEEPLKYFASLGYLGRDHA

SEQ ID NO: 207048 - protein, 51 aa, Triticum aestivum
  Clone ID: PAT_TA_101466.pep
AWSRPRSDIHLHTRAVLEQTPLHAPLHNRHHHNVLHTSRHQDAVPARAAAR

SEQ ID NO: 207049 - protein, 58 aa, Triticum aestivum
  Clone ID: PAT_TA_101467.pep
PSPAPPGSKPSASSTVSPPSPSSPLPRHAPPEKKKRLFPSQLQEHPNNAPPPPRPRPR

SEQ ID NO: 207050 - protein, 201 aa, Triticum aestivum
  unsure (1)..(201): unsure at all Xaa locations
  Clone ID: PAT_TA_101468.pep
RAAARAGTRPNGEWVAGAATQRESKRAKISPGVLASLVFSLQKRSTALHSISIDSAGISNFFLASNSKPRIAKSIKLRGPLTSLTPGTLKDLRNLRKLHLIETGLSSQILVEALQSLECLEYLKLGEEDRSGAWNGDFSVQSGGFSALRDLCFEGAKQYPRLKIAQGAMHVLTSLQLLCXXSPPLMGVDGXXHLTCLDEVI

SEQ ID NO: 207051 - protein, 67 aa, Triticum aestivum
  Clone ID: PAT_TA_101469.pep
RAAARAGTRRYAMRIRGVFDLAAKMTLGFMLVAYAVSPKLPREEDTTNNCPQCGLRTSTTREGTTNN

SEQ ID NO: 207052 - protein, 104 aa, Triticum aestivum
  unsure (1)..(104): unsure at all Xaa locations
  Clone ID: PAT_TA_101470.pep
RGRGRGTRRKRIRNTRPSQTPXXPAEAQSSASGGPKRPTATQPDLITRYNLQSRVNGKGKEPVPSEEQKRNAWSSDKNARAEALKKRREEMVLAARRKMQEKEA

SEQ ID NO: 207053 - protein, 203 aa, Triticum aestivum
  unsure (1)..(203): unsure at all Xaa locations
  Clone ID: PAT_TA_101471.pep
IFFGYVTKDMFIGLGSXXXQDNSLFIHPSHEIMLDTEFAVPTFFKILPLIFTISLSIISIIISEFTPKALINFKLSRFGYNIFSFFNQRFLIEMFYNRYVTDLVLKLGGQTTKVLDKGSIELVGPFGLEKALLNLSTNISKLDTGVITSYALYILVGLTFYIVLPLFYELDNNLLLVILFALITIKKKIVLVSARLVPRPRPR

SEQ ID NO: 207054 - protein, 172 aa, Triticum aestivum
  unsure (1)..(172): unsure at all Xaa locations
  Clone ID: PAT_TA_101472.pep
PNQDNLAKWRDAVDCRGISAEEFIPENSTFAPLNIPRRDNELFVQRKNNMIKDVEEKFVYPSETKQLTRDWVLMTVCKRWRAYKSRLKKKYFKRKERSLQEIXXXCSNXVLISINGRXLVGMWCQDSHMKLCEXTXXCVKQQKNPHTTGRKSHVRLQKEMEIKRKAPVKIDL

SEQ ID NO: 207055 - protein, 101 aa, Triticum aestivum
  Clone ID: PAT_TA_101473.pep
TPFPHLQSPQKQSARIFVLLGSVYDEKKIFSRGYVSNFSYSTAVIFPSMQYVLESSIHSCSSSLPSLVPVQRSLYFLLNEQPSVKRALPPVGWQPARAAAR

SEQ ID NO: 207056 - protein, 147 aa, Triticum aestivum
  unsure (1)..(147): unsure at all Xaa locations
  Clone ID: PAT_TA_101474.pep
SWVLSPDPLWGITEWIEVVDISGWRLHDTSCEALLTRSFALGSWLWVVVEGESLLLFFRMCRLXGGRKCSVKLRGRRHPTKSSYLTLQNLHPWTESRLRXXGFTACCXWCLLTLQVPSFPARKTLRLXXXGARQSYVPLNSGXXKII

SEQ ID NO: 207057 - protein, 129 aa, Triticum aestivum
  Clone ID: PAT_TA_101475.pep
WSRPRYTKEEAEGKRLKNPFDTITEGIGINRVTANFMMAELDGAYRGTDREAVEMSRFLLRRDGLFVGSSSAMNCVGAVRVARDLGPGHTIVTILCDSGMRHLSKFFNDEYLANHGLTPTATGLEFLDQ

SEQ ID NO: 207058 - protein, 59 aa, Triticum aestivum
  Clone ID: PAT_TA_101476.pep
SSGRPGRYKKRFRKAMSAYFLVVPDQWSPAAIIPSKQVADSGQDSDQFVSTGSSSLLDR

SEQ ID NO: 207059 - protein, 68 aa, Triticum aestivum
  Clone ID: PAT_TA_101477.pep
MANGWSLIISIIVVVAIAMAAWFFSPKGENQTVWRSSIILSVASCWLMWAITFLAQWHPLIVPRPRPR

SEQ ID NO: 207060 - protein, 114 aa, Triticum aestivum
  Clone ID: PAT_TA_101478.pep
CQGRNDLFSRISRLPINLLHPNRHALSRLRRSNKNLIHLLSLNILLSFPKARILRKVTPISSHLRQSLFIQRRREFHHSRHQRQHNLHLHDGKILSDTILRTQFKGPVPRPRPR

SEQ ID NO: 207061 - protein, 101 aa, Triticum aestivum
  Clone ID: PAT_TA_101479.pep
MQAIAAVLLLCALASAFIVFFKGQPSAVVAALAKSGFTAAFTLIFVSEIGDKTFFIAALLAMQYQKALVLLGSMAALSLMTIVSVVIGRIFQSVPARAAAR

SEQ ID NO: 207062 - protein, 97 aa, Triticum aestivum
  unsure (1)..(97): unsure at all Xaa locations
  Clone ID: PAT_TA_101480.pep
SVVAAEVRLYPLGQQDXGIQQRIVEFKTSKGSESQESKGSQDEGVADMDEEPAEKSASWRPEDAVDYTPPNLINGIITESGVLLPSAVSEALIQVWF

SEQ ID NO: 207063 - protein, 108 aa, Triticum aestivum
  Clone ID: PAT_TA_101481.pep
MTYLPCPCPFPFVIFLPFRPASINYTASSSRVFSKTHPPTLPASSSRPSPTPLPPPSLSPHQCSSPPLQNSHSTPPDSSSSQTASDPSHPMPCGTVSPSPIPARAAAR

SEQ ID NO: 207064 - protein, 169 aa, Triticum aestivum
  Clone ID: PAT_TA_101482.pep
RGRGRGRIQNIRYARGVCFPIGLGNLTNLQTLQALEVQEVDGSIRQLRELRQLRSLRIWVVKGTFCEHLCESLVLMQFLSNLNVSASDENEVLLLNALPPSLQKLSLGGRLPEGALLAESPLFQAMEQNLCSLRLSWSQLREDPLPSLSRLPNLMDLCLDKVYLPGRPL

SEQ ID NO: 207065 - protein, 89 aa, Triticum aestivum
  Clone ID: PAT_TA_101483.pep
SSGRPGRYYLNLIKQIFFYKNDHVINPSINNMDLTAYISSKRGSSNGNSGPSYNGANSSNVEKIKFTSSNIVINSSFSSIIAVPRPRPR

SEQ ID NO: 207066 - protein, 75 aa, Triticum aestivum
  Clone ID: PAT_TA_101484.pep
SARPGRYAHVRTMRIVDGPDEVHLLQLGRNETKRGKDCLAKIEAQKAKAAEMSRAYGMETRAIFQLDRQASKAKL

SEQ ID NO: 207067 - protein, 96 aa, Triticum aestivum
  Clone ID: PAT_TA_101485.pep
HGDGGGGVLCGLKGRAWVGLFCGDVRMGEDGWYDAADSVGWRLFCGIPAIVDLCDSDGHCHIEACGVDSALQRRSDHSTTFVDCDNFPVPARAAAR

SEQ ID NO: 207068 - protein, 211 aa, Triticum aestivum
  unsure (1)..(211): unsure at all Xaa locations
  Clone ID: PAT_TA_101486.pep
XXIMLMDVNAKHGPANVICAVGMCGVGKTXLATKVYQSDIAKKFSSCAWITVSQSFXQIELLKDMIKKLFSDEALMKQLEGKVMREEDLAHYLRIELLEKRYFVVLDDLWNIDDWIWIKSIVFPLSNNKGSRIIVTTQDVDLAEKCNLESSRSLIYHHQSLGTIDAMRLLLRKMRRSEEDMKNDKDMREIVIKIVKKSGRLPLVVPRPRPR

SEQ ID NO: 207069 - protein, 129 aa, Triticum aestivum
  unsure (1)..(129): unsure at all Xaa locations
  Clone ID: PAT_TA_101487.pep
FKXXXHLXAMDRAHRIXQKKVVNVYRLVTRGTXXEKILNLQRFKIDVASTVVNQQNAGLGTMETDQILDLFNLGETDPNLAVGESVEPNGVDESNAVDAEGNMREKGKKGILDELSELWDDKQYLGRDH

SEQ ID NO: 207070 - protein, 47 aa, Triticum aestivum
  Clone ID: PAT_TA_101488.pep
MGDIPTEQWAQVVEKTGGPVVYKKIPVQKPGPDEVLVNIKYLPGRPL

SEQ ID NO: 207071 - protein, 95 aa, Triticum aestivum
  Clone ID: PAT_TA_101489.pep
SVLVERQAQRAHSVSNGVDLEDWIGFLWLDLKAALDRWMGLIRESLATLWVSIVCMYIHRRRSIWENYIFAAKSPRCYLELEVFLFGAYDVRILT

SEQ ID NO: 207072 - protein, 73 aa, Triticum aestivum
  unsure (1)..(73): unsure at all Xaa locations
  Clone ID: PAT_TA_101490.pep
XXIHXXXXGMXXRFSAHDHDMLLFEHLLLLCQQEASTGRIRNRRRRRRLPLHLLNDSLCQAECFMNQCVYSLV

SEQ ID NO: 207073 - protein, 112 aa, Triticum aestivum
  Clone ID: PAT_TA_101491.pep
PCCWPSAKRPHPKKEDSRPFSFFNHESHPPQFTSHSKRLPDLSVIRPIRLASINHIPPIPLALFDNSLFPHPLHHSQPSTRRPGSLLRTTLADTHHTLLRLLFGIVPRPRPR

SEQ ID NO: 207074 - protein, 101 aa, Triticum aestivum
  Clone ID: PAT_TA_101492.pep
SVVAAEVLASLLLLSEDVAGARELTDAKESKKKNVKPAGGSGLPKEEKWGGGNKHDGGYRDGEGYGNGGGYGAGGYGNGGGYAGVDGRLAGEMQTCPGGRR

SEQ ID NO: 207075 - protein, 67 aa, Triticum aestivum
  unsure (1)..(67): unsure at all Xaa locations
  Clone ID: PAT_TA_101493.pep
MAPVIFGSAINEISLTSIMVQLMQLPASVLLKQXXLSLTTLSHNFIRDYSSSKSIMXXXSHLGRXXA

SEQ ID NO: 207076 - protein, 136 aa, Triticum aestivum
  unsure (1)..(136): unsure at all Xaa locations
  Clone ID: PAT_TA_101494.pep
CSWGTIHPSIVLHNHTHIHTHKISTSTCQSCKRGSAELYLGTNRAAQNQKPANVAKDDTCTPAPKSVKSTEKLVTGRPTAPHREHKQIAVLCTSKIRRKKIFFLNCNRTSTPALTNEFGTCKSWARASVPARAXAR

SEQ ID NO: 207077 - protein, 73 aa, Triticum aestivum
  Clone ID: PAT_TA_101495.pep
SIVLIPSIQVWPIEGIKKFETLSYLPPLSTEALLKQVDYLIRSKWVPCLEFSKVGFVFREHNSSPGYLGRDHA

SEQ ID NO: 207078 - protein, 140 aa, Triticum aestivum
  Clone ID: PAT_TA_101496.pep
SVVAAEVQDHVDDAVSHGGKVLAGGEKIPELGENFFAPTVIRDMTSKMKIASEETFGPVAALFPFDTEAEVVKLANEAEVGLAGYFFSKDIQRCYRVAEALEFGMVGINTGLISAPESPFGGVKHSGFGREGSKYLPGRP

SEQ ID NO: 207079 - protein, 81 aa, Triticum aestivum
  Clone ID: PAT_TA_101497.pep
IPHMQLLNGKNHEGRNGSSLMIFTNMVISSTSLTFCKGYCSTYILQHVASIYCNCILFYIYTAMALSSTSSTSLYLPGRPL

SEQ ID NO: 207080 - protein, 108 aa, Triticum aestivum
  unsure (1)..(108): unsure at all Xaa locations
  Clone ID: PAT_TA_101498.pep
SEDSRDSDERSXVGRVVSDDGSVDDQGEDGLLVGCGVVLXXSGGVFVSQRRIMRMLTXXXLLLVCXXDCTXRKDGGEGHNGGLHGCQGTGASXXFYPLSCXXXXVILV

SEQ ID NO: 207081 - protein, 107 aa, Triticum aestivum
  unsure (1)..(107): unsure at all Xaa locations
  Clone ID: PAT_TA_101499.pep
SAMTKKRRHRRNNVNATQKATLNKDAAGSEEVGDRLSKLPNDILLNILERVDTLDAFAGLKRLXXAHMXXGESDIPNILSTCKLLESLHLTNCDSGXEXXXXQLXHA

SEQ ID NO: 207082 - protein, 60 aa, Triticum aestivum
  Clone ID: PAT_TA_101500.pep
ERPPGQVSSSGSSSSAPKTHHFAVKTKDDRIDWMRELMLAKALQQKGQGFEVEVNGVRAE

SEQ ID NO: 207083 - protein, 52 aa, Triticum aestivum
  Clone ID: PAT_TA_101501.pep
QLKDIIHSYTHKAVGKCHPALPLHALLLYPLPAPFTITSARCKPTVPRPRPR

SEQ ID NO: 207084 - protein, 122 aa, Triticum aestivum
  Clone ID: PAT_TA_101502.pep
RGRGRGTKEQGSSVNAGNDDPYNAYEMSPDDQRQKNGSAARKRSAALSTSEEEKTGKKRRVNGDDMVHMSGKYRSEDALESLKNSKGTESLKKLGEDGNNDEINVISSGNDFTDRYLPGRPL

SEQ ID NO: 207085 - protein, 103 aa, Triticum aestivum
  unsure (1)..(103): unsure at all Xaa locations
  Clone ID: PAT_TA_101503.pep
MSSPKRRIETDVMKMLMSDYEVTLVNDNMQEFYVRFKGPTETPFEGGLWKIHVELPDQYPYKSPSIGFVNRIFHPNIDELSGSVCLDVINQXXSPMYLPGRPL

SEQ ID NO: 207086 - protein, 117 aa, Triticum aestivum
  unsure (1)..(117): unsure at all Xaa locations
  Clone ID: PAT_TA_101504.pep
XALNXXQLGXXSEAKARLKKXDNMGPRAQTLTASAVAGFFASFFSLPFDFIKTRLQKQSRGPDGKLPYKNMFDCAKKVIRDEGPLRFYRGFSTYYVRIAPHAMVTLIVADYLNFITK

SEQ ID NO: 207087 - protein, 63 aa, Triticum aestivum
  Clone ID: PAT_TA_101505.pep
IEDNNVVASLRFLISLDRSSQQQPPSSHFTRRTPCTPRRWGRSCSSPPAGRRCRRSPARAAAR

SEQ ID NO: 207088 - protein, 173 aa, Triticum aestivum
  unsure (1)..(173): unsure at all Xaa locations
  Clone ID: PAT_TA_101506.pep
RAAARAGIAYGSKATLKNMGYGGGLLHSHVQTYPEGSGQQQITCYHHKDANNDWFFYPNRHQPTYDPEADLKFVGNGDIIRLIHAQTGRNLHSHTVPAPVTKADHEVSCYGNLTVGDTKDHWMVETVSDAASNDWTKLRTLTTSFRLKHVDLNCYLRAGNVNLXSGGFKQIET

SEQ ID NO: 207089 - protein, 66 aa, Triticum aestivum
  unsure (1)..(66): unsure at all Xaa locations
  Clone ID: PAT_TA_101507.pep
LFPLFLRGRDLWFFFVFSIKIDNHGYRWLRMKLXXFIFYIITGTTWPWGSWGGVLIYDLVTANKLF

SEQ ID NO: 207090 - protein, 88 aa, Triticum aestivum
  Clone ID: PAT_TA_101508.pep
SVVAAEVLLDRQFYECMCRYVESGDNLKLIMWQLKDDRRMVDVRVDVAVALRLDEAFSRVLVIWLVDEAVLGATASLRVVVYLPGRPL

SEQ ID NO: 207091 - protein, 65 aa, Triticum aestivum
  Clone ID: PAT_TA_101509.pep
SLASDVADGNCVKLQLHHCNVHDSSLYVSLFAMGIFFTPFALKECTARCSKIQGTSVKKNPAGKI

SEQ ID NO: 207092 - protein, 109 aa, Triticum aestivum
  unsure (1)..(109): unsure at all Xaa locations
  Clone ID: PAT_TA_101510.pep
RCDVYSFGVVVLELVMGKHPRDLLDGSLLSGEQAMLVKDIXDQRPTTPTTTEENSLALLIKMAFSCLESSPQARPTMREAYQTLIQRPTSSSYPVPFSALTLQQGSDAC

SEQ ID NO: 207093 - protein, 88 aa, Triticum aestivum
  Clone ID: PAT_TA_101511.pep
ERPPGQVQGNADPGVLYGDHEGITKVVEEMVKGFGGGKQGWIANLGHGITPWVKPDDLKFYFSEIHRISESHQQTAMPSKTDLGRDHA

SEQ ID NO: 207094 - protein, 86 aa, Triticum aestivum
  unsure (1)..(86): unsure at all Xaa locations
  Clone ID: PAT_TA_101512.pep
VNNLTVFXLLEKHFSALMIKKYQDKKIRIRGSCHARQLYLDISENQSLKNGRAQHNCIPLLEKYLLIQAKYQTSSTTGHYNCFLKE

SEQ ID NO: 207095 - protein, 41 aa, Triticum aestivum
  unsure (1)..(41): unsure at all Xaa locations
  Clone ID: PAT_TA_101513.pep
FFFFFLXNTNFMKPYMFTANIXLKNIFNQAQPALQTNGFKV

SEQ ID NO: 207096 - protein, 92 aa, Triticum aestivum
  Clone ID: PAT_TA_101514.pep
RAAARAGTCGKQWTEDSFRSRGSILSSLHKGRTIATAHGKDPACNHNTGHWALRVTRFFWEDSRKRDDFFSLGAMIPPSGMSKDRYLGRDHA

SEQ ID NO: 207097 - protein, 102 aa, Triticum aestivum
  Clone ID: PAT_TA_101515.pep
RAAARAGTLIAKLHEKSQCQPLPKACLPKAQLHLGQGSSHTHSSLRLDLRLHLSELGSRIPISGILLIRMQPPRNLPCLLTPVLAQQPPRRERQPVPRPRPR

SEQ ID NO: 207098 - protein, 99 aa, Triticum aestivum
  unsure (1)..(99): unsure at all Xaa locations
  Clone ID: PAT_TA_101516.pep
PRTGAAAHLTGARTFRNPPHGAKTKIPGSQPTKTFWEXGKNRSGNQXXRXXRGPPLHSLTKFTPPPHYYRPPPXNNWGKTWRGAWGSQPGRTCPGGXXX

SEQ ID NO: 207099 - protein, 100 aa, Triticum aestivum
  Clone ID: PAT_TA_101517.pep
MKTNYTMHSLDKILTFSGLIFFKQEICYWWCILIKFCTNDLCPSIFSGTSEAFLHSVANENQLKQSNNMLLLFSAIYTVLNVAFIKSAGAIAANSVNMLL

SEQ ID NO: 207100 - protein, 107 aa, Triticum aestivum
  Clone ID: PAT_TA_101518.pep
AWSRPRYRDLEREKIRLGRVAKSEGSYYVPAEPKLVFVVRIKGINKIDPKKRKTLQLLRLLQINNGVFIRLTKATSEMLKIVEPFIAYGYPNLKSVRELVYLPGRPL

SEQ ID NO: 207101 - protein, 85 aa, Triticum aestivum
  Clone ID: PAT_TA_101519.pep
RGRGRGTGSQEVQEQIMRVLCERLMVPRPHPWGLIVMMLELVKNETNNIWSLPWIKTAPQVESMLLNLAHSQDQRQARSPMGAMM

SEQ ID NO: 207102 - protein, 107 aa, Triticum aestivum
  unsure (1)..(107): unsure at all Xaa locations
  Clone ID: PAT_TA_101520.pep
SSGRPGRYGFVVVYGGKNTLVDGTSASSPAAAGILTNVNDALIAAGRPPLGFMNPWLYSRAGRGFNDITVGNIWGCNTSGFPAXXGWDLATGYGTPDFKNIRAALGV

SEQ ID NO: 207103 - protein, 66 aa, Triticum aestivum
  Clone ID: PAT_TA_101521.pep
MTGGKSGGKASGAKSTAQSRSSKAGLAFPVGRVHRLLRKGNYAQRVGAGAPVYLAAVLEYLPGRPL

SEQ ID NO: 207104 - protein, 91 aa, Triticum aestivum
  Clone ID: PAT_TA_101522.pep
SVVAAEVFHLTSPTASTGHSILELRPQIAFRYSPLSRQIATNTMQPTLARMVGGGYLGKDGRSGVTPWRQPVTYETFRSKYGPQYRPGRPL

SEQ ID NO: 207105 - protein, 57 aa, Triticum aestivum
  Clone ID: PAT_TA_101523.pep
MSGNTQGSVQERAQYHLSQLDKELSKYPTLNNFESQTSVPKVYIALGLGALYLGRDH

SEQ ID NO: 207106 - protein, 105 aa, Triticum aestivum
  Clone ID: PAT_TA_101524.pep
SRPRYAAWSTGDTVKSKEPVPLWQIVVIALTICFGFCTYGYNIMRVMGNKITYHSPSRGSSMEMGAAITILIFSQYKLPVSTSMCITGATVGVGLCNGTCPGGRS

SEQ ID NO: 207107 - protein, 180 aa, Triticum aestivum
  unsure (1)..(180): unsure at all Xaa locations
  Clone ID: PAT_TA_101525.pep
DKNTETEVTLXXTKHQEVLTFLRANFPTSEYPDPSNNANPITHIDVDPATGPNSPFYRPEPVATHARLPFVRPSVLYLFGGKSDVSTPMLKADKMASTGIGPGGSGGAKKGRVKEVTFQDIGHLIPMEVVGRTADTATEWIVPEIERYMRLEEEHNREWSKVPKQMKPQMDEKYLPGRPL

SEQ ID NO: 207108 - protein, 70 aa, Triticum aestivum
  unsure (1)..(70): unsure at all Xaa locations
  Clone ID: PAT_TA_101526.pep
DCAPCEHKGHMXMFLFLYRTRGLCIGXVCFAHYSTAQYSIVYSAVFHHPVCVVLNLWHVSIFPALFKSKR

SEQ ID NO: 207109 - protein, 56 aa, Triticum aestivum
  unsure (1)..(56): unsure at all Xaa locations
  Clone ID: PAT_TA_101527.pep
AWSRPRYAGQSKKLKVVTKVNPDIKGGLIVEIGEQTIDLSVSSXXXXMNKLLSDSL

SEQ ID NO: 207110 - protein, 78 aa, Triticum aestivum
  Clone ID: PAT_TA_101528.pep
AWSRPRYHVCGSVAMGAATDTKLVVLGTKNVRCVDASVFPNHVSGNIVSSVYAAAEKAADIIKDDWITGGGKGKILMK

SEQ ID NO: 207111 - protein, 59 aa, Triticum aestivum
  Clone ID: PAT_TA_101529.pep
AWSRPRSGATVGVGLCNGTFRAVNWQRVGLLFFSWVMTIPIAGLIGGITMGLFLNAPSY

SEQ ID NO: 207112 - protein, 69 aa, Triticum aestivum
  Clone ID: PAT_TA_101530.pep
RGRGRGVGAAGAIFFTSRMFARPAPSTMNKEWQEATNEYLRENKVEPITFIGNPDYKGPGMVQSPPKKE

SEQ ID NO: 207113 - protein, 115 aa, Triticum aestivum
  Clone ID: PAT_TA_101531.pep
MKHMKLGSKPDVFQTEGSNIRFVATELAADIVISIGDVKFYLHKFPLLSKSSRLQRLVASSNQESDDEVNISDIPGGASAFEICAKFCYGMIVTLNAYNVLAARCAAEYLGRDHA

SEQ ID NO: 207114 - protein, 199 aa, Triticum aestivum
  unsure (1)..(199): unsure at all Xaa locations
  Clone ID: PAT_TA_101532.pep
SSGRPGRYNSEEGFCELDRKLTEKEAGKLPNRLFYLSIPPNIFVDVVRSASRTASLPSGSGWTRFIVEKPFGRDSESSGELTRSLKMYLEEEQIFRIDHYLGKELVENLSVLRFSNLVFQPLWSRDYIRNVQLIFSEDFGTEGRGRYFDNYGIIRDIMQNHLLQILALFAMETPVSLAXEDIRNEKVKVLRSMRKLXXX

SEQ ID NO: 207115 - protein, 85 aa, Triticum aestivum
  Clone ID: PAT_TA_101533.pep
LKMLFLYFLFSIASTRIYCHSSELVAICLTNDLLIRKVTSCSNGVWPHTTYLLVSCYSGCAFQYRLVIIFLACFGHNLVQRFYMS

SEQ ID NO: 207116 - protein, 65 aa, Triticum aestivum
  Clone ID: PAT_TA_101534.pep
VASFSSRLPLIRGSCISHRSPILNSAPNKNELQTSKIRHRSGVDQYLISRFTCIEQQNMKGNIST

SEQ ID NO: 207117 - protein, 174 aa, Triticum aestivum
  unsure (1)..(174): unsure at all Xaa locations
  Clone ID: PAT_TA_101535.pep
AWRPRYIGSFGLLXIFFISTVQLVXXWAVTLPTYVLLLTSQLRPEIAAFDQVFSRLLVALVVFEYFADGQQWTYHQAKAEYAKTAKVPEGWTRAQIERGFNTTGLWKHSRHPNFAAEQLIWIVLYQWGCFKSETLWNYTCVGVINYILVFAGSTPITEWISSGKYPQYLPGRPL

SEQ ID NO: 207118 - protein, 94 aa, Triticum aestivum
  Clone ID: PAT_TA_101536.pep
AWSRPRYSGIRMTTPPSPFVNAQRIQMMTQPDSFLDVRMMTPASSFLDVAPQKVAQCLGDPAYSGIHAADVNGRSVLLTTRPCSSAEYLPGRPL

SEQ ID NO: 207119 - protein, 114 aa, Triticum aestivum
  unsure (1)..(114): unsure at all Xaa locations
  Clone ID: PAT_TA_101537.pep
SSRPGRYFTQWYYDVRRNKXXFWAIIFGFVTIFPTLYIPVINREVFKHEGITWEWAIVVIAAVLFFAGVEAWKFAKRVFFRRRAVKMGGIMQDAEEADVENGKAESGEKMIESP

SEQ ID NO: 207120 - protein, 117 aa, Triticum aestivum
  Clone ID: PAT_TA_101538.pep
SVVAAEVLGGIPLLVISVLNHDPALNGHIQELTWSDIAALGYTSIFGSAVSYGVYFYNATRGSLTTLSSLTFLTPMFASIFGFLYLGETFAPEQIGGALLTLVAIYMVNYKSIIGEK

SEQ ID NO: 207121 - protein, 51 aa, Triticum aestivum
  Clone ID: PAT_TA_101539.pep
SVVAAEVQLQNFFPQTVYMTKLVRTFCTRCSPYTTFSYLATPPVTCPGRPL

SEQ ID NO: 207122 - protein, 207 aa, Triticum aestivum
  unsure (1)..(207): unsure at all Xaa locations
  Clone ID: PAT_TA_101540.pep
ARPRYDRXXXPKSRTSYAIQQXSGRAPFASTLRPNLTGGALGRTAGGYALGGSGRVGGARFFSHSPASQAQVVQNVSQAVRAFFVSGQKAQFDGISNHGDKRFKAVTALQEETGRKMRSLPKATPGSWIEFQVNPTITALTPLTTVTGYSFTSTADESSHLNTDGLLNILSVDFSRALKDLAAVLNDLKRLSALGDLPLTYLPGRPL

SEQ ID NO: 207123 - protein, 147 aa, Triticum aestivum
  Clone ID: PAT_TA_101541.pep
CIFSTGVGPGDTEFREAGDIKAGRIRHRSDLTKIDCSKTSSNTQRTPTLNRINSTTKSRPTPKSSKYTMQAFRRSNTESSQAWDTKSFMSSTSSLESWTPPAPRTTRKPEKRKVRNEERMKRRRIAAAAKSRDGNPMVAQYLGRDHA

SEQ ID NO: 207124 - protein, 57 aa, Triticum aestivum
  Clone ID: PAT_TA_101542.pep
AWSRPRYISHLVLEYCPTSRLTFVPHTSLLKAMTIIPHADSESFQTIQFRTCPGGRS

SEQ ID NO: 207125 - protein, 54 aa, Triticum aestivum
  Clone ID: PAT_TA_101543.pep
SVVAAEVIVHSWHRSAFDAIIYLFPAWWKKIEYVHELIHERGALCKIIKSNILR

SEQ ID NO: 207126 - protein, 69 aa, Triticum aestivum
  Clone ID: PAT_TA_101544.pep
SVVAAEVLGLFPSSLFLLSSSYYPYFSLLSSKDSSYSGIIGITRKREKRTCGKTKVVSPGRRTCPGGRS

SEQ ID NO: 207127 - protein, 130 aa, Triticum aestivum
  unsure (1)..(130): unsure at all Xaa locations
  Clone ID: PAT_TA_101545.pep
QIVTTLWITTAKVSCGMNSATSGRSPPLQQHLMRLDKQRLCSTPTALASSSLHNKNNCISSALSTRSKSNIMLPSSISLLPLTKNGHISLVALMHAYSFHHTVNLXXNFLFLVLSXXXGSLQSLNHXXST

SEQ ID NO: 207128 - protein, 49 aa, Triticum aestivum
  Clone ID: PAT_TA_101546.pep
AWSRPRSRISKRLLRRLQHLVPNMDKQTNTSDMLRIAVDYIKVGAAGPN

SEQ ID NO: 207129 - protein, 92 aa, Triticum aestivum
  Clone ID: PAT_TA_101547.pep
SVVAAEVEKSDIREFAREMLILSQINHRNVVKLLGCCLDVEVPMLVYEYVSNGTLYHFIHGKELNNDTALDTRLRIAAESAETLAYLPGRPL

SEQ ID NO: 207130 - protein, 96 aa, Triticum aestivum
  Clone ID: PAT_TA_101548.pep
AWSRPRSLSGLAPLVLPVTATRTLMLTEKLWLYGGLAVFGGFTLYDTQKILAHARMAERGLFRRDAVNESISLELDFINIFVRMVQILAMQQGRRK

SEQ ID NO: 207131 - protein, 131 aa, Triticum aestivum
  Clone ID: PAT_TA_101549.pep
MGHQGTRLQLLSVPPYAVAATLTIIIGYLGDRLRQRALLNMGVACLGIIGFLMLLISGNPTIQYVGVFFGAAGIYPTIPNTLTWVSNNIEGVYKRGVIIGIVVGWGNLNGVVSSNIYLKEDKPRYLGRDHA

SEQ ID NO: 207132 - protein, 97 aa, Triticum aestivum
  Clone ID: PAT_TA_101550.pep
RAAARAGTHIRRTLNAMGGSGDAGSFSDGSNLGPITTASNASDIPSAYPRDSTLFYRTSSAYTMDDETAFNNSARALQLLILAPAYGMGPVPRPRPR

SEQ ID NO: 207133 - protein, 148 aa, Triticum aestivum
  unsure (1)..(148): unsure at all Xaa locations
  Clone ID: PAT_TA_101551.pep
VVAAEVAAIVGGSKVSSKIGVIESLLEKCDILLLGGGTIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAXXX

SEQ ID NO: 207134 - protein, 129 aa, Triticum aestivum
  unsure (1)..(129): unsure at all Xaa locations
  Clone ID: PAT_TA_101552.pep
TVDTKXXEVEFEGKKSEYTMMHEWPVRVPRPSTDKLSSGDPFIVGQRVLDALFPSVLGGTVCIPGAFGCGKTVISQAVSKFSNSDXIVSVGCGERGNEMAEVLMDFPELTXXFXXRKEPIMKRTCPGGR

SEQ ID NO: 207135 - protein, 118 aa, Triticum aestivum
  Clone ID: PAT_TA_101553.pep
GRPGRYIILGDTFLRSAYVVYDMTNHEISLAQTVFGVDAADDQIVEVSSSGDGKPVGTGIASFVAPGGTTGSGSGTGTGSGNGSGGSSRTGEKGAASRVGGGLGMCAFALVACVLSLW

SEQ ID NO: 207136 - protein, 112 aa, Triticum aestivum
  Clone ID: PAT_TA_101554.pep
AWSRPRYEREVYDLFGVFFVNHPDLQRIMTDYGFDGHPLRKDFPLTGYTEIRYDEEKKRIVVEPLELTQAFRNFEGGTAAWEQVGPGHDRKPETFKLPTPKPEPPKEEEEKK

SEQ ID NO: 207137 - protein, 37 aa, Triticum aestivum
  unsure (1)..(37): unsure at all Xaa locations
  Clone ID: PAT_TA_101555.pep
AWSRPRYSHFQLLSGLLVVYSARXCVGVXVNSDRVRA

SEQ ID NO: 207138 - protein, 120 aa, Triticum aestivum
  Clone ID: PAT_TA_101556.pep
RAAARAGTDCSFSIIPAPLRRWIAIHYHAERPTEIDMVLSEFPESSSNFPMQHPKSDIYTQMPPKQDITHANAVVLHTLSPLSHPSNPLIYKRAKRPAIMAKAPAPTRVASPVYLGRDHA

SEQ ID NO: 207139 - protein, 142 aa, Triticum aestivum
  Clone ID: PAT_TA_101557.pep
RPPGQVPNQEASEVAKSLVAFLEQQFQSLDSNNRLTVTIDHKAEPWLGDWTNQIFRTLEEAIMEVWGPIDTHHPHNRSVSKLLSPSARQQANGYFNHQPTAKLSPATSSVLATGSLTPLQSLPPLSEVSKKLETSISSSPRS

SEQ ID NO: 207140 - protein, 122 aa, Triticum aestivum
  Clone ID: PAT_TA_101558.pep
SVVAAEVASVGHIRHRNLVRLLGYCRRKGELLLVYDYMPNGSLDKYLHCYDGGDKQAVMLNWAHRFQIIKGVASGLLYLHEKWDKVVIHRDVKASNILLDKEMNGRLGDFGLSRLYLPGRPL

SEQ ID NO: 207141 - protein, 62 aa, Triticum aestivum
  Clone ID: PAT_TA_101559.pep
ERPPGQVLHGDGVALLGTSLAVAGGDEFLGDTHSGGCDGESSELVCEETFGGGRGTSAATTL

SEQ ID NO: 207142 - protein, 88 aa, Triticum aestivum
  Clone ID: PAT_TA_101560.pep
LNTLGGIGGRYLQLKEKRTDHKQTTLPDQLAYTLRCPTLLRAWFGLSSKDARFIDCARPMDTCYSALRLPTRSCPRPSSPNTCPGGRS

SEQ ID NO: 207143 - protein, 160 aa, Triticum aestivum
  unsure (1)..(160): unsure at all Xaa locations
  Clone ID: PAT_TA_101561.pep
AWSRPRYVSHHQVYEQEVVSVERHVLSRHPLGCQFCSSRIPLERPMRLACLFCCFLWSVRPKNPPSIVMSIVNFAAVSVPARPVARPSVLPAPRSTPGSVEPQVLRLRASSIYICHFIFNTLPSPLLVTFLKKLSERSKLPSAQLGQRSTISPTXXGGRS

SEQ ID NO: 207144 - protein, 96 aa, Triticum aestivum
  Clone ID: PAT_TA_101562.pep
MTLYYSLVFGLLVFEMVVFVSLIVPMPFAVKRKLFTFISENPLIAKLQYGLKITFIFILILFIDSVNRVYRVQVELAQAKHQGGAGGVAGTSAATL

SEQ ID NO: 207145 - protein, 168 aa, Triticum aestivum
  Clone ID: PAT_TA_101563.pep
SVVAAEEYSVITKEAADSANYNPLNNQCNLDPKLFIGALGMPGLTAYSSFYEIGQPKKGETIFISAASGAVGQIVGQLAKHEGLKVIGSVGDDKKLDFITKQLGFDGGFNYKTEKPMDALKRLAPDGIDIYYENVGGEQLDAAIQNANNFARIIACGMVSQYLPGRPL

SEQ ID NO: 207146 - protein, 129 aa, Triticum aestivum
  Clone ID: PAT_TA_101564.pep
SSGRPGRYLYDTEQPTGRCGVIITGHDRSMCTDLAAANCYKIEHLKENWSVVEKAKAYYVGGYHLTVCVPAAPALGKEAAEKNKPYIFSLSAPFIPQFFKDQLDQVAPYWDYVVGNETEAAAYLGRDHA

SEQ ID NO: 207147 - protein, 216 aa, Triticum aestivum
  unsure (1)..(216): unsure at all Xaa locations
  Clone ID: PAT_TA_101565.pep
ERPPGQVGALKWFNASRSGATITHTSHETDFALPWNDTKFTPITPLEEQSDDQLVIIRSGKSQERKLKRIRASEKIPGVCVKASSRKPRKSRRSTSSQFITEWKNYPGRRRSIVREQSELLVTIKECANLEKIRENMVKEGQEVCYDKWAKAAGVDEAALKSRLQAGYCCRERLLVTXEWLVKYIARTYTGMXTAFEDLLQAGKMGVLDGAXXXXS

SEQ ID NO: 207148 - protein, 107 aa, Triticum aestivum
  Clone ID: PAT_TA_101566.pep
SAPRTGSRIQVWAITLLLPKHLLIHLPPRLRNITWMHTTPPVRIPILLPPNPDQLQHLRPEPNSRLHERLLIRINDRLLPHEIDFTERDDLGLVDEFPDNVPRPRPR

SEQ ID NO: 207149 - protein, 191 aa, Triticum aestivum
  Clone ID: PAT_TA_101567.pep
RAAARAGVAPSGAGKSTVASLLMRFYDPIQGSITIDGKDISTMNAKQLRRKIGYVGQEPVLFSGTIAENIAYGRPQASRSEIVAAARQANCQFISDFPDGLETFAGARGTQLSGGQKQRIAIARALLKEPDILVLDEATSALDAESETLVNHALQSLLRGDNTTISIAHRLSTIQRSDTIICIGTSAATTL

SEQ ID NO: 207150 - protein, 114 aa, Triticum aestivum
  Clone ID: PAT_TA_101568.pep
TSTGHYIQVLDSGISSSENFLNTSRSLRRVFSRAATQHLQRRLDHSEEDSNVPARTTEMEERRRRWRWRWRRWSIVRQTFTFSTENKASSLSLFSRWPSIAMVCGSGWESRDSH

SEQ ID NO: 207151 - protein, 122 aa, Triticum aestivum
  unsure (1)..(122): unsure at all Xaa locations
  Clone ID: PAT_TA_101569.pep
CAQNSSMFIEQGMALXNQVGSFKIPPPALXSXXVISIVVWVPIYEXYSXXPIASRXXXKQRGFSELQSMGIGLFVSTIAMXXXALVXVKXXXAQDPRXXSISKVPVSISILWQAPGYVGRAH

SEQ ID NO: 207152 - protein, 130 aa, Triticum aestivum
  Clone ID: PAT_TA_101570.pep
RDLTDYLMKILAERGYVFSTTAEREIVRDIKEKLCYVALDFEQEIQTASQSSSLEKSYELPDGQVITIGNERFRAPEALFQPSVLGLESGGIHVTTFNSIMKCDVDVRKDLYGNIVMSGGTTMYLGRDHA

SEQ ID NO: 207153 - protein, 224 aa, Triticum aestivum
  Clone ID: PAT_TA_101571.pep
AWSRPRYNGEDDGGILAAINGSLSHVRSVLLLRGSLVHSFLVLKFIRVLYIIDWRCERLDLTDIRWLFLLRYLKICVRKDLIIPSKIGELQQLETIEIKGRTFLPSDIVTLPRLSHLSYSNHVLLPDEIGRLKSLHTLRGVDFIQSSVENIKGLGELTNLRELEMAWKFVKGAVNMRVDALCSSIGKLSCSLRSLSISKCLQLWVDGWSSTLTPPRRLHKLDLY

SEQ ID NO: 207154 - protein, 197 aa, Triticum aestivum
  Clone ID: PAT_TA_101572.pep
AWSRPRYNRKYFYAESVDPSTIAKSATRIAVLGVSALTSSNAGHINVPPIPQRGDSLLVVGSPFGILSPFHFFNSISVGAVANCLPPGAARSSLLMADIHCLPGMEGAPVFDKNSCLVGMLMKPLRQRGSNIQVQLVITWDGICTAWSRNKLEQIEQASNELLDDKIADSKTVESCGMDNHFVSNLDLNQYSIPPSL

SEQ ID NO: 207155 - protein, 136 aa, Triticum aestivum
  Clone ID: PAT_TA_101573.pep
APSSAATLFFGDAWATFHDFLSKRIQLENSKTKKDVSESEPAWMEYLLELMKVRGWNVLHPSTALVTVHNDLARMPEEFQQRTPSTETRREKPTGALQEDAILTVERAKIPNNRTEHDINSHHLPLHQLLPFDGEL

SEQ ID NO: 207156 - protein, 211 aa, Triticum aestivum
  Clone ID: PAT_TA_101574.pep
SSGRPGRYKKGKENKVADALSRVKYALQALTSTAAIPTWITEVVNSYKQDLKCSELLEQLAIAPNGKPPYSLTSGVLRYKGKILIGNVTELRASLITSFHTSELGGHSGERATYHRLKILFTWPGMRQAVKNFVQQCPVCQLNKAHHFPYPGLLQPLPVPDFAWTHISMDFVEGLPVSDNKDLILVVVDRFTKYAHFIGLKHPINVTTVAQ

SEQ ID NO: 207157 - protein, 88 aa, Triticum aestivum
  unsure (1)..(88): unsure at all Xaa locations
  Clone ID: PAT_TA_101575.pep
AAARAGTNAERGYRSIAEHNTSSEVLCCIPHCYFVTSSQSFSSSHLIYTISKPRSLRRSLWKHVLLEVDAKLQXDSLQLLDVPRPRPR

SEQ ID NO: 207158 - protein, 87 aa, Triticum aestivum
  unsure (1)..(87): unsure at all Xaa locations
  Clone ID: PAT_TA_101576.pep
HEILPSHHATQLPFCTTTKSDTPSPPPAXSVPLPPARQPQSSHIPHPHSPPPPLSRNPPSPPPQSPPHSPHPSHPRSSTQPPRPRPR

SEQ ID NO: 207159 - protein, 71 aa, Triticum aestivum
  Clone ID: PAT_TA_101577.pep
AWSRPRYPQRLQHPEGVHSPLGAPSAWRTVDHANKSVIEKGKVFWFCDYHQVYESRAKVSERADLRMQRSA

SEQ ID NO: 207160 - protein, 157 aa, Triticum aestivum
  unsure (1)..(157): unsure at all Xaa locations
  Clone ID: PAT_TA_101578.pep
RAAARAGKWLRSIYVKGVFLGRVLAKGESLMSRSFEELEEITGYLECCGVRRDWIGHVVSRCPQLLNLSLDELETRVRFYTDMGMNENDFGTMVYDYPKVLGFXSLEEMNSKVQYLKEFGLSTEELGKMLAYKPQLMACSIEERWKPLVKYLGRDHA

SEQ ID NO: 207161 - protein, 96 aa, Triticum aestivum
  Clone ID: PAT_TA_101579.pep
SVVAAEGPILPPAVCKKVAKPELEKLVDGFEWCGIDLEDKEELQEFYDLLYNHYVEDTEGSFRFNYSKEFLAWALKPPGWTKECHIGVRTCPGGRS

SEQ ID NO: 207162 - protein, 198 aa, Triticum aestivum
  unsure (1)..(198): unsure at all Xaa locations
  Clone ID: PAT_TA_101580.pep
GFAVYADRFVDPALGFSLGYTYWFKYIITTPNQLTAGALVISYWLPADRVNPGVWITIFXVLIVTINVLGIKYFGEIEFWLSSIKVLVILGLILLSLIIALGGADGDVRGFRYWNNPGAFNPYKGSGSWGRFLAVWQSMVTAVFAYLGTELVGVTVGEAQNPRKNVPRAIKLTFYRICVFYICSVILLGMCVPRPRPR

SEQ ID NO: 207163 - protein, 110 aa, Triticum aestivum
  Clone ID: PAT_TA_101581.pep
SSGRPGRYLSPPDEFAMGCCLSSSLNARLERSCSYASEKCSGLQPAVLRPVSLSSAPLQPFVPLRHSPSIPNAGKSNIPKQNKPPPLASPSQGLLKCESAHLRILGRDHA

SEQ ID NO: 207164 - protein, 183 aa, Triticum aestivum
  Clone ID: PAT_TA_101582.pep
MLPQIAARAAQQVDRLCQAWRIQKEIANDIVRLALYDVIIYVDDSGSMSFEENGERIKDLQLILQRSVFAATLFDDDGIELRFMNEDLPPQQISGIRNEQQVEQLLASKRYKGLTPFGTELRKKVIDPILIQKLNSGQMRKPLLIISITDGQPAGENQNTLIETVQYACQAAQRSQYLGRDHA

SEQ ID NO: 207165 - protein, 49 aa, Triticum aestivum
  Clone ID: PAT_TA_101583.pep
RGRGRGHLSHPIYLIDFLFLNTLTKSVDQVIYSSRCKQFLKLFFLFLFS

SEQ ID NO: 207166 - protein, 96 aa, Triticum aestivum
  unsure (1)..(96): unsure at all Xaa locations
  Clone ID: PAT_TA_101584.pep
SVVAAEVQTADASIYAAEFKLPDQHGIFNFFVEYRRPFFTNLEEKRTVTVRHFAHDEWPRSFVISGAWPWISGIWVTVAGWLVFXAVWLYLPGRPL

SEQ ID NO: 207167 - protein, 55 aa, Triticum aestivum
  Clone ID: PAT_TA_101585.pep
RPPGQVQARNEGRDLAREGNEIIRVACKWSPELAAACEVWKAIKFEFEPVDTIDK

SEQ ID NO: 207168 - protein, 96 aa, Triticum aestivum
  Clone ID: PAT_TA_101586.pep
SVVAAEVFLFQMARNWEGSNFLGLEMNEKLVVRCLQDVTLAGKRNLYFLSTNATSTFRSIVSSYPGQLTLVSIQCPNPDFNKEQNRWRMVPARAPL

SEQ ID NO: 207169 - protein, 95 aa, Triticum aestivum
  unsure (1)..(95): unsure at all Xaa locations
  Clone ID: PAT_TA_101587.pep
XGRGRGTREEALASLAMHSKRFTSPRGNSSSRRXXSSRSPTSLLLKNSEADFYSXSSIFLSLAPAAAALSSXSSSGMSSSSSSSPSSSTCPGGRS

SEQ ID NO: 207170 - protein, 67 aa, Triticum aestivum
  Clone ID: PAT_TA_101588.pep
WSRPRWGAQGDLWYSNVLCGVVRGCLEMIQMQVEAKFVSDVLRGDDTTEMRITLLRYIEDEMPPDDE

SEQ ID NO: 207171 - protein, 66 aa, Triticum aestivum
  unsure (1)..(66): unsure at all Xaa locations
  Clone ID: PAT_TA_101589.pep
ERPPGQVSPMARHLHSSAHPPPAVTESAITTRPTRRRPIVSIPFVLRMVEHAYGNRSTRTSAATTX

SEQ ID NO: 207172 - protein, 68 aa, Triticum aestivum
  unsure (1)..(68): unsure at all Xaa locations
  Clone ID: PAT_TA_101590.pep
LIGRRYSPIYTPEEWSPSGDVYVGGKAGLFLWAITLAGILLGGALLXYNTSALASLCGKPKYNQTGRD

SEQ ID NO: 207173 - protein, 158 aa, Triticum aestivum
  unsure (1)..(158): unsure at all Xaa locations
  Clone ID: PAT_TA_101591.pep
RGRGRGTSARTNRVKLRNLLAASEGTELLKITQSKARKKRLRFQRSKIHEWGLVALESIDAEDFVIEYVGELIRRPVSDIREDQYEKSGIGSSYLFRLDDDYVVDATKRGGLARFINHSCEPNCYTKVITVEGHKKIFIYAKRRIYAGEELTYXXXRP

SEQ ID NO: 207174 - protein, 77 aa, Triticum aestivum
  unsure (1)..(77): unsure at all Xaa locations
  Clone ID: PAT_TA_101592.pep
RGRGRGTTRRPHSSINTPLLLRLGLDILLHALSLLLRLRTLLFRLTLDFIRLLLPLXXHLIQLLLSLLRVPARAAAR

SEQ ID NO: 207175 - protein, 43 aa, Triticum aestivum
  unsure (1)..(43): unsure at all Xaa locations
  Clone ID: PAT_TA_101593.pep
RAAARAGTANLRRSIWEKNRSDVVICIQGSLIIDXXSAQESAT

SEQ ID NO: 207176 - protein, 80 aa, Triticum aestivum
  Clone ID: PAT_TA_101594.pep
WIRRCMQCHSCPKCRCSARSSLSTSLNPSSCEIGVSSSFERVLESWCNMPLCIDHVVSVGAVVIDAIDEVRTCGSRVPCE

SEQ ID NO: 207177 - protein, 118 aa, Triticum aestivum
  unsure (1)..(118): unsure at all Xaa locations
  Clone ID: PAT_TA_101595.pep
ERPPGQVPGKDYHHQLTLILDVLGTPXXEDYYGIKSRRAREYIRSLPFKKKIPWKAMFPKTSDLALDLLEKLLAFNPTKRITVEEALKHPYLEPYPATAMPIAATATHMLQYLGRDHA

SEQ ID NO: 207178 - protein, 40 aa, Triticum aestivum
  unsure (1)..(40): unsure at all Xaa locations
  Clone ID: PAT_TA_101596.pep
SSGRXXQVLERVNSFPNHGETDGGTKVACNGRRTTQMLDD

SEQ ID NO: 207179 - protein, 66 aa, Triticum aestivum
  Clone ID: PAT_TA_101597.pep
RGRGRGLYLARLQKHRKAEEFKVLIATSRWIASSSPIWIWIASYKQYNINDQILIIHPEYLPGRPL

SEQ ID NO: 207180 - protein, 112 aa, Triticum aestivum
  unsure (1)..(112): unsure at all Xaa locations
  Clone ID: PAT_TA_101598.pep
RGRGRGTSRGYQAVVLALKVFPTCSALLRKSFTETGLWSFLLPPQISTHSAIFLRLLRRALDLRLGLCRQILRLIHDSLRLVLRHLQSLFRLVLERLLTSTHVPXXXXXARI

SEQ ID NO: 207181 - protein, 105 aa, Triticum aestivum
  Clone ID: PAT_TA_101599.pep
STVHRVERDLHERHPDPPNSILTLACPALVLLKGSKNYKTPRDSMNSIPDVADHKLVIHWTTPHQRCSAFECFIFLKPTMSRAEWPEGYSTRQSSRLYLPGRPLE

SEQ ID NO: 207182 - protein, 84 aa, Triticum aestivum
  unsure (1)..(84): unsure at all Xaa locations
  Clone ID: PAT_TA_101600.pep
NINXXXXPPITLXSCHCARRPSLTPXXRHQXKXXPLPPARQPQSSHIPHPHSPPPXXSRNPPSPPPQSPPHSHHPSHPRSSTQP

SEQ ID NO: 207183 - protein, 127 aa, Triticum aestivum
  Clone ID: PAT_TA_101601.pep
AAARAGDLTCPSSHHDKTPLSRPHRHRHRAHLTLYRSQSATTLIQPSGSFFLVDCRFSTTQQQTTAIPQDSRLSKICDLKQTNINSKMRSVFAVAALAAGALAVPYAEKRGLEAYVEDVVYLGRDHA

SEQ ID NO: 207184 - protein, 138 aa, Triticum aestivum
  unsure (1)..(138): unsure at all Xaa locations
  Clone ID: PAT_TA_101602.pep
SSGRPGRYLFVLDALNFCFWXXKDLTYDNLASGLKLALEKDKSALDADRLKNYTGPQLRELLNWPRPLPIEEERVRLLHEVGLELERSFGSEAANLVKSAGNSAASLIELITRHFPGFRDHSLYKGHQVFLYLGRDHA

SEQ ID NO: 207185 - protein, 104 aa, Triticum aestivum
  unsure (1)..(104): unsure at all Xaa locations
  Clone ID: PAT_TA_101603.pep
RGRGRGLRSFTSXXRRNCLKEYLCLNRQYKHSLQLTSRKSPKTDDHLHRITFALGESASFKQHAVYAPTKNIQQSSICPPTSLIHIHCFAASRKGMMPKPSRSF

SEQ ID NO: 207186 - protein, 80 aa, Triticum aestivum
  Clone ID: PAT_TA_101604.pep
MSDLDVQVPTAFDPFAEANAEDSGAGAGSKNYVHVRVQQRNGRKSLTTVQGLKKDYSYNKILKDLKKEFCCNGTSAATTL

SEQ ID NO: 207187 - protein, 127 aa, Triticum aestivum
  unsure (1)..(127): unsure at all Xaa locations
  Clone ID: PAT_TA_101605.pep
AWSRPRYMVSLMDRTNLXXASIAGMRQELGMIKSAATPNGNPMAYSIVTLVFFTTYVFFQPPATVLTKKIGPRNFLATICFLWGCTMIAMGFVKTWQQLAALRVILGIFEAGFFPGCVYLLSTWYAR

SEQ ID NO: 207188 - protein, 77 aa, Triticum aestivum
  Clone ID: PAT_TA_101606.pep
SCCTVFCSSCSFIPDSEIGGATSGLSTCTVCCSSCSFIPDSEIRGATSGLLTCTVCCSSCSFIPDSAIGGPTSGLLT

SEQ ID NO: 207189 - protein, 66 aa, Triticum aestivum
  unsure (1)..(66): unsure at all Xaa locations
  Clone ID: PAT_TA_101607.pep
FERPPGQVPSNMLITRLRPSIYMSSCMALWXXVSGLTALANDFKGLFLTRFFLGLVEAPYLGRDHA

SEQ ID NO: 207190 - protein, 169 aa, Triticum aestivum
  Clone ID: PAT_TA_101608.pep
QDELLSTTPRFSETVRTFANRNLVQNLANLVKRNLVTKLLCSQYAPMLNIHILVDKVSVYCSLPFYVIFTFVVSYKLIKVNVCISMVDDLCHSFTGHNNSSSYSGRMLTNEPCNNEVRDAAMHNQLSACNTRNYTATFPPVQANSNDVPLDETSAFNSGTRASTYVPLR

SEQ ID NO: 207191 - protein, 60 aa, Triticum aestivum
  unsure (1)..(60): unsure at all Xaa locations
  Clone ID: PAT_TA_101609.pep
SVVAAEVLVGQSSIFIVSVVGVFAVVLRLLGLFVRPVSAVSXSLGSVXRLSFGTCPGGRS

SEQ ID NO: 207192 - protein, 148 aa, Triticum aestivum
  unsure (1)..(148): unsure at all Xaa locations
  Clone ID: PAT_TA_101610.pep
RAAARAGLDASRSRIXELQRQIQMEANQTKGXLMLLKQQVMGLRAKEEEVAKKDAEIEQKLKKLKNLEVEVLELRRKNKELLYEKRDLMVKLDAAQGKITESDVVAHAREEINNLRHTNEDLTKQVEGLQMNRFSEVEELVYLGRDHA

SEQ ID NO: 207193 - protein, 120 aa, Triticum aestivum
  unsure (1)..(120): unsure at all Xaa locations
  Clone ID: PAT_TA_101611.pep
RGRGRGXXCHPQTDGXTEXXNRTLSTMLRGVLKNNKKMWEECLPHIEFAYNRSLHSTTKMCPFEIMYGFLPRAPIDLLPLPSSEKVKFDAKXHVELILKMQXXNENIERMNAKYKLAGDD

SEQ ID NO: 207194 - protein, 51 aa, Triticum aestivum
  unsure (1)..(51): unsure at all Xaa locations
  Clone ID: PAT_TA_101612.pep
WSRPRYXDSRYWTMWKLPMFGCTDATQVINEVEEVKKXXIKLYIGSFCCFI

SEQ ID NO: 207195 - protein, 87 aa, Triticum aestivum
  unsure (1)..(87): unsure at all Xaa locations
  Clone ID: PAT_TA_101613.pep
SXXXPXXRSVLLPFFSPCYCSPFLAPQPAAPSPAXSPFPHSSAAPPLKTAAALLSHVPALHSASHLRCCCFSSEPLLLFSSEPLHLC

SEQ ID NO: 207196 - protein, 108 aa, Triticum aestivum
  Clone ID: PAT_TA_101614.pep
QLLDCHLWLLKGHWSVKAHQFVAPDYSKDIRGPCPGLNAAANHNFLAHDGVVTYNELVDAQQNVYNVGYDLANLLAILGLTVTDGDLVTEKLSIGCDATSRTCPGGRS

SEQ ID NO: 207197 - protein, 150 aa, Triticum aestivum
  unsure (1)..(150): unsure at all Xaa locations
  Clone ID: PAT_TA_101615.pep
RGRGRGTGASGIXTIXEIGPKVKHLTVYQRTPNMCLPMNXHPLDQEEEERKKKDGTYEKLINDTRSTFAGFTYDFAEKNTFDDTPEQREQFYEKLWQEGGFRYWLSTYKDMLFDNEXXMEAYKFWRKKVLARVKDEEKQKILAPXXPPHP

SEQ ID NO: 207198 - protein, 44 aa, Triticum aestivum
  Clone ID: PAT_TA_101616.pep
ERPPGQVRDRSRPMNIREKLGYDNASKPRSKFCSICRGKGHIAS

SEQ ID NO: 207199 - protein, 92 aa, Triticum aestivum
  unsure (1)..(92): unsure at all Xaa locations
  Clone ID: PAT_TA_101617.pep
AQQAWDTSFRNHRESXKGRKHGLCHVSKLGGRQWAIIPPVKTQRLEGFAAGVESFVLVWGYTGRSRSRGEFGKIFEDIDHTSKYVPXXXXXL

SEQ ID NO: 207200 - protein, 198 aa, Triticum aestivum
  unsure (1)..(198): unsure at all Xaa locations
  Clone ID: PAT_TA_101618.pep
RAAARAGTFADXNIQKESTLHLVLRLRGGMQIFVKTLTGKTITLEVESSDTIDNVKAKIQDKEGIPPDQQRLIFAGKQLEDGGTLADYNIQKESTLHLVLRLRGGMQIFVKTLTGKTIMLEVESLDTIDNVKAKIQDTEGIPLDQQHLIFAGKQPEDGRTLADYNIQKESTLHLVLELIAGKYNTCSCNGSVPRPRPR

SEQ ID NO: 207201 - protein, 212 aa, Triticum aestivum
  Clone ID: PAT_TA_101619.pep
VVAAEVGRMVLEDFDIEKSAGGAGKLVIKTFITYVTNHTLEIQFYWAGRGTTGIPKRGFYGPLISAISVTPNFQIPLAVEPPRSGSGTNTSRTSKALLIGAPIIAIFTALVVGIYWIKRRRKNLMNQDLRALDLQIGSFTLRQIKAATRNFDPANKIGEGGFGSVYKGSLSDGTIIAVKQLSSKSKQGNREFVNEIGMISALQHPNLVRLYG

SEQ ID NO: 207202 - protein, 217 aa, Triticum aestivum
  unsure (1)..(217): unsure at all Xaa locations
  Clone ID: PAT_TA_101620.pep
SVVAAEVPTEDFKSSVNFAALERYRWIIQRVHEHGMKVMLTLFHHSLPPWAGEYGGWRMEKTANYFMDFVRLVVDRVSDLVDYWVIFNEPHVFVMLTYCAGAWPGGDPNAIEVATSALPTGVYNQALHWMAVAHAEAYDYIHSESKNAMMPIVGVSHHVSFTRPYGLFDVAAVTIANSMTLFPFIDSICDKLDFIGINYYGQEVISGPGLKHVENDX

SEQ ID NO: 207203 - protein, 217 aa, Triticum aestivum
  unsure (1)..(217): unsure at all Xaa locations
  Clone ID: PAT_TA_101621.pep
RGRGRGTYDELASKLKSMDXKEISPFLSYIDNLVRTVEIPVNMRKRLSELRKELFTLQSLAIQLLVFVTSNKLPAPPSVTLLEEANAKYANLPLPVLVSSEVKAPRFYRSFGKDSKDLLYKHYCSDAPMTSKTIVNFDMRGRSSLSMLLSTDQQVMFKCNYADNLPKNLMATMLFGVPSSNSKVKLQYLFPYGGLNGSFNFGEESVLKVAFSGGYDX

SEQ ID NO: 207204 - protein, 142 aa, Triticum aestivum
  Clone ID: PAT_TA_101622.pep
SGERLCSDVSSIRVSPSPDSSSMFIHSIILRVLPLLATQTVRPQKGQRQRQTMELAMRTDHRPTFPILRSSSVFPREFQPIPSPLCRYVAVKEKQMLHPKMSADLHPKLLCGPARPVSINRTRASLRSSGGGFFHVMATATH

SEQ ID NO: 207205 - protein, 56 aa, Triticum aestivum
  Clone ID: PAT_TA_101623.pep
QCRARSESASPNLRSRSMHVDIFFAHFLLKGVGLFGLICSHYFSSLYTYVVIARDM

SEQ ID NO: 207206 - protein, 71 aa, Triticum aestivum
  Clone ID: PAT_TA_101624.pep
FKILGKCRIYYSTAEINTKIIDGHFKFIILNHQVYARNKEYIRSESGAKKKHVRLDLEQKDNISMKSVLGF

SEQ ID NO: 207207 - protein, 90 aa, Triticum aestivum
  Clone ID: PAT_TA_101625.pep
AWSRPRCRLLIPPFTLFNTTHHLQTHPTSSPSVKMISNVVALGFAGMAAAAYAPQGPPQGYGAASSSAPAGPPPSYGTSTAPVYLPGRPL

SEQ ID NO: 207208 - protein, 85 aa, Triticum aestivum
  Clone ID: PAT_TA_101626.pep
TYAERFWNEALLWFDLRLPRPHPDSWARDILCDPHFSDGDRPKIITIMWSIWHSRNKLKHEEGGSDPTNCMRMTREALALLELPL

SEQ ID NO: 207209 - protein, 64 aa, Triticum aestivum
  unsure (1)..(64): unsure at all Xaa locations
  Clone ID: PAT_TA_101627.pep
RAAPRGGYAHLYXSHFQKXGXXKXEXXLNTCFKHFILVTNQFGLIDQKELAPLQEPIESIIGPY

SEQ ID NO: 207210 - protein, 70 aa, Triticum aestivum
  unsure (1)..(70): unsure at all Xaa locations
  Clone ID: PAT_TA_101628.pep
XGRPGRYHLQQVXHTTRTPANGLDDTXSYAYCPYWNKDHAXXIPKLRTHVGSFXQPKCQLTEQNKPSQAL

SEQ ID NO: 207211 - protein, 85 aa, Triticum aestivum
  Clone ID: PAT_TA_101629.pep
MSQYVNELQHFWADLDQCDPVDLPHAESMEIARNWVERRRVMQFLKGLDQGFESSTMCCFINDAFVLDEAIVAMSQEEVPRPRPR

SEQ ID NO: 207212 - protein, 41 aa, Triticum aestivum
  Clone ID: PAT_TA_101630.pep
SSGRPGRYFSGREDYRPEDLIVHKGDYATKAYGQRNLIDKK

SEQ ID NO: 207213 - protein, 147 aa, Triticum aestivum
  Clone ID: PAT_TA_101631.pep
RAAARAGPKASTPGCTKQVCFFRDSYDALTSTGLSIYGLSTDSPKSNTTFKTKQNLPYPLLCDPSATLIKAIGLKKAPSGTTRGVFVIDKSGKVLAAEPGGPEPTMQVVKKLVDASGASGGAEKKEDKEKAETAAEVADTAEKVDAA

SEQ ID NO: 207214 - protein, 120 aa, Triticum aestivum
  Clone ID: PAT_TA_101632.pep
RGRGRGTAPAPLRSPALREVMATQRSNEDAYGSNRVASYGSEQRMGSEHRLRRSFQEQQFAPATPEEEESELTDFHPISRPPQRVTSLGRFSSRRAATEKQAQGQGYSPGLQQRRHVIVE

SEQ ID NO: 207215 - protein, 132 aa, Triticum aestivum
  unsure (1)..(132): unsure at all Xaa locations
  Clone ID: PAT_TA_101633.pep
SVVAAEVPGWDANRSVFDEYSHNYGRQELGRNNDPNFHQQSESEVPFPSHTLVKPSLMQLPAENQSQSSEVKTVGTNAEKTDAHAPKNRSDATPGPSNVKVDSWFCSNYFKRLDISTSLASPELXXXXXXXX

SEQ ID NO: 207216 - protein, 60 aa, Triticum aestivum
  Clone ID: PAT_TA_101634.pep
ERPPGQVLRLTVEWGVGMKRQDLSYGGVVYTRDLRVQALLGGSNSPTSRSLEAVDCIISV

SEQ ID NO: 207217 - protein, 70 aa, Triticum aestivum
  Clone ID: PAT_TA_101635.pep
MPRINVTLKKGADASQLEQAKKQVQEQGGKIVEEFTLVKAFTAEFPADTVHTLQTNDHVTVEDDGEVKTQ

SEQ ID NO: 207218 - protein, 117 aa, Triticum aestivum
  Clone ID: PAT_TA_101636.pep
AWSRPRSLPGLPVLAAAASADVVIFLKTLSRSSGEPLLELRGNPRSSRPDGDGVSASYSFLKALSCLLAVSPVLVFTMLVFSLVRLDRSWFRLGRSSCVVSLVRAEHPLSPCPGGRS

SEQ ID NO: 207219 - protein, 108 aa, Triticum aestivum
  unsure (1)..(108): unsure at all Xaa locations
  Clone ID: PAT_TA_101637.pep
IIFFLNXNPPNSKFLCFPVKVIFSNFVQLSQFLFLPRPLSWGGMVCILVTPKFFFFFLKELFSKKGFVALNRHNIYPPGQFFSINFPMGWGLLSTALQYFSVGLPVRE

SEQ ID NO: 207220 - protein, 113 aa, Triticum aestivum
  Clone ID: PAT_TA_101638.pep
SSGRPGRYKQVDPIVEAVIKEMKTNLGVKKLGSVGYCFGAKYVARFMTGGKGIDVGFMAHPSFVEEDEIKALTGPLSIAAAETDQIFPAEKRRATEDILKGMKIPYQISLYEE

SEQ ID NO: 207221 - protein, 153 aa, Triticum aestivum
  Clone ID: PAT_TA_101639.pep
RAAARAGLVYEYMANNSLDKFLFGERRGTLNWKQRFNIIVGMARGLAYLHEEFHVCIIHRDIKSSNVLLDDDFQPKIADFGLARLLPDDHSHLSTKFAGTLGYTAPEYAIHGQLSEKVDTYSFGIVILEIISGRKINDTRVEAETQYLGRDHA

SEQ ID NO: 207222 - protein, 64 aa, Triticum aestivum
  Clone ID: PAT_TA_101640.pep
SVVAAEVQHLGAGWCGEHCDGVCCGVECGVEFVRALLWCEDGCHNINDQILIIHPEYLPGRPAR

SEQ ID NO: 207223 - protein, 79 aa, Triticum aestivum
  unsure (1)..(79): unsure at all Xaa locations
  Clone ID: PAT_TA_101641.pep
SSGRPGRYLAELLAERHKLNPSVPXLPHIXRLLNQEILRVTTLLDNAFLVNQXXFEHGXPLAWGGLSSNGXATDMNGWT

SEQ ID NO: 207224 - protein, 46 aa, Triticum aestivum
  Clone ID: PAT_TA_101642.pep
SSGRPGRYGSSDGADKFTRDFVSAWEKVMNADRFDLKAGQVSSAKL

SEQ ID NO: 207225 - protein, 63 aa, Triticum aestivum
  unsure (1)..(63): unsure at all Xaa locations
  Clone ID: PAT_TA_101643.pep
PESPXXVVATEGHDRICCPNSSSLLVRLKKLDWKSGSSTSFTRYCITRRMXXLALGTSAATTL

SEQ ID NO: 207226 - protein, 61 aa, Triticum aestivum
  Clone ID: PAT_TA_101644.pep
RGRGRGTGSEIRITTIWVQLAGRAVKLDILFFIVSCLLLLQISVQDNLLLLHSSKLAYSRR

SEQ ID NO: 207227 - protein, 45 aa, Triticum aestivum
  Clone ID: PAT_TA_101645.pep
AWSRPRYVEKRKAGAVRVDGAYVQFLRNKGPIAQNIRRFPSAFNA

SEQ ID NO: 207228 - protein, 107 aa, Triticum aestivum
  unsure (1)..(107): unsure at all Xaa locations
  Clone ID: PAT_TA_101646.pep
AWSRPRYANGEEKDPYNKKFFHNFPVEVNDDFHVAQMEPVLHFTMGGIEINDQAQVLNNQGKPFDGLFICGELAGGVHGANRLGGSSLLGCVVYGRVAGASSSXTAR

SEQ ID NO: 207229 - protein, 178 aa, Triticum aestivum
  unsure (1)..(178): unsure at all Xaa locations
  Clone ID: PAT_TA_101647.pep
SVVAAEVKNINPDEAVAYGAAVQAAILSGEGNEKVQDLLLLDVTPLSLGLETAGGVMTVLIPRNTTIPTKKEQVFSTYSDNQPGVLIQVYEGERTRTRDNNLLGKFELSGIPPAPRGVPQITVCFDIDANGILNVSAEDKTTGQKNKITITNDKGRLSKEEIEKXVQEAEKYLPGRPL

SEQ ID NO: 207230 - protein, 127 aa, Triticum aestivum
  Clone ID: PAT_TA_101648.pep
FERPPGQVPNGLTHRNISIEYRADVALMCGSFGFELNPDELSAEETAAIPGIMEQWRQLNPLVIAGDFYRLAIPQESNWPAVQFVSKDKSESAVFMYQQQAKIKPSPPPVRLVGLDAGARYLGRDHA

SEQ ID NO: 207231 - protein, 63 aa, Triticum aestivum
  Clone ID: PAT_TA_101649.pep
RAAARAGTKNYTPMNTSPQERKQGMSTAATKLVIIIGGAGDQPLVENDLHRCLKQIVPRPRPR

SEQ ID NO: 207232 - protein, 50 aa, Triticum aestivum
  Clone ID: PAT_TA_101650.pep
IHLSSKPDQRIRETYKMSIRAYCNYKKLGSNIICWTNILETKKHGSQNRL

SEQ ID NO: 207233 - protein, 108 aa, Triticum aestivum
  Clone ID: PAT_TA_101651.pep
AWSRPRYSIILCDLHMPNKDGYQTCKEIRKWERKNKHPHLPIIALSANVLGDVYQKCVDAGFNSYMTKPVDFKELSQVLMSFMDPKDPSKPHELMRLKREKSTIGAAR

SEQ ID NO: 207234 - protein, 83 aa, Triticum aestivum
  Clone ID: PAT_TA_101652.pep
RGRGRGTKRLHSTDVAWIKAYSFLLDLMTYQSGISNIRKPTHLSITKMCRFLHFSLSININLRFFLRSLSPAVGVECVKTTQY

SEQ ID NO: 207235 - protein, 108 aa, Triticum aestivum
  Clone ID: PAT_TA_101653.pep
YPSRSTGFLMVDGGRHDFVICAWSSWRIERRLPARWSKASCTFCTYVWIPRKGHVCENEMVTAMSAGNTSEKGGCRYPSQSARCLSSVYQTPARTMSYNPTASSQKKK

SEQ ID NO: 207236 - protein, 159 aa, Triticum aestivum
  Clone ID: PAT_TA_101654.pep
RGRGRGLKEVWIQVRGLLPRWCEWSVLDQCTSAFGLLIDLDWQGMFQSLFECVRVKVQCRDPTKIPTERVFCIGGKTFKVRMTVEVPIVDLVSKDAEVNGGGDDNREDPRNQKDMDTDGLANQNNTANDSASGSNGGSLSGRGNGSGADFQKRSIDAIE

SEQ ID NO: 207237 - protein, 62 aa, Triticum aestivum
  Clone ID: PAT_TA_101655.pep
CYQLVQRAFLNSTAYASDNSRSSISQSVRTVRNESRAAAHFYHHLSGWAPVPHRLMRSMRVE

SEQ ID NO: 207238 - protein, 110 aa, Triticum aestivum
  Clone ID: PAT_TA_101656.pep
AWSRPRYAAFWGQGKPIGKNETVIEALSGVLGEQEAKNIVEVEIKKDETKKKMNANTQLAWEAGAFGLPWFVATNEKGEKEGFWGVDHLGQMLNFLEVKRVQEGGWKAML

SEQ ID NO: 207239 - protein, 67 aa, Triticum aestivum
  Clone ID: PAT_TA_101657.pep
RGRGRGTSSIIYGCSLSQLVNLDLNINTKMLFLKTLSTNINLSIKLKSKFKKALGANYAFGHLLALF

SEQ ID NO: 207240 - protein, 139 aa, Triticum aestivum
  Clone ID: PAT_TA_101658.pep
ERPPGQVPKAMCLCTDTSIVGTDFYIMSFLDGRIFADPSFPDVSPKDRNAMWKSAVETLAKFHRTSPKSVGMEDFGRPNNFYNRQLKTFATLSVAQAKTKDIESGKPVGMIPHYDQMVEFFGDKNSQPVDRGTSAATTL

SEQ ID NO: 207241 - protein, 126 aa, Triticum aestivum
  Clone ID: PAT_TA_101659.pep
SVVAAEVKCEEDYVVARNAEEALAKAQEKYGKSVEIYQDPDVLDTWFSSALWPFSTLGWPDVSREDFKHFYPATVLETGHDILFFWVARMVMMGIEFTGTVPRGSNHTCCLWVGAMLIQLCKPKIA

SEQ ID NO: 207242 - protein, 53 aa, Triticum aestivum
  unsure (1)..(53): unsure at all Xaa locations
  Clone ID: PAT_TA_101660.pep
VGMSLVFRRWATKKXDGSTKNXLDSNPKYMGAKKFGGEXXXPGNIIVPARAAA

SEQ ID NO: 207243 - protein, 155 aa, Triticum aestivum
  Clone ID: PAT_TA_101661.pep
RGRGRGTVLAQPVSSIGNFIYNLGKDKALPWAPEMISLLWELLQCNRRFRRYLVETGCALDYVVLILYYALDSKDDPSKHGILRMCVFVLQTLSAEGLFAEKLNTAFRYPETLPAILRLPNFHGSYADFLICSIHTIFTTTKGRLESVYLPGRPL

SEQ ID NO: 207244 - protein, 86 aa, Triticum aestivum
  Clone ID: PAT_TA_101662.pep
RAAARAGTARAREIDMMQELTKQVEGHTICALGEAFAWPIQGLIRHFRPELEARIQGNTKAAGGEALAGGWQHDAVKKGMLISPGQ

SEQ ID NO: 207245 - protein, 131 aa, Triticum aestivum
  Clone ID: PAT_TA_101663.pep
MVSFWPFGGGNGTDAASFEKVLSQLSTKINKTSAQNDRYRQKQRRYKALWTLYSTFAYILIAAILTLVTGWENWNILEYSAIAGAPVLIYSIRTGLDAYYNYRLANSQNHLNDLTKQREAAIEKLKAATTL

SEQ ID NO: 207246 - protein, 59 aa, Triticum aestivum
  Clone ID: PAT_TA_101664.pep
MSTEGQTITCKAAVAWEAGKDLVIEDVEVLPPRAHEVRIKVAYTGVCHTDAYLPGRPLE

SEQ ID NO: 207247 - protein, 80 aa, Triticum aestivum; identical to SEQ ID NO: 207186
  Clone ID: PAT_TA_101665.pep

SEQ ID NO: 207248 - protein, 174 aa, Triticum aestivum
  Clone ID: PAT_TA_101666.pep
SVVAAEVWPWESRPSNSSSAGQENAVHERSQPSFVPVAVPLQQPNRSFTHQTPNPPPPRESSTSQQTAPAPGAFRCEHCQKTFDKAYLLNKHIKKHTRPAKCPHCVYASDLEADVRRHCASQHPEAMSSNNAYYCPVAGCKKSRGFGPASTRKDNLNRHIRNSHPGVPARAAAR

SEQ ID NO: 207249 - protein, 126 aa, Triticum aestivum
  Clone ID: PAT_TA_101667.pep
AWSRPRYGSMINGLGSLIGNLGAIPCCIICPNPYKPVAQGNVGLVTKFGRFARAVDPGLVKINPLSENLIQVDVKIQIVEVPRQVCMTKDNVNLTLTSVIYYHITSPHKAAFGISDLRTALVERTS

SEQ ID NO: 207250 - protein, 137 aa, Triticum aestivum
  Clone ID: PAT_TA_101668.pep
RGRGRGTNVVGGTNPKKAGSEHLGKPVFANVEEARKATGADASAIFVPPPLAAAGIEEALKAEMPLVVCITEGIPQHDMVRITDMLKTQNKTRLVGPNCPGIIAPGQCKIGIMPGFIHKRGRIGIVSRSGTCPGGRS

SEQ ID NO: 207251 - protein, 114 aa, Triticum aestivum
  Clone ID: PAT_TA_101669.pep
VLKCLLFCQMRAYKENSNSDQINHGYYRMGASSSLPFRFQPTTVKSLGAKSTLTSNSPYFNTESSGDLTAPTASCSKVHQNSDSSSSKHTSSFPWPSPRRHILISLVHFAHLIN

SEQ ID NO: 207252 - protein, 61 aa, Triticum aestivum
  Clone ID: PAT_TA_101670.pep
AWSRPRYEFFSKRQLVTLFSAPNYCGEFDNAGAMMSVDESLLCSFQILKPAEKKQNRFGRR

SEQ ID NO: 207253 - protein, 203 aa, Triticum aestivum
  unsure (1)..(203): unsure at all Xaa locations
  Clone ID: PAT_TA_101671.pep
SVVAAEVKVAFVASQQLASRRWYSAETEAKKEEVLKEQAEAQGAQETPKKDAAKEDPVQKELEAKKQENVDLTDRLKRQIAEYRNLQEQTKREVQAARDFSLQRFAKDLLESIDNLDRVLEAVPKEKLTSENQDLVNLHSGLKMTERILMGTLKKHGMEKFDPSVEGDKFDPNKHEATFMTPQPDKPDNTVFHCQSKGFLYNX

SEQ ID NO: 207254 - protein, 57 aa, Triticum aestivum
  unsure (1)..(57): unsure at all Xaa locations
  Clone ID: PAT_TA_101672.pep
GRYPGXRYYGGNEYIDMAEXLXXKRXXXALXXXXQSKWGVNVXPLSGSPANFHVYTA

SEQ ID NO: 207255 - protein, 107 aa, Triticum aestivum
  Clone ID: PAT_TA_101673.pep
AWSRPRFTISDVFASILGFLPTGWCILLIGQACAPLIKKTTLWDSIMELGRAYDNIMGLVLFLPIGFLSWFPFVSEFQTRLLFNQAFSRGLQISRILAGQKDIGEFE

SEQ ID NO: 207256 - protein, 100 aa, Triticum aestivum
  unsure (1)..(100): unsure at all Xaa locations
  Clone ID: PAT_TA_101674.pep
RRREHSCILCSKLDNTRKSILNVSILFVVTFIFSLVHTSTQYYNHQSNPDNXTTMATHIPRRNVTTGTIPELISLSYAHPKLKTHNSYHASDFALKRKYX

SEQ ID NO: 207257 - protein, 44 aa, Triticum aestivum
  Clone ID: PAT_TA_101675.pep
SSGRPGRYAPIQSVKHKSTILHCGDQLYVKFHDIYQLIATSGMG

SEQ ID NO: 207258 - protein, 224 aa, Triticum aestivum
  unsure (1)..(224): unsure at all Xaa locations
  Clone ID: PAT_TA_101676.pep
AWSRPRCFQQEENLYGIILPKGIGKLKTLHALGAVDVSWRNGNAIVKEFRELTELRNLKVGGVSCRNINELWSAIAGYSQLKSLSVQIGGPDKRNALDGCLGEGLLPSNSLESLHLWGKLVNVTKWINTLQNLTKLVLRRSRLEQDDAIQALGFLPNLVVLRLRMDSFDGTQLHVKSSSFPSLIVLELQWLXXLQSALFEKDAMPKLELLQIGQCKNLNGFSGL

SEQ ID NO: 207259 - protein, 103 aa, Triticum aestivum
  Clone ID: PAT_TA_101677.pep
YSQLHCLCLKPGIQLPYVLDSQEKFYCRFSGETWSDGVPVKGGARADSVPAKSAERRDWMDAACDPVIQQYLGATSGTSSCTTSSPSIPAPMNTLPDARVPHQ

SEQ ID NO: 207260 - protein, 71 aa, Triticum aestivum
  unsure (1)..(71): unsure at all Xaa locations
  Clone ID: PAT_TA_101678.pep
SSGRVLAPSPPSPSPPPHPSSPSPPSXQHIPPPIANHPRSXPSSPPPCPHPDPSGCGASSSHTRPVPTHPV

SEQ ID NO: 207261 - protein, 78 aa, Triticum aestivum
  Clone ID: PAT_TA_101679.pep
SGRPGRYIYSRIKSVITDNNIKDTLRKTLEVYIQIYDTCSKNNWNRVSNNMFNGCRNEYTFNISLLSVYWIPCYGVSF

SEQ ID NO: 207262 - protein, 64 aa, Triticum aestivum
  Clone ID: PAT_TA_101680.pep
SSGRPGRYGGGNGGGYGRGEQEEHGRRGGDEMPGSFGGSDETGGYGNQGDDQSGGYGGGYERRY

SEQ ID NO: 207263 - protein, 216 aa, Triticum aestivum
  unsure (1)..(216): unsure at all Xaa locations
  Clone ID: PAT_TA_101681.pep
RGRGRGTNTSPRWPLAQPMRLLGHNGEINTIQGNLNWMRSREATIQSPVWRGRENELRPFGDPKASDSANLDSAAELLLRSGRSPAEAMMMLVPEAYKNHPTLSVKYPEVIDFYEYYKGQMEAWDGPALLLFSDGRTVGACLDRNGLRPARYWKTSDGFVYVASEVGAIPMDESKVVMKGRLGPGMMITVDLETGQVLXNTEVKKNVASAKPYGTW

SEQ ID NO: 207264 - protein, 116 aa, Triticum aestivum
  unsure (1)..(116): unsure at all Xaa locations
  Clone ID: PAT_TA_101682.pep
MSGDRLRKIEXLKKMLADPKHELIQFDPPLPLPLDPXIHITGVIPXDCNVFKSTLLPLLLKFTTTEGEIYPLILXTGDDLRQDQLVVQIIALMDRLLQKENLDLKLTPYRILRDLY

SEQ ID NO: 207265 - protein, 70 aa, Triticum aestivum
  Clone ID: PAT_TA_101683.pep
SDGFFVAKQDLIHIFCQDSCHAMVQVAPQIVLQGRPWDATRWFELASRDANFDLDRVAGLVYGTSAATTL

SEQ ID NO: 207266 - protein, 112 aa, Triticum aestivum
  unsure (1)..(112): unsure at all Xaa locations
  Clone ID: PAT_TA_101684.pep
EXXXXXXVRDLYHNVTERYPNSDVWLSGHSLGGVVSSLLGLTYGLPTLTFEAFPDALAASRLGLPAPPGYKIGAHQSRSSLGIYHFGHTADPIYMGTCNAASSFCTSAATTL

SEQ ID NO: 207267 - protein, 223 aa, Triticum aestivum
  Clone ID: PAT_TA_101685.pep
VTVCIYRGKWRNKEIEQRQMLRYASSSNEIGGEYVEFPFVSFEDIATATDNFSDSNQIGRGGFGKVYKGLLEGGKEVAVKRLSEGSRQGIAEFKNEIVLFAKLQHKNLVRLLGCSIHGDERLLIYEYLPNKSLDAFLFGAARQSVLDWPTRFKIIKGVARGLLYLHQDSRLTIIHRDLKASNILLDTKMNPKISDFGMARIFGENQQHAKTTRVVGTCPGGRS

SEQ ID NO: 207268 - protein, 69 aa, Triticum aestivum
  Clone ID: PAT_TA_101686.pep
SVVAAEVLKEMQATGKKSGLSPFEIIEGVVLVDDEWAPESGLITSAQKLQRKAITEKYKDGINKAYGKK

SEQ ID NO: 207269 - protein, 117 aa, Triticum aestivum
  unsure (1)..(117): unsure at all Xaa locations
  Clone ID: PAT_TA_101687.pep
AWSRPRYNLTKHGRIPKTVNMVKGSRIHKVKEMEVHTEVPVEIATKEDKLGLRLWNVIQGLRTLRATGLTRELEVFGVVEGEVFIGIIDEISHTCPDEEKEESMLKSGDTSTSPXXL

SEQ ID NO: 207270 - protein, 68 aa, Triticum aestivum
  Clone ID: PAT_TA_101688.pep
RAAARAGVKHDNLVDMIDKTSNDMQAHEQDVIQMMKLAMWCLQIDCKRRPKMSEVVKVLEGTSAATTL

SEQ ID NO: 207271 - protein, 53 aa, Triticum aestivum
  unsure (1)..(53): unsure at all Xaa locations
  Clone ID: PAT_TA_101689.pep
ERPPGQVPDMIQLIALGAVFIYXLFNGRHEHYYYYHSXXDEKEXXYLGRRRTL

SEQ ID NO: 207272 - protein, 111 aa, Triticum aestivum
  Clone ID: PAT_TA_101690.pep
SSGRPGRYPAEDSRKGLSFFSTVTKNKFLFWAVMAGLVTPFPIIYVPFINKVVFRHLPLTWEWGLVFGSVVIFVALVESWKAGKRYRKAKKVKKGGGVLVGRVVVEEKGSV

SEQ ID NO: 207273 - protein, 58 aa, Triticum aestivum
  Clone ID: PAT_TA_101691.pep
SSGRPGRSGQVQSVYKRKSDKAEHASVSLTYLHHHNKRKLRTSALRESIVASIMQQGM

SEQ ID NO: 207274 - protein, 157 aa, Triticum aestivum
  unsure (1)..(157): unsure at all Xaa locations
  Clone ID: PAT_TA_101692.pep
FLIGLFLNIAGYLMMLGINFIGLSYLLVYVGAVSILFLFILMLINVRISELVTDNNNSIPLAIMIGSIFNLTLYKLLPNNFSSNEYGFVPHKLGSLSDKSLLEAQTLAGDNMGSNLYNAYNVHNNNLSFVSSHIXDGVLSETSHITSIGNVPRPRPR

SEQ ID NO: 207275 - protein, 90 aa, Triticum aestivum
  Clone ID: PAT_TA_101693.pep
AWSRPRYDDGTPATASQMAKDVVEFLNWAAEPEMDERKRMGWKVMAIGGLLFGMSVWVKRYKWSTVKTRKITYTAPPTNSPKQPGGVFRR

SEQ ID NO: 207276 - protein, 190 aa, Triticum aestivum
  unsure (1)..(190): unsure at all Xaa locations
  Clone ID: PAT_TA_101694.pep
RAAARAGXXNGFLSVDAGAMIGTSNTPLSMSSHGDPVIADHSPPLNGVGRSQSADIFGNHGEGSQLGDEGLYLSETFNKQMALPFRSPGLQEDFQSPMHDGMFNFQSPSNSGQDSQNNMNMSGQQQMHFQSSPQHNADSSNYQSPSQHQSSMHQDSGVSFSTPSHISHDQSSMFNSPQDNGMLYLGRDHA

SEQ ID NO: 207277 - protein, 114 aa, Triticum aestivum
  unsure (1)..(114): unsure at all Xaa locations
  Clone ID: PAT_TA_101695.pep
SSXXXXXVQTRTKRTKRSVPRLSTRISMPNVLLPHRITGLVADLFPEPPSHLCIVALVLSHFSSSNLHPPLLPTVNSTRLLRNLDTTGSTNSLLDITVNRKLSSGQSTSAATTL

SEQ ID NO: 207278 - protein, 104 aa, Triticum aestivum
  Clone ID: PAT_TA_101696.pep
SSGRPGRYETMTRQHHHEQLAQQQEEDFKSYIAATSNQQQPQQIQQQPQVQSRPSSNHDTQPVTLQTSGLDLDYANMLRGDWPYQLQQHPTHQQQQQYLGRDHA

SEQ ID NO: 207279 - protein, 117 aa, Triticum aestivum
  Clone ID: PAT_TA_101697.pep
SVVAAEVDNALSTSTWESPYQLEPSTIKFNDGILTGIVNKKLASSETIRLPFKLAFYESGVARVTIDEEKRQKGEIELRHDSKARKERYNEAEKWAIVGGTTVSTSLLTSTCPGGRS

SEQ ID NO: 207280 - protein, 122 aa, Triticum aestivum
  Clone ID: PAT_TA_101698.pep
SVVAAEVTSPLGNTTTGSTTFSTSTRPTSTSRFPYSRSPTRCPTSLTGQHTAGSSRIPCGPSPWHNSTHITSARTCQSSEHLHSTPSRSTSTPSTTSTSSADSDTNGASSTATNTSATKSLM

SEQ ID NO: 207281 - protein, 82 aa, Triticum aestivum
  Clone ID: PAT_TA_101699.pep
SVVAAEVRCHSSVVLKPSQEPDAVALISLLFVAYSSTESSLASISGAAAYCNCFPSCLCRKKYFLGRKEQLVCTRHLPGRPL

SEQ ID NO: 207282 - protein, 85 aa, Triticum aestivum
  unsure (1)..(85): unsure at all Xaa locations
  Clone ID: PAT_TA_101700.pep
SSGRXXXVRVNHSYKSALSQDHRDERFIIGCVAESRTMNEPSHNRRSEGPQNYHDEYPPPLPHPSIQLNLSGSLKPLRVPRPRPR

SEQ ID NO: 207283 - protein, 212 aa, Triticum aestivum
  unsure (1)..(212): unsure at all Xaa locations
  Clone ID: PAT_TA_101701.pep
SSGRPGRYPENLDYTFMRQFNAFFGAVLIPLSYFTAKEMHFRKPVVWLITLAVLCENSYCTISRFILLDSMLLCFTFTTVFTLFKFHNQRHQPFSLQWGFWLGMTGISIGCVCSVKWVGMFGTALVGIYTIVDLWNKFGDLKMPKWELGAHVVFRVIGLIVIPLIVYMFTFYLHFLILENSGPGDAQMSSLFQANLRGTEVGKDSPLEIAYX

SEQ ID NO: 207284 - protein, 92 aa, Triticum aestivum
  Clone ID: PAT_TA_101702.pep
RVRFSKDVLHCCGHVSRPCQALRVSLLILLDTTVSLLLLVLSSASEDTPSSSSGWPLLLVHLLYSAWKKHAHGCQSIAWQPSEGSRPRPRPR

SEQ ID NO: 207285 - protein, 66 aa, Triticum aestivum
  unsure (1)..(66): unsure at all Xaa locations
  Clone ID: PAT_TA_101703.pep
VSSCGLGKSAGQSMRMVLSVGCNLLCSSRGLLEDLSLKDKERSSCGSPNMPPSHTPQSGTXXXXRS

SEQ ID NO: 207286 - protein, 83 aa, Triticum aestivum
  Clone ID: PAT_TA_101704.pep
RGRGRGTGLIWTRWCFVIKPRNLFLASVNFLLFCVGATQTGRVLSYQASQKGTTVGEEIKDAAKEQGKKIEQAVEKVEAKVSK

SEQ ID NO: 207287 - protein, 153 aa, Triticum aestivum
  unsure (1)..(153): unsure at all Xaa locations
  Clone ID: PAT_TA_101705.pep
MSEIMDEGINMSINTVVPDLLDDTIDEICGLSKDPRADLDAASARLREDNSSGKIGLHSPTQTKECPTAGMQAMRAQDIGVKPVLKRKEEQADSKPRKRVRFNADVKEQPVELLEHDEDSPMVPQSMDVVTTKGNLGNSSTPSGVPDYVRNPX

SEQ ID NO: 207288 - protein, 91 aa, Triticum aestivum
  Clone ID: PAT_TA_101706.pep
LQVKLPIDEDERGDAFRGIPKLRLLVVLEYIGVPRASPSLGSCHFLFHSPSNIYPKLENFTTQNSTGNLISSVSARKRNHHIRYLPGRPLE

SEQ ID NO: 207289 - protein, 101 aa, Triticum aestivum
  unsure (1)..(101): unsure at all Xaa locations
  Clone ID: PAT_TA_101707.pep
EXXXXXXYGLEATTRDFIGHSMALYTTDDYVDAKGMAKDCIERIRLYVNSMARYGKSPYIYPLYGLGELPQGFARLSAIYGGTYMLNTNVDEIKYLGRDHA

SEQ ID NO: 207290 - protein, 72 aa, Triticum aestivum
  Clone ID: PAT_TA_101708.pep
AWSRPRYHAATVPLINRLILFIMIYDHTVEILRRTDPKAYNTVMTSLDCPANWDNLVRSNNFLLMYLPGRPL

SEQ ID NO: 207291 - protein, 99 aa, Triticum aestivum
  Clone ID: PAT_TA_101709.pep
ERPPGQVNSPPTITFRTPCCHPNVSFKTGEICLDLLKSAWTPAYGIVKTLEAVQQLMSAGGEPDSPLNLDVAKLMRGGDVLGAQALVRFYTGRFAVGRR

SEQ ID NO: 207292 - protein, 85 aa, Triticum aestivum
  Clone ID: PAT_TA_101710.pep
VFWSILFYKISTAQRQKRKLQWLAPAEKMIYVITIFCRKECLNPSVASPGLKKINALTGCCKSLSHQLLQKNEKPSLVRWIVLIE

SEQ ID NO: 207293 - protein, 110 aa, Triticum aestivum
  unsure (1)..(110): unsure at all Xaa locations
  Clone ID: PAT_TA_101711.pep
GRGRTCPGGFIXVGGDGVLNEVVNGLLGXDDLKEALLLAIGIIPAGSDNSLLXXXLGXXDPVXXXTALAXGXXTPIDVSAVXWIQTGVTHFGLTASYXGFXTDVLQLSEN

SEQ ID NO: 207294 - protein, 228 aa, Triticum aestivum
  unsure (1)..(228): unsure at all Xaa locations
  Clone ID: PAT_TA_101712.pep
RGRGRGAEDSLISPKTSGDIATSDASALDSGDLSPLVDYLSGTDPEFSWTLGSSHDDPEQTVYNPRRRILEAMNRELNLPCDEPEVTEMPSVNTPSEAYLVVGATELEVAKNEPGTAKTDAEMMAVDAKSLEDIEMAFKQASGGGVDEAETARISGVDIDLEPLEGSEELHVIDAKSVEDISAALKEYSNVDVNNCFEQNXXEVGCGEVAECXXHDSLPXXXHVESLQ

SEQ ID NO: 207295 - protein, 156 aa, Triticum aestivum
  Clone ID: PAT_TA_101713.pep
ERPPGQVAVAVLTGSEGVKGTIFSTQEGDGPTTVTGSVTGLKEGLHGFHVHALGDTTNGCMSTGPHFNPAGHVHGAPEDEIRHAGDLGNVTAGADGVANINVTDCHIPLTGPNSIVGRAVVVHGDADDLGKGGHELSKSTGNAGARVACGIIGLQG

SEQ ID NO: 207296 - protein, 98 aa, Triticum aestivum
  unsure (1)..(98): unsure at all Xaa locations
  Clone ID: PAT_TA_101714.pep
CTHFSNPHRPVLCDCVGGVGLTIFTCERGQAITEPISSLTVWNFSYGLTSFSSPRYVQPRTRTATYCTPSMFPPTTYVFSLLSKVPXATSLPARAAAR

SEQ ID NO: 207297 - protein, 99 aa, Triticum aestivum
  unsure (1)..(99): unsure at all Xaa locations
  Clone ID: PAT_TA_101715.pep
ACVRLEALRVEENXXQGDIPQSLANLKGLKVLDCSSNNLSGTIPEFLGTFTSLMYLNMSLNDFQGPLPTAGVFANRSGSFVQGNPHLCANIAVPRPRPR

SEQ ID NO: 207298 - protein, 84 aa, Triticum aestivum
  Clone ID: PAT_TA_101716.pep
AWSRPRYIHGRSITSEDENRGKRRKMEQDATMMTQPTTTWTPPGQQQIQSQSGQFFAPARAGPTTDFGRDSPHWDHGYRPGGRS

SEQ ID NO: 207299 - protein, 171 aa, Triticum aestivum
  Clone ID: PAT_TA_101717.pep
SSGRPGRYWEMMRIAREPDQYMWPALQRLRAAADKSNGQLILGALSNTSIFPPGHAFNDESTPEGKQNKELKSVFDIFVSSAHVGMRKPAEDIYKYAITRLHEMVKLKGYGMGVRPQDITFLDDIGGNLRTAKKLGMGTIKVQLGRADLAVKELEKLTGLDLGLKESKSKL

SEQ ID NO: 207300 - protein, 85 aa, Triticum aestivum
  Clone ID: PAT_TA_101718.pep
IKNGNKRTHTKTMQKAQRRYLRINNDIHTTPAWPMLARFCHDSANSEHAHKGVVGEGTSFIGRAATVMCEGTSFKDRNMRTKKGA

SEQ ID NO: 207301 - protein, 208 aa, Triticum aestivum
  unsure (1)..(208): unsure at all Xaa locations
  Clone ID: PAT_TA_101719.pep
RAAARAGTVCSQIASETLQDDIAKTLENFRDMIAMDDRFSFCAXVDDDNGLKSLMWTTGRSRSLYNHFGDAITSDTTYGTNIYKMPFGMFVGVSNHFESVIFAGVFLTNEKGENFCWAFKKFVAMMGGKHPVTILIDQARDIGNAVRKVFTHAEHRWCKWHVLKRAHELLGAVYSKHKTFADDFHKLVNHMLTVEEFEYAWNFVTVKY

SEQ ID NO: 207302 - protein, 76 aa, Triticum aestivum
  Clone ID: PAT_TA_101720.pep
NILVIKMRRLKRAQQKKITFGNVLDREMQDDEASMYSRNSMSTTQIEESARLLRQWQSNYWIDTIPRRQWKDTIFN

SEQ ID NO: 207303 - protein, 92 aa, Triticum aestivum
  Clone ID: PAT_TA_101721.pep
AYIQYRIALCLHLEIYLVTSIIIIREVIASELIVFIALFADLATVAIAYDNAHSEQRPVEWQLPKIWIISVILGIELAIATWIARGTCGGRS

SEQ ID NO: 207304 - protein, 71 aa, Triticum aestivum
  Clone ID: PAT_TA_101722.pep
SVVAAEVLRLGRPQAFGRVDGLVVVSRNIELVVLVEAKLLFLADAAKLGMSQGGRRRVEEGEAVPARAAAR

SEQ ID NO: 207305 - protein, 86 aa, Triticum aestivum
  unsure (1)..(86): unsure at all Xaa locations
  Clone ID: PAT_TA_101723.pep
SCVEISMERKAVKGKTAPMEEVAPGYMFPFPKMEGGGKHGSGPLHLLLCKEKKKSYPKIKWGVGHVVVXXYKFWIGGQNXKLFPCX

SEQ ID NO: 207306 - protein, 40 aa, Triticum aestivum
  Clone ID: PAT_TA_101724.pep
SCRMWHGQRMHIDVLLIHPMSKDLVLYHMGFHFGVFRQRN

SEQ ID NO: 207307 - protein, 115 aa, Triticum aestivum
  unsure (1)..(115): unsure at all Xaa locations
  Clone ID: PAT_TA_101725.pep
WSRPRYKXPPPPPPPPPXXPPPPPPPPPPPPXXXNLKPPSPPGNKFFSHQIFLVFFSLKGNPLPKAIPKDFKQIPNKGNQPIFSPQGFKIFPPTFSKFLRDPSLFPPPPKFQCQI

SEQ ID NO: 207308 - protein, 76 aa, Triticum aestivum
  unsure (1)..(76): unsure at all Xaa locations
  Clone ID: PAT_TA_101726.pep
TAAAYXLVNLAAANGKXLHLGNGAAKEQKNKQFAASKEGKGPVPDKWAEANVQKIIYGTKVVKVAXEEFYAKKARV

SEQ ID NO: 207309 - protein, 75 aa, Triticum aestivum
  unsure (1)..(75): unsure at all Xaa locations
  Clone ID: PAT_TA_101727.pep
ACNAEVDXDGSHVTPGPPDEEMMDVGFALTELFIMDAARPRMRSLXLNCCVLTEYFPVKFVGGCIFCPLSFGFQI

SEQ ID NO: 207310 - protein, 90 aa, Triticum aestivum
  Clone ID: PAT_TA_101728.pep
WISLATSLFEGPAARWLESVRRRALNSTWDEFCRLLRGRFGRNLHQSVLRKKFHISQTGTVEEYVEFSELFDQLVAYESSPNTVPRPRPR

SEQ ID NO: 207311 - protein, 71 aa, Triticum aestivum
  unsure (1)..(71): unsure at all Xaa locations
  Clone ID: PAT_TA_101729.pep
CYXLVFGWGPXXLPXALNANPLPILKKCGRHPQERFFSSLFVSRKCDCYCACLVKVLELSCTIKKKWGAVR

SEQ ID NO: 207312 - protein, 55 aa, Triticum aestivum
  unsure (1)..(55): unsure at all Xaa locations
  Clone ID: PAT_TA_101730.pep
XNWNLAGLIFXXHKKVKHVRGYPNSKTHTFSSSTVTKAKRIXHWKFLCTSAATTL

SEQ ID NO: 207313 - protein, 58 aa, Triticum aestivum
  unsure (1)..(58): unsure at all Xaa locations
  Clone ID: PAT_TA_101731.pep
KWGLWGXFFXXXFGVKHPFLFSVKKKKIKXXRVTKFVQKKKLVWGGGVFKKEQQLAVE

SEQ ID NO: 207314 - protein, 62 aa, Triticum aestivum
  unsure (1)..(62): unsure at all Xaa locations
  Clone ID: PAT_TA_101732.pep
QTHKASFENPNHXQAFHPFTSKLLSVLNAWTRYGTLRQTHGQPNDLSSLPPAIFGTCPGGRS

SEQ ID NO: 207315 - protein, 55 aa, Triticum aestivum
  unsure (1)..(55): unsure at all Xaa locations
  Clone ID: PAT_TA_101733.pep
SVVAAEVFFVPXVILISYYNXWVFLADVKLVNLSLFPGIVAEYNRCYMILLKKKK

SEQ ID NO: 207316 - protein, 56 aa, Triticum aestivum
  Clone ID: PAT_TA_101734.pep
LGGQHIYTAAQLNRTPTRIVIWTKCQNKTANLILLDQTLGRQNLLMQSDHLGRDHA

SEQ ID NO: 207317 - protein, 69 aa, Triticum aestivum
  Clone ID: PAT_TA_101735.pep
SVVAAEVHTPTPHLESPSHATSISPDYSISEREEAEIDDDTHAAASISHEVVGLEVELTALTPARAAAR

SEQ ID NO: 207318 - protein, 36 aa, Triticum aestivum
  Clone ID: PAT_TA_101736.pep
SSGRPGRSGLFLWAVTLSGILLGGALLVYNTSALAS

SEQ ID NO: 207319 - protein, 83 aa, Triticum aestivum
  Clone ID: PAT_TA_101737.pep
RAAARAGTASEYAPIPRLHYAHYSQAFESTDNLITQLFSQTVVQPNQCLSPLPMHQLLSYKAATNPTIPAAIPAPTHLGRDHA

SEQ ID NO: 207320 - protein, 85 aa, Triticum aestivum
  Clone ID: PAT_TA_101738.pep
LRGQENSHYWQPRTITTGVYSRRIFRIAEQQATPTFSRERKHSDEDTTYWYTYLLVTHTRIGTMTLLISSELLFHFRRNLGRDHA

SEQ ID NO: 207321 - protein, 75 aa, Triticum aestivum
  unsure (1)..(75): unsure at all Xaa locations
  Clone ID: PAT_TA_101739.pep
DXXPAAKIIGTGFATTGFIGAGVGIGVVFGALILGGXKNPFFRGQLFFFGILGVGFAEANGXFALMRAFFFLYGG

SEQ ID NO: 207322 - protein, 41 aa, Triticum aestivum
  unsure (1)..(41): unsure at all Xaa locations
  Clone ID: PAT_TA_101740.pep
XGDPSGLAFANTIACGSFGLIMGVGIVIGLKNTGVLDQIIG

SEQ ID NO: 207323 - protein, 103 aa, Triticum aestivum
  Clone ID: PAT_TA_101741.pep
SDRFFLDHGSACLPYRHIHQALASSSNTSNSPSALPTLCDTPPFALPCLRRVLMRMSPTSSLLRRADLIVNLLSIWLETSCSSSSSRSPPGASKSLYLPGRPL

SEQ ID NO: 207324 - protein, 60 aa, Triticum aestivum
  Clone ID: PAT_TA_101742.pep
ERPPGRVRHIIFGGKTRSLKVEQWDAGLHLWLIHWNYTPFILAYGYQKQLGSRACVYKVL

SEQ ID NO: 207325 - protein, 55 aa, Triticum aestivum
  Clone ID: PAT_TA_101743.pep
LKERSGRRDEKRRQAYYWALFRASNEISLAFILRLSKIMSHGFVTFFLVIILLNS

SEQ ID NO: 207326 - protein, 125 aa, Triticum aestivum
  Clone ID: PAT_TA_101744.pep
RGRGRGASEPDVCTVGASDANDERASFSNFGLLVDIFAPGVNVLSTWKDSDTSTNTISGTSMASPHICGLAAYYLALPGSGAPGEPKALCKFLQDKSTKNALGKSSLGLTVLSRNYLAYLPGRPL

SEQ ID NO: 207327 - protein, 99 aa, Triticum aestivum
  unsure (1)..(99): unsure at all Xaa locations
  Clone ID: PAT_TA_101745.pep
PGGRPGRLLKHCRPPGPPKGKPPTNRLPTWNPPGGHQKNQPKNWAKPGPXGKTLPPPNPPTXPPKNKNGKTRGAPGGAQPTKKARFSPPPPQTGNXXGN

SEQ ID NO: 207328 - protein, 107 aa, Triticum aestivum
  unsure (1)..(107): unsure at all Xaa locations
  Clone ID: PAT_TA_101746.pep
NRGPPPGDXKGKPPTPGKPNWRIPKGPPKNPGETXGKTGSRGKMVTPHNSPQKTNREPKGQNPGGPKGEPTXXYGGGPTGPFPXGKPGPPPALKKKPTPREXXVGYW

SEQ ID NO: 207329 - protein, 66 aa, Triticum aestivum
  Clone ID: PAT_TA_101747.pep
LTSSHCQSQQPSHLFSILPFVENREVVVMVRWTSMKTSTCSSSHRRRGGRSRWCRWRRPTCPGGRS

SEQ ID NO: 207330 - protein, 61 aa, Triticum aestivum
  Clone ID: PAT_TA_101748.pep
RAAARAGTCGKPQLWLDNAGSLWLPSHLLKASALCPDPPTCQLSEDQSSSTHLASPSSQQA

SEQ ID NO: 207331 - protein, 90 aa, Triticum aestivum
  Clone ID: PAT_TA_101749.pep
RAAARAGGAPPAGSDPNNPYGYQKDPADPNHPQEGERGFMGAVAGGIGGHLLGKQAGHGILGTLAGAFLGSKGEDKFKQSHHNKHSNQRW

SEQ ID NO: 207332 - protein, 112 aa, Triticum aestivum
  unsure (1)..(112): unsure at all Xaa locations
  Clone ID: PAT_TA_101750.pep
KIPGPPGGHHWGKPPTRGRQNWGFLKGPQKSGGKKGEKRVPGEKCYPLKIPQKKKTGNKKGKPGGAQRGGQPTLMGGAPRPPFQRENLGGPLXKKNPQPPGKGGLGIGAFSP

SEQ ID NO: 207333 - protein, 35 aa, Triticum aestivum
  Clone ID: PAT_TA_101751.pep
LSSHAVVIRLNKLASRFSLQSQYEKSKCTSAATTL

SEQ ID NO: 207334 - protein, 39 aa, Triticum aestivum
  unsure (1)..(39): unsure at all Xaa locations
  Clone ID: PAT_TA_101752.pep
AWPSXNKSTAASNTEGVCLLTPTLKIIIYFPSNIKGTNI

SEQ ID NO: 207335 - protein, 61 aa, Triticum aestivum
  Clone ID: PAT_TA_101753.pep
MAGGHGPGPRHGGAHPIAIPPVRPLYRFAAVGLGASMWFFLFYRARYDLPVLLGMRHPWDH

SEQ ID NO: 207336 - protein, 111 aa, Triticum aestivum
  unsure (1)..(111): unsure at all Xaa locations
  Clone ID: PAT_TA_101754.pep
XARAGRXXLDSHKYIRLTALPNATTGSHRKPCQANMQILQISILFALVSAVSADWPSGWSCKVTDFYKNGVCQNGQGDGNACSTDFSCLLDDHPCDPSPNGYPSEDAKCND

SEQ ID NO: 207337 - protein, 70 aa, Triticum aestivum
  Clone ID: PAT_TA_101755.pep
FFFFAESGAEMHDARSKLRHTTIQTEEKRHKKGKLGWPADSCTHRVTNYAPTQADCRPQQAELQPRPRPR

SEQ ID NO: 207338 - protein, 100 aa, Triticum aestivum
  unsure (1)..(100): unsure at all Xaa locations
  Clone ID: PAT_TA_101756.pep
GGVEYSPIYPQYGVQGSYEGLEIFNSPLLEGLVTGLIIGIKSCIMIFIFIXVRASFPRIRFDQLMSFSXTILLPIIIAFIVLIPCIVYSFEIIPSNISLL

SEQ ID NO: 207339 - protein, 61 aa, Triticum aestivum
  unsure (1)..(61): unsure at all Xaa locations
  Clone ID: PAT_TA_101757.pep
GFTNIPPMPRLERPIDKNKFWLNCPNLENIIFTGTHTILDFGGYGFKRKFITLXSLVTSNS

SEQ ID NO: 207340 - protein, 81 aa, Triticum aestivum
  Clone ID: PAT_TA_101758.pep
FERPPGQVPIYTRRNALLPSHRSPVEATLVLLDALSSTAPLHAVLRVLLDPWLDLCLVQIEVVDRSYSHNELPWVPRPRPR

SEQ ID NO: 207341 - protein, 75 aa, Triticum aestivum
  Clone ID: PAT_TA_101759.pep
ERPPGQVLSGHMLLNILSGFTYNIMTSGFVFFFLGLFPLAFIMAFSGLELAIALIQAQVFVVLSCSYIKDGLDLH

SEQ ID NO: 207342 - protein, 130 aa, Triticum aestivum
  Clone ID: PAT_TA_101760.pep
APTPGCIIVQTLRNRLVSSSLVVGLAVGEQPVDDHADDREEEDADSPEDLVEDRAVGFGYLDPHDHIQDQNNESDNAAAGAVLPCIGLNGDDFVVNWSSEGQSREEELEEEGEHDVDAESRCLTCPGGRS

SEQ ID NO: 207343 - protein, 96 aa, Triticum aestivum
  Clone ID: PAT_TA_101761.pep
FFEISATSAKNGERTRGVPQRSDINALPFIAFTFTSNDTSIGTDFTYANSPEKAEMGDNAAEKCGAFRDGDGRWRSGCETGVIPSSIWVYLGRDHA

SEQ ID NO: 207344 - protein, 63 aa, Triticum aestivum
  Clone ID: PAT_TA_101762.pep
CDSRLTLFLLVAHAQGRVRCVYISNYKTTKYLHVQLHPSNSTDIEPTEKTCASMQHTCPGGRS

SEQ ID NO: 207345 - protein, 68 aa, Triticum aestivum
  Clone ID: PAT_TA_101763.pep
FFFFTFSFIVRLHCWVISSQSAEATKSGLCSFLSRVRIHLTRGPDMCFIVSYPSIVSSIHLTSESNHI

SEQ ID NO: 207346 - protein, 82 aa, Triticum aestivum
  unsure (1)..(82): unsure at all Xaa locations
  Clone ID: PAT_TA_101764.pep
RAAARAGTVEVFGQGXXWGDAFGQYRGAIICQGIAARYAVRQASSEKAGDYGRMMGPYGEQAWESVQKYMRQAQAEGGKAKL

SEQ ID NO: 207347 - protein, 44 aa, Triticum aestivum
  Clone ID: PAT_TA_101765.pep
SSGRPGRYKGFLPKVLRLGPGGGILLVVFTGVMDFFRKMRDEKA

SEQ ID NO: 207348 - protein, 56 aa, Triticum aestivum
  Clone ID: PAT_TA_101766.pep
SSGRPGRYIKCYNQAPAPAQECSFRVTRLKIQTSWNHRKWHPKPIQEGRNLGRDHA

SEQ ID NO: 207349 - protein, 144 aa, Triticum aestivum
  unsure (1)..(144): unsure at all Xaa locations
  Clone ID: PAT_TA_101767.pep
LTKLSDLMTXENELGQRGIVQLLLIPTSQFTSHPHERSHPHQRPAIEPHRILRNPPCVPYSTIPRNSRKESHPPRIDSKLTNPRTAPAPESDSNYFPDSFPHPYPSDFPSSPMDLPSRLSSRQQQAQHPGPHSLSFSEPASXXP

SEQ ID NO: 207350 - protein, 66 aa, Triticum aestivum
  unsure (1)..(66): unsure at all Xaa locations
  Clone ID: PAT_TA_101768.pep
TGGNLNAPRAFWESNPFWKTLFGGKKFFNPNPGGVIGPGPGEKPGXKKKPPPQPPKKGAGGGDPKK

SEQ ID NO: 207351 - protein, 79 aa, Triticum aestivum
  Clone ID: PAT_TA_101769.pep
SSGRPGRYAVSQGEISLRWCIDQDIVALTTSSKEQRLSDYLRAMKFKLTPVEIKQINELGSQKHYRGFWNHKIDENDRR

SEQ ID NO: 207352 - protein, 93 aa, Triticum aestivum
  Clone ID: PAT_TA_101770.pep
NNSGPPGGDPMGKPPTPGEANLGILKGDPKNLGEKRGKRVPGGKRYPPPNPPKKKTGKIKGKTRGGQRGNQPPIIGGGPPAPFQRGKPGGPLV

SEQ ID NO: 207353 - protein, 132 aa, Triticum aestivum
  Clone ID: PAT_TA_101771.pep
THKVPARVPTDGIFSNAASASASVMGNDGLCNGIPQLKLPHCSNLTTKKPTQKLAIIFSICGAVVFIALVFALSTFYSKSRKMKANMQTSSIDEQYLRVSYAELVTATNGFASENLLGAGSFGSVYLPGRPL

SEQ ID NO: 207354 - protein, 50 aa, Triticum aestivum
  unsure (1)..(50): unsure at all Xaa locations
  Clone ID: PAT_TA_101772.pep
TNLYTIPEHPRPKPNKGNYDTXXVSFSHQQSVVNSHSRRLNRNTCPGGRS

SEQ ID NO: 207355 - protein, 85 aa, Triticum aestivum
  Clone ID: PAT_TA_101773.pep
ERPPGQVCKGSARTSARDWRPRMSRPGSMRRPRCAGRTQTLLRPQFTRSVSSIRVNQKRFGSGKVWNDEGAAFFTFGHGLLFLMF

SEQ ID NO: 207356 - protein, 45 aa, Triticum aestivum
  Clone ID: PAT_TA_101774.pep
LIVGIIDCGYPDAYVRIIGFDNMRQVQCVSFIAFKPPGCEESGKA

SEQ ID NO: 207357 - protein, 89 aa, Triticum aestivum
  Clone ID: PAT_TA_101775.pep
RAAARAGPGRYLVTLRDQGTPAQHEKYLKPAENFEHIGCYAQTELGHGSNVRGLETLAIWNPEDQTFIIHSPHLTSSKWWIGSLGRDHA

SEQ ID NO: 207358 - protein, 119 aa, Triticum aestivum
  unsure (1)..(119): unsure at all Xaa locations
  Clone ID: PAT_TA_101776.pep
VKKHWARKGPPPPPNKGPPAGTPQITGEFRPPPGPPYGKTPHPGGAKPGVFIRGPKKPGGNKGKNGSRGKKVFPPKSPQKKNPEQKRENPGGXRGNPPPLIGGGPPAPFQRGKPGGPPD

SEQ ID NO: 207359 - protein, 69 aa, Triticum aestivum; identical to SEQ ID NO: 207317
  Clone ID: PAT_TA_101777.pep

SEQ ID NO: 207360 - protein, 56 aa, Triticum aestivum
  Clone ID: PAT_TA_101778.pep
SSGRPGRYRAEASWRASLQGKALLNAPRLIFLRYRLQTLLQTIGSACYSNLGRDHA

SEQ ID NO: 207361 - protein, 76 aa, Triticum aestivum
  Clone ID: PAT_TA_101779.pep
SVVAAEVPQEVDEVRAKQILEMEDLEILVRLEDGPPEVEEQDAEGRKRAPRTVKEAVFWTCDFSHEYVTINGDYRT

SEQ ID NO: 207362 - protein, 43 aa, Triticum aestivum
  Clone ID: PAT_TA_101780.pep
SSGRPGRCRLLCSTLGTSVPTPETGSICRPFSVDDAPNNRSVY

SEQ ID NO: 207363 - protein, 60 aa, Triticum aestivum
  Clone ID: PAT_TA_101781.pep
FFFSKDHMLSIAVRLEASYWNILSSQTCHCLHASPLPVPIGDDEVLYDMLKRLISSIPLP

SEQ ID NO: 207364 - protein, 118 aa, Triticum aestivum
  unsure (1)..(118): unsure at all Xaa locations
  Clone ID: PAT_TA_101782.pep
FXRVHWPPFSFKICFPMPPPGQKTRRGEKPPQPTQKTGGKRKTKRAKTRPDFPPWKNKEQVGEGAPPRYGSNRFRGGTPLFLYLFRGGSPLFLFQKKKNKGLKSSKXGSGARFRKKNF

SEQ ID NO: 207365 - protein, 49 aa, Triticum aestivum
  Clone ID: PAT_TA_101783.pep
RVFSLSFQIQLIYLYNISLFNLSFHSLIKRLMIMLPLHGHNTAALQIHQ

SEQ ID NO: 207366 - protein, 110 aa, Triticum aestivum
  Clone ID: PAT_TA_101784.pep
HVDEVGVAGHGVDDLHRQHGAAGHDHLLPPSASNLHPPVQPRLLSLLIPLATHALDQTRVSWSLIPSELPYCCSFIFNLLLLFFPHATSAAPLLKTATSSLPRPLLFLTS

SEQ ID NO: 207367 - protein, 103 aa, Triticum aestivum
  Clone ID: PAT_TA_101785.pep
FLFFYSCFSFVSFYIIYPCSIQINDSPPTSWKPTIHRNDRQQHNTPVTRPPHKLGKLKEGYDTPDSALEAGVQCTRTTATLLGAEDEWDGFGIDEVSIQAAFT

SEQ ID NO: 207368 - protein, 118 aa, Triticum aestivum
  Clone ID: PAT_TA_101786.pep
GQKGRFHRPCRVIAPVYVEMSKNYPQLMFLPIDVDALMVIPFYICLGKMTLKSPVGHVILTDALLIPKCSAKPQSMQGIFLSCYFLFQKNVGKPINMYAVLYIFILPFPVSKKYMPPG

SEQ ID NO: 207369 - protein, 64 aa, Triticum aestivum
  Clone ID: PAT_TA_101787.pep
RAAARAGRSYTTEEMRPGCLAVSHCVCVRVRACVRAWMPCYSVHVLRSDVFLVEQGLYLGATTL

SEQ ID NO: 207370 - protein, 88 aa, Triticum aestivum
  unsure (1)..(88): unsure at all Xaa locations
  Clone ID: PAT_TA_101788.pep
RAAARAGTSRRSSHTPRGKSVCKRRSRLLPARCGYXXLELCDLCVDNAPTTVSAMGVLGMIKENQSRIACRGTMRYAEIRSNVTCHLS

SEQ ID NO: 207371 - protein, 120 aa, Triticum aestivum
  unsure (1)..(120): unsure at all Xaa locations
  Clone ID: PAT_TA_101789.pep
GPPGGNPPNNKENPGPRRGTLWGNPPPRGGQTWGIYKGPQKTWGKKGQNRFPGEKGIPSQIPPKKKPGTKKGKPGGAQGGXQPPINGGGPMAPFXXXKPGGPPPLKKRPPPGKRGLNGGP

SEQ ID NO: 207372 - protein, 159 aa, Triticum aestivum
  unsure (1)..(159): unsure at all Xaa locations
  Clone ID: PAT_TA_101790.pep
PFFFFFFFFFFFFFFFFFFKKKPLGGPIFGPKKGPPQGPPIGGGGFPTPPQFFFKNHGPFPXGGPKPPKRGGPPGRVGNGPSPPPPLFLLNSPPPGGPPFGETPPPGGPQPGFFFRAPKKPGXKPGPNLFPGENGSPPPFPPKIQPETKKGNPGGXXGG

SEQ ID NO: 207373 - protein, 62 aa, Triticum aestivum
  unsure (1)..(62): unsure at all Xaa locations
  Clone ID: PAT_TA_101791.pep
SSARAGRRACEATASSHAFXRKXXLXNXLYXEKYTIXXFYSXLGANHITXXGSFVVPRPXPR

SEQ ID NO: 207374 - protein, 61 aa, Triticum aestivum
  unsure (1)..(61): unsure at all Xaa locations
  Clone ID: PAT_TA_101792.pep
DQMAXAQISKFICLWIQDFITLSTFSFKXXXFIFLTMSKXXCQQGPSXEKEGREIFSVKGP

SEQ ID NO: 207375 - protein, 99 aa, Triticum aestivum
  unsure (1)..(99): unsure at all Xaa locations
  Clone ID: PAT_TA_101793.pep
KKKACTKKKLVQKSSLLVLSSSASRSPTARPRSPPSRRWSEWELLWWATDDEGRAGTERRLKGAWEDTAFRSWPNLKSRFYLRKHRQRLARVXXXXXXX

SEQ ID NO: 207376 - protein, 84 aa, Triticum aestivum
  unsure (1)..(84): unsure at all Xaa locations
  Clone ID: PAT_TA_101794.pep
PPPRLLKTLKIQTPRVRDPRPKILTRPYLXPMSPSITGAPIIDRKPEGNTRPXKKCPKGKIGGPRXLKKNPQVGAPLPVEGGGX

SEQ ID NO: 207377 - protein, 49 aa, Triticum aestivum
  Clone ID: PAT_TA_101795.pep
AWSRPRSMFGYFVQAIVTGKGPLENLADHLADPVNNNAWAFATNFVPGK

SEQ ID NO: 207378 - protein, 54 aa, Triticum aestivum
  unsure (1)..(54): unsure at all Xaa locations
  Clone ID: PAT_TA_101796.pep
QQTDRKSPRQGSRGASTNTCLTHIDYSAPSFLLVPRTEGVPAPRAFVSLRQHLX

SEQ ID NO: 207379 - protein, 82 aa, Triticum aestivum
  Clone ID: PAT_TA_101797.pep
SSGRPGRYKPHLDKIIIAKVDATANDVPDEIQGFPTIKLFKAGSKDAPIAYDGDRSIADLSKFIKENGSSGVYVEYLGRDHA

SEQ ID NO: 207380 - protein, 73 aa, Triticum aestivum
  unsure (1)..(73): unsure at all Xaa locations
  Clone ID: PAT_TA_101798.pep
XPPVCFKIQPPFFNPCCYINMAFPFFLGPIKKNKGKRKPQSMVKVDKTARAFYLGPGGRNLLRPCRTXQTRGV

SEQ ID NO: 207381 - protein, 68 aa, Triticum aestivum
  Clone ID: PAT_TA_101799.pep
KVTKRVPPGGVQFRKPFKSLQGGFLGLFFPKRLLNPPLLKKRFFSPLFFPPMGSPKGKFIFFFSPGPG

SEQ ID NO: 207382 - protein, 161 aa, Triticum aestivum
  Clone ID: PAT_TA_101800.pep
RGRGRGTFTGPGELLLAPFALGDITNLRLSGKEQWSVGKDAFLASTQGVTKTYVSQNFSKAMFSGEGFFIYKIAGVGICWIQSMGAIIRKDLRDGEKYIIDNGHLVAWNCDYVLERVASGGIISNLSAGEGLVCKFTGPGTVFMQTRNPQQFAQYLPGRPL

SEQ ID NO: 207383 - protein, 77 aa, Triticum aestivum
  Clone ID: PAT_TA_101801.pep
RGRGRGLHRLLLLGISGPLMPPALRNPVDSSAMHPPGHVFSLAPVPTIALATSQPYFRMPVKSPDQSPSPTPARAAA

SEQ ID NO: 207384 - protein, 51 aa, Triticum aestivum
  Clone ID: PAT_TA_101802.pep
RPPAQVQREQTTTHQIPSYKHIYLFNHYAFLYVGCRGIFTATPGADSSELR

SEQ ID NO: 207385 - protein, 93 aa, Triticum aestivum
  unsure (1)..(93): unsure at all Xaa locations
  Clone ID: PAT_TA_101803.pep
GSTNEXITNGHXCHXXRXINLQMVIAYIFDKLMKGRSLTTLLRRSDVAFISFLGLEPCPSDHGEEELLEVHLAVLVXXHLLCNKVHTSXXXTL

SEQ ID NO: 207386 - protein, 96 aa, Triticum aestivum
  Clone ID: PAT_TA_101804.pep
AWSRPRYEDLCPSTHNMDVPNVSRREFQLLDITDDGFLSLMNDNGDTKDDVKVPDGEVGDKINKLFKEEEKDTNVIILTAMGEEAAIDAKEAPKGA

SEQ ID NO: 207387 - protein, 100 aa, Triticum aestivum
  Clone ID: PAT_TA_101805.pep
RPPGQVPTHNPVPYARDSLGRPLSPPSPPYTHCSSFSPLHRSHPFPPSLSSSHLAHLQTFLHSSSPLFFPPQRKTLLSYTLILKTKKQGKKERHLGRDHA

SEQ ID NO: 207388 - protein, 189 aa, Triticum aestivum
  Clone ID: PAT_TA_101806.pep
AWSRPRYIFMTIYSLCHGLASDRYQKRFWFYVYPIPIVLAGALVFMFTESFGSRYFSLFMLNFVFAMNGTIYAWIANGIPRPPAKRAAALAFINSVGNAASIWTPFTYNDGDRPYYRSAMGINMGMTVVAGASAVAMKFILESQNRQLIRMENEDTPLTDKDMRKLERTAEIEGIDIASARMLQYRYIV

SEQ ID NO: 207389 - protein, 96 aa, Triticum aestivum
  unsure (1)..(96): unsure at all Xaa locations
  Clone ID: PAT_TA_101807.pep
KKKKNPGPPGGHHRGKPPTRGRPNWSFLKGPPKSGGKTGAKRVPGEKWYPPTIPHKKQTGNKKGKPGGAQRGTQPPLMGGPXXPPFQRGNXGGPLD

SEQ ID NO: 207390 - protein, 96 aa, Triticum aestivum
  unsure (1)..(96): unsure at all Xaa locations
  Clone ID: PAT_TA_101808.pep
PPILGKTEIPPLKKIKPLPPPQTPRPXIYLXXKGKRPQKPNPLSPGGGGFIKKRGPKGFPLGKGAVRPTQKKGGGSPLRPPRVYPLIFRLLFFGEF

SEQ ID NO: 207391 - protein, 60 aa, Triticum aestivum
  Clone ID: PAT_TA_101809.pep
SSGRPGRYSQLRHLLRTGYRRRSKARRNVFLTKVHHYATLHCSTKVQYLLVLNDLGRDHA

SEQ ID NO: 207392 - protein, 118 aa, Triticum aestivum
  unsure (1)..(118): unsure at all Xaa locations
  Clone ID: PAT_TA_101810.pep
KKGVLFFSPPLXYPPPGPPFYWGGPPXPGGXXXTXEIPGPRRAPLWGNPPPPGGPTWGFXRAPQKPGGNMGQTGSRGKMVSPXQFPPQTNPEPKRENPGGPKGGPPPLYWGGPPGPFS

SEQ ID NO: 207393 - protein, 98 aa, Triticum aestivum
  Clone ID: PAT_TA_101811.pep
QGENCPPLPSEKFKTFFGGEEPPHNGGKNQRVWGQLLGGGDPNGRRGGPKILGPPELCPGLGGFLLIGPQFFFFFVKTVLIGGVQALFLGFFFPFHLN

SEQ ID NO: 207394 - protein, 96 aa, Triticum aestivum
  unsure (1)..(96): unsure at all Xaa locations
  Clone ID: PAT_TA_101812.pep
SSXXXXXGAATLSSPSRKRRLNRKPSETRHTTTLATAATRSSPSRKRKPSSKQLEDPRRRASTAGSFEKLCSSRPXIXDGLQNEHASFNSRTSAAT

SEQ ID NO: 207395 - protein, 107 aa, Triticum aestivum
  Clone ID: PAT_TA_101813.pep
ERPPGQVLAKAVLLMCPYFQLSSPDTLKGQQGCYGTTTSLHLILQRRVSLQGKDLGVWFAQIEDDVCQRCNFWDSQTEDDVWCGADRNVGKYHIYVMKMMYLGRDHA

SEQ ID NO: 207396 - protein, 58 aa, Triticum aestivum
  unsure (1)..(58): unsure at all Xaa locations
  Clone ID: PAT_TA_101814.pep
FFFLIKDRICILEYGSSSRLDRPHLSYSPTXXLKSNQKLHPKRXESHHSQPPARAAAR

SEQ ID NO: 207397 - protein, 75 aa, Triticum aestivum
  unsure (1)..(75): unsure at all Xaa locations
  Clone ID: PAT_TA_101815.pep
XRGRGRGVSHAHWERSGLLGGXXRANKTYSLEAXXRLSSTRGLCSRRAARMGACFWAFFVSLVITKIERVSQKKK

SEQ ID NO: 207398 - protein, 114 aa, Triticum aestivum
  unsure (1)..(114): unsure at all Xaa locations
  Clone ID: PAT_TA_101816.pep
KGAGGPPPIKGGGPPLWPPRVFPFXXPVFFLWXFVRGYHFPPGTSFALVSPQFFGGPFKIPKFGPPRVGGFPKGWPPGGPEFPYFLGGSRPGWVLSVSQGLFPFQFGKPGDPXX

SEQ ID NO: 207399 - protein, 57 aa, Triticum aestivum
  Clone ID: PAT_TA_101817.pep
RAAARAGTLADYNMRQVQCVSFIAFRPPGCEESGKASARTYTCHSHLSASVISPIYL

SEQ ID NO: 207400 - protein, 78 aa, Triticum aestivum
  unsure (1)..(78): unsure at all Xaa locations
  Clone ID: PAT_TA_101818.pep
RLYVQQRVRRRHLRLVVGLDGFEHDQIDSGXDIILFSVCFTFCFRPELVHVLSNHAYFRSYFMMIITXXXGQWMCTLX

SEQ ID NO: 207401 - protein, 133 aa, Triticum aestivum
  unsure (1)..(133): unsure at all Xaa locations
  Clone ID: PAT_TA_101819.pep
GEKKXXLFKNFSFFFPPFWGGGRGVFXFFSRERKXFPRGGPIKIPPRGPQILGTXPFFVSVLKGGILNAPRVFWEFNLFWASLFGGERFFYPNPGGVIGVGPGVNPGAKKMAPPKPPREGAGGGVPKFFFPRG

SEQ ID NO: 207402 - protein, 83 aa, Triticum aestivum
  unsure (1)..(83): unsure at all Xaa locations
  Clone ID: PAT_TA_101820.pep
PMAMFLGPIRGVAGLLYRFHTPLGSGHPFXCXWVPLVVFRQTTSINNFLQIFVCDLSCKSLNKGNYSVFPFXNFIFFQXXXML

SEQ ID NO: 207403 - protein, 146 aa, Triticum aestivum
  unsure (1)..(146): unsure at all Xaa locations
  Clone ID: PAT_TA_101821.pep
GGKKPFQNLSLFFPPGFGGGAGVSLFSPGKDLVPPGGPRQKPPPAPPKFGDQPHFWPRPNGAKPKPPPGLLGIPPXWPPPFGGNPFFNPNPGGVIGPGPGENPGXKKXAPPPPPKKGPGGRAPKVYFPRGPKGLAPKAPVLGGGPL

SEQ ID NO: 207404 - protein, 81 aa, Triticum aestivum
  unsure (1)..(81): unsure at all Xaa locations
  Clone ID: PAT_TA_101822.pep
SCCLPPLAAGQGRAGKKQHHFKQNIQGFHLLLPSSLQCRRGSTTACMLSVNLLRQLLDVHLKPFLHXVKDVRVRPARAAAR

SEQ ID NO: 207405 - protein, 84 aa, Triticum aestivum
  unsure (1)..(84): unsure at all Xaa locations
  Clone ID: PAT_TA_101823.pep
GGSGXXYFFKGPFFKGAPGSNXVKKKAPKVYPGPIKLNXKNPVXTRWGRTPFFLFLKRFLAGVKKITPGGGVFNGLFGGGKTPP

SEQ ID NO: 207406 - protein, 54 aa, Triticum aestivum
  unsure (1)..(54): unsure at all Xaa locations
  Clone ID: PAT_TA_101824.pep
PTNLGLIFSFXXNPRGPDREHRTGAGXXLTGAQTFWNPPQGARTKPAPAGPLNH

SEQ ID NO: 207407 - protein, 161 aa, Triticum aestivum; identical to SEQ ID NO: 129051
  Clone ID: PAT_TA_101825.pep

SEQ ID NO: 207408 - protein, 88 aa, Triticum aestivum
  unsure (1)..(88): unsure at all Xaa locations
  Clone ID: PAT_TA_101826.pep
GQPKKRGLGPSLGPPGFTLFFSGFYFFGNFKGKKIFPRKKFFPFFPXIFLGPXKKIQXRPPTGGGFSQKVAPKGAGNFXXFKPPPGGV

SEQ ID NO: 207409 - protein, 88 aa, Triticum aestivum
  Clone ID: PAT_TA_101827.pep
AWSRPRYWLSERAELPAVTSRRFDNDPITNHKRWDRNWLAGCWNKLDISFRFGLWVLWVLALIYSPSTVSGLEGRFLPPLVPARAAAR

SEQ ID NO: 207410 - protein, 78 aa, Triticum aestivum
  Clone ID: PAT_TA_101828.pep
SVVAAEVLELAGNAARDNKKTRIIPRHLQLAIRNDEELNKLLGHVTIAQGGVLPNIHQNLLPKKTTGTKGGKGPSQEL

SEQ ID NO: 207411 - protein, 86 aa, Triticum aestivum
  unsure (1)..(86): unsure at all Xaa locations
  Clone ID: PAT_TA_101829.pep
LSKLLGLPIRRVPGPKGVILFGLSTFPKFFVVKRGFSFGGHYVLTTQKFFHVPFQKNGSPLGGLLVLEIISCKRLXSLSNKGAPFP

SEQ ID NO: 207412 - protein, 80 aa, Triticum aestivum
  unsure (1)..(80): unsure at all Xaa locations
  Clone ID: PAT_TA_101830.pep
XFFFFFFXXXKGHIFFSFYANPTQIISLSIYAIXAIYSILTGLQSQLAXXXTDNRLGRNPRYRREXIFSDEEEYPYWLHT

SEQ ID NO: 207413 - protein, 166 aa, Triticum aestivum
  Clone ID: PAT_TA_101831.pep
RGRGRGAALGLTLASIIPPCLIIFLRPKKELIPWAFAATSWGFFLCSYQVHEKNVLLPLLPMTLLLATEGGMKPSIRAWVGYANLIANWTLFPLLARDQLRMPYLVLTSLWAYLLGLPPFSISAYTHPAKEGGVNILTKLIHLGTYAAALAWHGAELFVPARAAAR

SEQ ID NO: 207414 - protein, 119 aa, Triticum aestivum
  unsure (1)..(119): unsure at all Xaa locations
  Clone ID: PAT_TA_101832.pep
ALRLHAFPENNDNAXAGSQEHAAFLQKMQKMIILGXXSPPAPTLGFWGCENQATSLMLEQGSKSQKXVXXXGCKREPLYDERRLKMLXXPPFIWRVXTFRMLARSESDDAPDXXXATXX

SEQ ID NO: 207415 - protein, 69 aa, Triticum aestivum
  unsure (1)..(69): unsure at all Xaa locations
  Clone ID: PAT_TA_101833.pep
SSGRPGRSSASPTSRXXSRLLERGGRRSLAVVRRAXSSLFVVPARRMWWWWWYCCYLPSIYLSRAGVRV

SEQ ID NO: 207416 - protein, 91 aa, Triticum aestivum
  unsure (1)..(91): unsure at all Xaa locations
  Clone ID: PAT_TA_101834.pep
SSGRPGRYHSILALFGFEHYDXAGPXSAGGQRLGMGFHGRNLELRCHRCFCCLFVFHCGTKDECATATTTALLICSSMRIIKTYIRLKKKK

SEQ ID NO: 207417 - protein, 96 aa, Triticum aestivum
  Clone ID: PAT_TA_101835.pep
MKFSLAPLLVLGLAAGAMAKDQTQQVIISYPNNTPASVLEGAKKAILDAGGVITHEYSLIMGFAAKVPAKVLESVQAMGQEHNVLIEQDQIVSINN

SEQ ID NO: 207418 - protein, 35 aa, Triticum aestivum; identical to SEQ ID NO: 207333
  Clone ID: PAT_TA_101836.pep

SEQ ID NO: 207419 - protein, 114 aa, Triticum aestivum
  Clone ID: PAT_TA_101837.pep
RGRGRGTLASQLDATPAGRPLQDQRICFVQVTFASLLSSSNAASRFPSFTFAFLIVLPTSLTFGAAPIANLLLDVMKELLSRECHSVFARIKHVCICEHAHQLLFQLYLPGRPL

SEQ ID NO: 207420 - protein, 54 aa, Triticum aestivum
  Clone ID: PAT_TA_101838.pep
ERPPGQVHLFFSADGLVSLFVARRGCSVSIIINETVAFALNLHNRQWNAAKFKL

SEQ ID NO: 207421 - protein, 61 aa, Triticum aestivum
  unsure (1)..(61): unsure at all Xaa locations
  Clone ID: PAT_TA_101839.pep
XRPPGQVDFVVPSGSSPATARLQSXXXXXQGXRSRFLLSVWGPPCKSQGLNVMFLSILVLL

SEQ ID NO: 207422 - protein, 80 aa, Triticum aestivum
  unsure (1)..(80): unsure at all Xaa locations
  Clone ID: PAT_TA_101840.pep
GWLVGWSLYPLLXXKNFLEGLSPQGXNFFTNKFFWVFLTLRETPGLRGCPRAFNKCETKGIKPGVEPQGGKFFRPTLENF

SEQ ID NO: 207423 - protein, 85 aa, Triticum aestivum
  Clone ID: PAT_TA_101841.pep
PQNGFIDEAVRCCRREDRGGHKSTRGGAYKGGVLEPWPLPRTLASPSSTLLNLSVHEQQQEEEDDRRRQWTHGFCWRTYLGRDHA

SEQ ID NO: 207424 - protein, 65 aa, Triticum aestivum
  unsure (1)..(65): unsure at all Xaa locations
  Clone ID: PAT_TA_101842.pep
SSGRPGRSGAQCWPSCXHXXELSQPSKGFAAQGCTALERESYISLVVFFFFEYLSLVVSISSRLA

SEQ ID NO: 207425 - protein, 79 aa, Triticum aestivum
  Clone ID: PAT_TA_101843.pep
PPGARDFIIISTAPPAGYFAQLGGQGNYYGTRDEPGVGTGEFSRTRFFLVPRIFLVAFTVLKKFLRRKKSTTGRGMLVP

SEQ ID NO: 207426 - protein, 59 aa, Triticum aestivum
  Clone ID: PAT_TA_101844.pep
AAARAGEEDELVDGIKANSPPRGYLRRYMSRLQSVVLCHNGTVVNLSLVLICTSAATTL

SEQ ID NO: 207427 - protein, 83 aa, Triticum aestivum
  Clone ID: PAT_TA_101845.pep
RADVQTSAREHSMLLYSHCRPAHNRHQPWVNPMPSWTQIQPPLPTPLKESQHIASTYAPEERRDVALDAQRARSRTCTCPGGR

SEQ ID NO: 207428 - protein, 74 aa, Triticum aestivum
  unsure (1)..(74): unsure at all Xaa locations
  Clone ID: PAT_TA_101846.pep
PPGQGPFSFFVPPFVFLAMLVGGPLFLLGEKSGGPPLGLNKVEXGKSGYQNFCWLFQNWGFLKFVLFCYEILLG

SEQ ID NO: 207429 - protein, 34 aa, Triticum aestivum
  Clone ID: PAT_TA_101847.pep
GKFTEKNMSCKLANPGNYIVYWLTKKKTCPGGRS

SEQ ID NO: 207430 - protein, 88 aa, Triticum aestivum
  unsure (1)..(88): unsure at all Xaa locations
  Clone ID: PAT_TA_101848.pep
KRGQGIFLGGKKKKPSPAKKKKGKYKAPGPPHPKKNGIPGPREVNQKEKPPTGGRQNLKILKGNQKSWAKTGPNPVPGGNWFPLXXXX

SEQ ID NO: 207431 - protein, 77 aa, Triticum aestivum
  Clone ID: PAT_TA_101849.pep
NFLEPQLRRQQHQHEDREKRIDRISQATTRKIEQPTISRTKPPDTGGKSHAISCKKKAFTFEQSSSEQQQYLGRDHA

SEQ ID NO: 207432 - protein, 148 aa, Triticum aestivum
  Clone ID: PAT_TA_101850.pep
SSGRPGRSTLPTQMIKRFRRCWTTFTFLQRQPYWKNSMHSPAVQHWMRARKQFQSHALHCSVLARTGAHPRVGTRTLEGLVPTSITSSMVLPASQSPVGIRTFKARWRVGSLERKIVVFAIEDSSVEVNYWTVRSIHCLTTWCYTEHH

SEQ ID NO: 207433 - protein, 72 aa, Triticum aestivum
  Clone ID: PAT_TA_101851.pep
SVVAAEVRIRWLSGFRSLGFFHNTTHLHAFTTQKYPSARCCGSGKAGDGWRRWEWFFQAGCSRPSFMVLIDV

SEQ ID NO: 207434 - protein, 81 aa, Triticum aestivum
  Clone ID: PAT_TA_101852.pep
GRPGRSSSDLESLSSTLAACLDGTRPLYPFHPHHFLCGFHVRLCFLFMLSCGLGFVFIEQRLIPPYPGACSLLLLLFPFAL

SEQ ID NO: 207435 - protein, 137 aa, Triticum aestivum
  unsure (1)..(137): unsure at all Xaa locations
  Clone ID: PAT_TA_101853.pep
XTTFCSILSYVYVGLLLVSITXNVQVATILASFFNTMQTLFSGFILPAPQIPKWWTWLYYLTPTSWALNALLTSQYGNIEKEVKAFGETKSVSIFLNDYFGFHQDKLSIVATVLVAFPFVLIILFSLSIEKLNFQKR

SEQ ID NO: 207436 - protein, 56 aa, Triticum aestivum
  Clone ID: PAT_TA_101854.pep
FFFYSWTIGDEFILTSMITHTSHATPTLVVYIRTWSPILYSQLTNAQRFHLPGRPL

SEQ ID NO: 207437 - protein, 51 aa, Triticum aestivum
  unsure (1)..(51): unsure at all Xaa locations
  Clone ID: PAT_TA_101855.pep
ACWLAEKMARLLMCSVIMLVLQQPGICADHGLTLCPSKAQIFEHVPXXXGR

SEQ ID NO: 207438 - protein, 91 aa, Triticum aestivum
  Clone ID: PAT_TA_101856.pep
FKVGLFLSLRSKNTALFYIQISSHKSRLFMAPTSGDCYSSEAWAENVEQGDSGVDQGPEDALAAVLHVRNAPSEVVHALKRRLPTCPGGRS

SEQ ID NO: 207439 - protein, 69 aa, Triticum aestivum; identical to SEQ ID NO: 207317
  Clone ID: PAT_TA_101857.pep

SEQ ID NO: 207440 - protein, 41 aa, Triticum aestivum
  Clone ID: PAT_TA_101858.pep
HKILHLCYMKISLLHQTRPSMDELCLRTGYPAIFTCPGGRS

SEQ ID NO: 207441 - protein, 51 aa, Triticum aestivum
  Clone ID: PAT_TA_101859.pep
SPSILACYYPRHGSFPKVKRYERTTIVPPGADHEVDKVEDANAGTSAATTL

SEQ ID NO: 207442 - protein, 113 aa, Triticum aestivum
  Clone ID: PAT_TA_101860.pep
ERPGIDLIVGTVSSAKMPLEGYLGLLKTKGTYIQIGAPDAGELPAINAFTLLTNGIKVGGSAIGSPKEIEEMLQFAADKKIEPWLNERPMKEANDVVQDMTAGKARYLGRDHA

SEQ ID NO: 207443 - protein, 49 aa, Triticum aestivum
  Clone ID: PAT_TA_101861.pep
KTKKESSFWHPDSRGNPKTGPFKGGPWVENPPAPTTLSLRKSRPPGGPP

SEQ ID NO: 207444 - protein, 108 aa, Triticum aestivum
  Clone ID: PAT_TA_101862.pep
AWSRPRCEDSEESGEAEEGGDDAEEEEEEEEEEEEEDEPEDIKPKLEEECLKTSVCAPLKHHYDECAERVQHQTEQHGKAEEDCVEEFFHMMHCASQCAAPKLFRQLR

SEQ ID NO: 207445 - protein, 88 aa, Triticum aestivum
  Clone ID: PAT_TA_101863.pep
KKRENTFAVTLPKVLVGGYTVLYTKTCKVSKPRPRKNPEQHKNYFFLLHKDPHFRGVLKNKSPNRSTGHPWVHEGGHGPRSASLPFHV

SEQ ID NO: 207446 - protein, 91 aa, Triticum aestivum
  Clone ID: PAT_TA_101864.pep
AWSRPRYWGKVKGRSQFAKVADLQDAYLKEGWEGDEILESFAESLENGWTADQVWGFAEVEGVRRHVRRILSKKGKDELRIRLVYDWAPPS

SEQ ID NO: 207447 - protein, 87 aa, Triticum aestivum
  Clone ID: PAT_TA_101865.pep
MSDDEERVTMPFKFVTAGFDARFPNQNQTKHCWQNYVDYHKCILAKGEDFKPCRQFFLAYRSLCPIGWSNRWDEQREAGTFPCRLDQ

SEQ ID NO: 207448 - protein, 78 aa, Triticum aestivum
  unsure (1)..(78): unsure at all Xaa locations
  Clone ID: PAT_TA_101866.pep
PKGFLGPKKPPGWPPSFPLNFPFGFPGGGGXANGRVPLKFFQGWXENFPPLGSPPRFISLFPPFFKSPWPSLWAGVSP

SEQ ID NO: 207449 - protein, 74 aa, Triticum aestivum
  unsure (1)..(74): unsure at all Xaa locations
  Clone ID: PAT_TA_101867.pep
GNSSSXXVNPGFFRSARELKSAPLPGGKRAPIFARFGGSQXPFFRAFGNSMIKRGNPGVKRAPPKGKVRKAFVN

SEQ ID NO: 207450 - protein, 53 aa, Triticum aestivum
  Clone ID: PAT_TA_101868.pep
GKKRIDSAKPGFHASQFNSVTHTCKHQLHRYVCQLHHRTPRCWCPRPARAAAR

SEQ ID NO: 207451 - protein, 72 aa, Triticum aestivum
  unsure (1)..(72): unsure at all Xaa locations
  Clone ID: PAT_TA_101869.pep
ERPPGRYWTIIAVLFNLPLGVLLKHPDSCLEIPAKPLRLRLVHSPWPRASCTRSQPFRRLVIALDXWAATTL

SEQ ID NO: 207452 - protein, 91 aa, Triticum aestivum
  Clone ID: PAT_TA_101870.pep
RAAARAGPGRYTIQIYRVFLALLREKGHGKHAYASVLHLWIATHAACCEGLYINLNHASRSRFMDDTTSMASPRGHAASMKYSPYLGRDHA

SEQ ID NO: 207453 - protein, 76 aa, Triticum aestivum
  Clone ID: PAT_TA_101871.pep
SSGRPGRCTVGRLGHEFGWKYQDVVARLEERRKVKGQAYYERKSAARKNLVEAKKNAKVPEAVQKQLEQYLGRDHA

SEQ ID NO: 207454 - protein, 112 aa, Triticum aestivum
  unsure (1)..(112): unsure at all Xaa locations
  Clone ID: PAT_TA_101872.pep
ERPPGQVIFSTAADNXPTVLIQVFEGERSMTKDNNQLGKFELNGIPAAPRGQPQIEVTFELDANGILRVSAGDKGTGKSESITITNDKGRLSAEDIERMVEEAEKYLGRDHA

SEQ ID NO: 207455 - protein, 114 aa, Triticum aestivum
  Clone ID: PAT_TA_101873.pep
MQFVALHAEGELDKILDPQVIEEGGSEVKEVATLAVECLKLRADERPTMRQVEMALEALQTPKKRVRDNLTEETDEKEYAATGFPSTSQQAKTNEASRCYIQEEEFLLSAAYPR

SEQ ID NO: 207456 - protein, 65 aa, Triticum aestivum
  unsure (1)..(65): unsure at all Xaa locations
  Clone ID: PAT_TA_101874.pep
RAAXXXGTNCVYYSLTQTMTMEPLRDRSLHIPPSKQIADHQLHPRRTRRSTGVMNLPTRGSSAFC

SEQ ID NO: 207457 - protein, 81 aa, Triticum aestivum
  unsure (1)..(81): unsure at all Xaa locations
  Clone ID: PAT_TA_101875.pep
STQERITVTVPSAIPFASSSPKKHANTIAPVSLALAQXXLSPPPITSSHTSXXSLRRRLGNLHRAXXVVEVLLGYVGRDHA

SEQ ID NO: 207458 - protein, 180 aa, Triticum aestivum
  Clone ID: PAT_TA_101876.pep
RAAARAGTNNGANPTPGGTLITQIDAAARVNGFTYDGTYSNQFDDFFISRIGNSDSNDGSNRYWGVLQEFQFTPAGGCEDAIDTNSEGLWAYNAFNANYFLRIEQDYQVLRLGQTVSVTVIDGQSGIPISDASIAGVITDANGRATFVVPSTPGCYQYKATRSDSIRSNAFYLTVLPAEG

SEQ ID NO: 207459 - protein, 73 aa, Triticum aestivum
  Clone ID: PAT_TA_101877.pep
YSFIYSFYSSFNIPSLHDPSLHDEGTAILPALGLCNPGSSLSYFSQFSKIFPILGLFVNRYTSSKYLPGRPLE

SEQ ID NO: 207460 - protein, 55 aa, Triticum aestivum
  Clone ID: PAT_TA_101878.pep
SSGRPGRYIQRSHRHISPTHHLPFDMLIPQLGPTQTKITVAAITFRILGEGRSGS

SEQ ID NO: 207461 - protein, 129 aa, Triticum aestivum
  Clone ID: PAT_TA_101879.pep
ERPPGQVHPSLRRSSFSVTEDDSSVDHRGGFVNLGLIRWNLRSACIRTIMPVSCCQCFGPRCNDLSDSHRCLPNFEPCFISHSKSLRLRPHRVVERIRDITRRQTSSTKEATIQALHGFDTAVLGRDHA

SEQ ID NO: 207462 - protein, 93 aa, Triticum aestivum
  unsure (1)..(93): unsure at all Xaa locations
  Clone ID: PAT_TA_101880.pep
GKGPGGPTQLMGGGLFFGPPGFSPLCFGLVFWGELGGDNIFPREPVLPFXXPVFLGAIIKSSSLASXGWGVFPNGRPAGGREFFIXXAAPRAG

SEQ ID NO: 207463 - protein, 71 aa, Triticum aestivum
  Clone ID: PAT_TA_101881.pep
EEIQSLHYYPLLLILRSFSCHFTTTHERKERTDALNYLAFLLLLLLLLFAAAASLLLLFFELRRTCPGGRS

SEQ ID NO: 207464 - protein, 58 aa, Triticum aestivum
  Clone ID: PAT_TA_101882.pep
ERPPGQVAGRAEHRSGEGPDCFSVLFVRVLCVNFQDYSVTLGLVRAHICILYLGRDHA

SEQ ID NO: 207465 - protein, 50 aa, Triticum aestivum
  unsure (1)..(50): unsure at all Xaa locations
  Clone ID: PAT_TA_101883.pep
WFFFWKNPLIIXEQQGGQHHFANLNSAYVSTSWIXRFANLIGEMTLENGK

SEQ ID NO: 207466 - protein, 48 aa, Triticum aestivum
  Clone ID: PAT_TA_101884.pep
CSVLKLLLTSNFTGIQTEGKYLILNSSEYNHDGYLTLNTNPVPARAAA

SEQ ID NO: 207467 - protein, 102 aa, Triticum aestivum
  Clone ID: PAT_TA_101885.pep
ERPPGQVPAARGKRKASVAAPTTDGTKTYGRTTASDKENEGYESFEEADESTLPELSVSMHELAKSRELEEAKRKFAEVDDWDMEFESMSQDDHLRSSQSWR

SEQ ID NO: 207468 - protein, 88 aa, Triticum aestivum
  Clone ID: PAT_TA_101886.pep
RGRGPIGQLAPPRYNTLGVSSWRNLGFEAVDFGRGSPARVMWKAHPTVGLVCVLCPPCKGEHGVTVVSRCVKPKHADAFVAELAALDV

SEQ ID NO: 207469 - protein, 59 aa, Triticum aestivum
  unsure (1)..(59): unsure at all Xaa locations
  Clone ID: PAT_TA_101887.pep
LAPARAGTHCNXXTLYYPFMTFIIFFFLCMVIKCLAASSVHGDAWGKFRXXTLCWSFLS

SEQ ID NO: 207470 - protein, 57 aa, Triticum aestivum
  Clone ID: PAT_TA_101888.pep
AWSRPRYGTDEEGIKYWLIKNSWGIDWGDLGYVKILRDVESKAGFCGLASDACYPVA

SEQ ID NO: 207471 - protein, 51 aa, Triticum aestivum
  Clone ID: PAT_TA_101889.pep
ARNCYPDSMGILLSTQPYRASVRKGEIRAPFPPPPKGFLRVSVTCTDVTFR

SEQ ID NO: 207472 - protein, 62 aa, Triticum aestivum
  Clone ID: PAT_TA_101890.pep
QAFTTRRPRRAVPPETGGSSGRTYRPRQLVMTDPRAGDPPLHSPTVTLRVAAWHGFDPLLGT

SEQ ID NO: 207473 - protein, 61 aa, Triticum aestivum
  Clone ID: PAT_TA_101891.pep
FGRLVKVTSAESREAWVSRPRSPTNRERELGSRPVARQGRGYHDGGQGARGRQHETRPRQR

SEQ ID NO: 207474 - protein, 40 aa, Triticum aestivum
  Clone ID: PAT_TA_101892.pep
MQVLSVVISSFSNLSIVMCESQCRLSCSLRAANLRPATHV

SEQ ID NO: 207475 - protein, 41 aa, Triticum aestivum
  Clone ID: PAT_TA_101893.pep
GVWSQNRSVRPASVHIITDVGQSTTHSERTFSSSTCPGDRS

SEQ ID NO: 207476 - protein, 81 aa, Triticum aestivum
  Clone ID: PAT_TA_101894.pep
SPPYLGDTIEYSSYASNALGALPYGRPAGGREFTSDLGRRHYTKYSTYASNALRSSAHMVDVSGGLEFTSVAGHSYGHDYA

SEQ ID NO: 207477 - protein, 74 aa, Triticum aestivum
  Clone ID: PAT_TA_101895.pep
RTSQSLSGSGNGLRDHPYGKAPHTKERITGVFYNVSLNKKNSVCRVHRQREMDSDNKTPTNKQTNNSLKHHPSN

SEQ ID NO: 207478 - protein, 98 aa, Triticum aestivum
  Clone ID: PAT_TA_101896.pep
AGDPGCFPLDDEAYPPSSHWPTLTPVIFGSYLVFRVCLDLVPLAQPAPKQCFTPRSPVNCSASTHFGENQLALGSSGISPLTTTHPQILQHQSVRTSA

SEQ ID NO: 207479 - protein, 218 aa, Triticum aestivum
  Clone ID: PAT_TA_101897.pep
INYSTHTHLNTPYMCAGCGSCLIWTGHYTSNRRQFRPVCVIVVDVWCGDCVVYTTNYSTEPADATHTTTHEPGLGWAAGGFVNTQATQAPPASCSRFLSVLFFAFPLQNTQTSGHIARTQSLLFFYWLSARAAQRPRAARLPAHVALSGARLVADRTHTDTTHISHSHHRSAVPRARASRPGAPSAAPWPRGAWWRGRPGTTPPPNLPINTLYYRFLY

SEQ ID NO: 207480 - protein, 106 aa, Triticum aestivum
  Clone ID: PAT_TA_101898.pep
NRTHHYPNQSATTTNSSHSNLYNISYLFMNLSSSIYVIRLFHMNDDTPQSSTTSCNAMRLLDVQVDLLSSIIFYINLYTFYFHYPLIPSCTSSCACDVFTYIYIIH

SEQ ID NO: 207481 - protein, 108 aa, Triticum aestivum
  Clone ID: PAT_TA_101899.pep
VSRINFGWGGCGGGGCSRLLFCCIFCIYYTSLYSSRAYPLACAPRHPIRTAQSLCFCGGVRGFKNRHVYRFMFHIFVSHGHERSRVPMSPLSPSHGEPLRDKYTKLLD

SEQ ID NO: 207482 - protein, 88 aa, Triticum aestivum
  Clone ID: PAT_TA_101900.pep
VSHRTLNQLCRWLPARPVPSCAPRARRAAGPDTGTPKHPPNHTTLHNLNTTHYRANWARRRMLPAAMAAAGIRLTSSRSRAAARDPRT

SEQ ID NO: 207483 - protein, 128 aa, Triticum aestivum
  Clone ID: PAT_TA_101901.pep
HYLFRCSAFALVTIPTNHIKKKKNTDTTTHNNEHYSLLYLIDSYVIYAGFLSLCDPTDVPTKYTNKLTEKKTIKKTLIIIIFPSLSSTLLPPSPSLLSRTHIDNPRPHNNQKTAHDSSEKNYTHTHLT

SEQ ID NO: 207484 - protein, 119 aa, Triticum aestivum
  Clone ID: PAT_TA_101902.pep
LVSRIASGRPRSRTSQSNSRGRHGGREHATSGSNSPYSRVIYNLALGVFSAGACFFGVLIPHTTERYNVRGMVVSWLCVRRLVARGWRGRLRLEMTMDRDVEHGGACRPKTLLEDIRAS

SEQ ID NO: 207485 - protein, 94 aa, Triticum aestivum
  Clone ID: PAT_TA_101903.pep
IIYICNNCPQLRSETCTACERSSCRYRQCRCLSTQLHSDNNSTPPSTLVAKNKEKEEKEQELQGRRGIISPAGAGRRVPQPDTPSPKNLIQTHQ

SEQ ID NO: 207486 - protein, 132 aa, Triticum aestivum
  Clone ID: PAT_TA_101904.pep
VFLVDKTVKNAIRRVVEVCHSNRTSWMSACGVRRRDGVPLSSGRARGRRARTHSKRRTTAGKRVMKESQRHASPSPPPQTHTTTPAHGAEKMLSYNIHISHSPPSARKCPWWRGCSRGVPRHHTPTINMTSL

SEQ ID NO: 207487 - protein, 119 aa, Triticum aestivum
  Clone ID: PAT_TA_101905.pep
KMIISLLIVYISVLGGRPNTQPPNKRDTCEEGKGEKTQPKKKKLNAIITISPIERIRARRRMLPAAMAAAGIRSTSSRSRATARDLEPRNHLVNSRPPCMDRPLLGRELPTSVSRRARA

SEQ ID NO: 207488 - protein, 98 aa, Triticum aestivum
  Clone ID: PAT_TA_101906.pep
ERPVPIIHLPTPPQAGPPPRVGPLWYVPQISPRTPTRAPRRRVRDAPLLPTGSLQARLLQNKRENLSHCFSDAGHIPKKVLRGSVYVSPPPSLGDPLL

SEQ ID NO: 207489 - protein, 164 aa, Triticum aestivum
  Clone ID: PAT_TA_101907.pep
RGGVLGVVFHTGERGGTSTRNNRPTASNFEAHPRRTHHIPALHFHPRAVQTPTTLRLAPPHQHSKISICLHALLHPPPITLPPNRSPRAGARTPPSHRSEKEVFVSGVCAHWNSTKRQTHSGTRSSSLAGRSPADTENTFNIISSDAQTRTAHTPGPHYKNKHQ

SEQ ID NO: 207490 - protein, 65 aa, Triticum aestivum
  Clone ID: PAT_TA_101908.pep
ISFALWVSVPRGGFIAPPDSLGVYPDFGRHGRGYPYIAGCFLRPLEMVPVKPTAASKRTFGEEPA

SEQ ID NO: 207491 - protein, 89 aa, Triticum aestivum
  unsure (1)..(89): unsure at all Xaa locations
  Clone ID: PAT_TA_101909.pep
MLPPLFQNKDKRAKYINVPIANFDEMEFIFQDKHATGEFNXVFQPPYDRVHARDKDFIGDTEKSAIDIEVDPATQYDSDCFAHSPHSNH

SEQ ID NO: 207492 - protein, 60 aa, Triticum aestivum
  Clone ID: PAT_TA_101910.pep
IGARKGESVHLRFHSVRKGKCEAHAGERRKSFLPTPPFQSLVRPLHGSTIWESFPNARVI

SEQ ID NO: 207493 - protein, 110 aa, Triticum aestivum
  Clone ID: PAT_TA_101911.pep
VRTYIFSSPSPPHPFLGERRGHFPRGGTGGPPFGGIFPLLGTNGLNPGPLSPGNKQNPGGGGAYLWETNKTQRGKNRDKYKEKRCHSRAFFQRLPFQSLVRPPAMVDLYW

SEQ ID NO: 207494 - protein, 203 aa, Triticum aestivum
  unsure (1)..(203): unsure at all Xaa locations
  Clone ID: PAT_TA_101912.pep
GELGPTSHAPGRHGRGIGMGGVGKTVLIXMELINDIAKAQGGVSVFGGVGERTREGNDLYMEMKESGVINEKNIEESKVALVYGQMNEPPGARMRVGLTALTMAEYFRDVNKQDVLIFIDNIFRFVQAGSEVSALLGRMPSAVGYQPTLSTEMGSLQERIAYTKKGSITSXQAVYVPARRFCRPPPFQSYSAAACEVWPIYSR

SEQ ID NO: 207495 - protein, 65 aa, Triticum aestivum
  Clone ID: PAT_TA_101913.pep
YMFNRIAFAGSLSRFFKFNIPDLNKREFYILLTLVSLTVILGVYPTPILDGLHYSVSSLIYCTAV

SEQ ID NO: 207496 - protein, 72 aa, Triticum aestivum
  Clone ID: PAT_TA_101914.pep
MHRLTPCHPQTYQSSKSVSSPCPSDSVSSPGIVPKSVSSSVYIRFSSPSSSSSSSASPSSSSSSSASPSTSV

SEQ ID NO: 207497 - protein, 45 aa, Triticum aestivum
  Clone ID: PAT_TA_101915.pep
GIFCCCVVCWPVRHKGYYRRSISIIAALPKPLRTKMKRECPASSC

SEQ ID NO: 207498 - protein, 46 aa, Triticum aestivum
  Clone ID: PAT_TA_101916.pep
TARCLYSNSSLASIRTIQDVEECVPLDIEKKLPKTVSSSNSYRAVS

SEQ ID NO: 207499 - protein, 52 aa, Triticum aestivum
  Clone ID: PAT_TA_101917.pep
ANIIGKGSYGTVYRGKLTQAKIQVAINVFNLDMKCADKSFVTECEVLRSIRH

SEQ ID NO: 207500 - protein, 98 aa, Triticum aestivum
  Clone ID: PAT_TA_101918.pep
LDRSSFDDDDEEEDQIRDPPVCNQTSMPSFHFHLGPILMFFISPNPSATHHSLASPSSSNRPSGGSMSWLKLFAASASALSAGARGASARGVSAAAHF

SEQ ID NO: 207501 - protein, 56 aa, Triticum aestivum [sequence omitted]

SEQ ID NO: 207502 - protein, 101 aa, Triticum aestivum
  unsure (1)..(101): unsure at all Xaa locations
  Clone ID: PAT_TA_101920.pep
MSWWWAGAVGAVKKRQDERAASGXPTFQSVALILGCTGIVGASLLNILPDDHTPGWPWNVYSASHLAPHGWWTPSPSPSVTLLNLWISYSCCMNDALLPVT

SEQ ID NO: 207503 - protein, 240 aa, Triticum aestivum
  Clone ID: PAT_TA_101921.pep
MIKVAAPEVQQPQAVAAAEAVSAVVPEATIFRSKLPDIDIPSHLPLHEYCFARAAELPDAPCLIAAATGRTYTFAETHALCRKAAAALHRLGVGHGDRVMILLQNCVEFAVAFFGASFLGAVSTAANPFCTPQEIHKQLVASGAKMIVTQSPYLDKLRHESFPRISTSGGDNPLTVITLDNKAAPPNGDCLLGGHWTPIRLRSAVLYLRDTHTIKSNNKWIISIHSILSTSLICLSTLTE

SEQ ID NO: 207504 - protein, 72 aa, Triticum aestivum
  Clone ID: PAT_TA_101922.pep
TRYVPWSFHIQKRCSKKPPAQRSILILTAVQASSELYNHCNMCSITLAKSSVQKCVPSVMTMCNTSVKISQI

SEQ ID NO: 207505 - protein, 175 aa, Triticum aestivum; identical to SEQ ID NO: 115797
  Clone ID: PAT_TA_101923.pep

SEQ ID NO: 207506 - protein, 175 aa, Triticum aestivum
  Clone ID: PAT_TA_101924.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGHA

SEQ ID NO: 207507 - protein, 250 aa, Triticum aestivum
  Clone ID: PAT_TA_101925.pep
TRFLLTGSAGDADRLHRLLLATYHPRNLYLLLLDRAAPASDRVRLAREVRAGPGRAGNVHVVGDPGFANPRGASALAAALHGASLLLRLGQGWDWFVHLDAGDYPLVTPDDLLHVLSYLPRDINFIQHTSYIGWKESRHIRPIVVDPGLYLSSRTDIFYATQKRELPSAYKLCTGSSSDILSRELTESCIGWTNNLPRTMLMGYTNMTLGTQEDLQRVYAIHVGEQTVYTLICPLGFDGRTRRARCDLRS

SEQ ID NO: 207508 - protein, 261 aa, Triticum aestivum
  unsure (1)..(261): unsure at all Xaa locations
  Clone ID: PAT_TA_101926.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWAWQVVLMGAVEGYRVAGXPLGEIVDPLYPGAAFTPWPRREPKARTQGKESNRRSPVLMLGFRAGSHGRAPETLHTCDPNTRWAAQLSRSTLVLHIMLNV

SEQ ID NO: 207509 - protein, 282 aa, Triticum aestivum
  unsure (1)..(282): unsure at all Xaa locations
  Clone ID: PAT_TA_101927.pep
MLSLLPPARLRAAPSDASVTLPRRPAVILPGLGNNTGDYARLAAALRDGHGVPSVVARVSRPDWLRNAAGLADPSYWRGTLRPRPVLDWYLNRVEEAVSEARELSSPDGKLSLIGHSAGGWLARVYMEEFGTSDISLLLTLGTPHLPPPKGVSGVIDQTRGLLNYVEKNCXPAVYTPELRYVCIAGXYIXGAPLTGNXLATTTDELVGVDAPSEVAEAVMASADDHKPVRQAHLPAPFVGQATNRFGQPQSLGDGGSPRAAHLRGTDLTSTGDHLLRFDIKR

SEQ ID NO: 207510 - protein, 175 aa, Triticum aestivum; identical to SEQ ID NO: 115797
  Clone ID: PAT_TA_101928.pep

SEQ ID NO: 207511 - protein, 253 aa, Triticum aestivum
  unsure (1)..(253): unsure at all Xaa locations
  Clone ID: PAT_TA_101929.pep
MAAQGLLSGRQLLGRPLQSSISRSSSSRKSPFVVRASSSPPAKQNDNRQLWFASKQSLTYLDGTLPGDFGFDPLGLSDPEGTGGFIEPRWLAYGEIFNGRTAMMGVVGMIAPEALXKVGLVPPETAIPWIQTGSIPPAGTYQYWADPYTLLLCEMALIRFSEHQRVHDXYNPGSMGKQFFLSLEKYLRGSGDPATPGAHLLPLRFGPKTKKDEGPKLKRSKLPLSMSPPCMSSSFFPGRPCKLLTTLTLKKLF

SEQ ID NO: 207512 - protein, 222 aa, Triticum aestivum
  unsure (1)..(222): unsure at all Xaa locations
  Clone ID: PAT_TA_101930.pep
EPSRFPPFSPLATSPSLSLSCYLAGPHSSLFPSLSHSLCRVSLCVRLYFLLILALSLFHLLFFFPLCRTLLTLFCISTVYPDMAVCFSPFVHESSLFELVLSRPSARTLLSWRCPPLRALSLFLFFRVRVPRISLFPPSGGPPLFSFFRVSPAPFPYRRGXYLQARSLCRSPLXPSLSFFTPHPPPFFPLPAXSVFFFXGIPPTLFFFFLPFIFSPLNFPFS

SEQ ID NO: 207513 - protein, 78 aa, Triticum aestivum
  Clone ID: PAT_TA_101931.pep
MSCCGGNCGCGTACKCGNGCGGCNMYPEVEAAGATLLVSATATHKASSGRMEMAAENGGCGCTQCKCGTSCGCSCCSC

SEQ ID NO: 207514 - protein, 211 aa, Triticum aestivum
  unsure (1)..(211): unsure at all Xaa locations
  Clone ID: PAT_TA_101932.pep
ARAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPXLENLADHLADPVNNHACAFATNFFPASERRQLKL

SEQ ID NO: 207515 - protein, 172 aa, Triticum aestivum
  unsure (1)..(172): unsure at all Xaa locations
  Clone ID: PAT_TA_101933.pep
FPCSLLDGSGKSIQQLYLNNCALRPTVALGRLRSLTSLNFXYVRITENELRCLFSSSIALEKLTLRSCDELFFLEIPSLLQQLSHLVVEECRNLEVIKSKAPHLYSFGYRGTLVRLSLGDSLQNLYIDASDQDVVHHACADLLDVVPNLEALEISSYYPMDTLVVPGKFLLV

SEQ ID NO: 207516 - protein, 282 aa, Triticum aestivum
  unsure (1)..(282): unsure at all Xaa locations
  Clone ID: PAT_TA_101934.pep
ARESESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEAHYNTARGVQKVLQNYKNLQDIIAILGMDELSEDDKLTVARARKIQRFLTXPFHXAEFYRRTWKLLSLRGVQVPGVLMGIQYLQTASTGGDKEVLQVKDARNLVKLLFNTCITFGAPWLYCDQM

SEQ ID NO: 207517 - protein, 175 aa, Triticum aestivum; identical to SEQ ID NO: 115797
  Clone ID: PAT_TA_101935.pep

SEQ ID NO: 207518 - protein, 203 aa, Triticum aestivum
  unsure (1)..(203): unsure at all Xaa locations
  Clone ID: PAT_TA_101936.pep
ARAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPLENLADHLADPVNNHAWAFATNFXPRK

SEQ ID NO: 207519 - protein, 203 aa, Triticum aestivum
  Clone ID: PAT_TA_101937.pep
ARAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPLENLADHLADPVNNNRWGLRTNFVPGK

SEQ ID NO: 207520 - protein, 203 aa, Triticum aestivum
  unsure (1)..(203): unsure at all Xaa locations
  Clone ID: PAT_TA_101938.pep
ARAPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFDPLGLAEDPEAFAELKVKEIKNGRLAMFSMFGFFVQAIVTGKGPLENLADHLADPVNNNAWAFATNFXPRK

SEQ ID NO: 207521 - protein, 294 aa, Triticum aestivum
  Clone ID: PAT_TA_101939.pep
ARETDYWAIDPETNPDLVTVERVWQCQGRLLSSDVDGGETMPAALKHKDLCLSFALFKLLRRRLGRYPLHESCLNKTRDLVKLGLLAGDDHERVYRVVEVELGFLFDFYYARYRSPKETLILDTLLFATVAATSLCTLFSLAALDHRAQQRQAYPDTVTTVFDIWLTRMMIVLFLILESLQYFTLVFSDWHKVKVLCRYVLNEAWHNSPFLERILAFICRVKLTPYWNNSLGQHSLLHACHRYEQGRLRRVWGLELPGRIAGFSSGTGDGSPNCPGEKPSSFLRPGDADQTQSP

SEQ ID NO: 207522 - protein, 98 aa, Triticum aestivum
  Clone ID: PAT_TA_101940.pep
HEIFLTVFGYSFLNGSVCKGHVGEARSKDFVVEIWSGMETLGDMLLGAKKICTCQFPVISFSPCLIALTCNFTLCPCTNFNLCQKPKRRKCLNLLLAS

SEQ ID NO: 207523 - protein, 175 aa, Triticum aestivum; identical to SEQ ID NO: 115797
  Clone ID: PAT_TA_101941.pep

SEQ ID NO: 207524 - protein, 175 aa, Triticum aestivum
  unsure (1)..(175): unsure at all Xaa locations
  Clone ID: PAT_TA_101942.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDXMRQVQCVSFIAFKPPGCEESGKA

SEQ ID NO: 207525 - protein, 148 aa, Triticum aestivum
  unsure (1)..(148): unsure at all Xaa locations
  Clone ID: PAT_TA_101943.pep
VPGRPIPRSKGRLKSLKGGRIGESGGPIRAQKVKTRFSCHPSPRAPLEQVEHLIRSKGXPSLKFSKVGFVFREPKSSPGYNDGRXWTMWKLPMLGGPDPTQVLKEVEEVKKESPDANVGVMGFDTLRQGQGVSFIPFSPPGCKEFGKP

SEQ ID NO: 207526 - protein, 213 aa, Triticum aestivum
  unsure (1)..(213): unsure at all Xaa locations
  Clone ID: PAT_TA_101944.pep
MAAAFSSTVGAPASTPTNLLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAIMDKLVVHLSKNFMTLPNIKSPLILGIWGGKGQGKYFHCELVFTKMGINPIMMSAGELESGXAGEPPSSKAADREVETDQEVRCAAL

SEQ ID NO: 207527 - protein, 189 aa, Triticum aestivum
  Clone ID: PAT_TA_101945.pep
RGREIHGGDGVPLLRGRPRLGHRRQQPPAGLQPVRRDPRRQDHQRPRDGEVPWVRLRHVRQRGVDAPGHRGDERQGARRAQHHRQRGPVPPLRRRGRPLRLPTVTRLQRSSTRTCGRYRCHDDALTVRALPHFLHALTARPCFRAGPIGTLLPAPVELLSIDSFQPVFIIFQLTVTLSKSSIRRVRTHC

SEQ ID NO: 207528 - protein, 169 aa, Triticum aestivum
  unsure (1)..(169): unsure at all Xaa locations
  Clone ID: PAT_TA_101946.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGGYGGXAGGCFGQGGGGCXAQAGGGYGGHLGGRWLPMTVAVASRWSALVATPGCPLEVL

SEQ ID NO: 207529 - protein, 175 aa, Triticum aestivum
  Clone ID: PAT_TA_101947.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGQA

SEQ ID NO: 207530 - protein, 227 aa, Triticum aestivum
  Clone ID: PAT_TA_101948.pep
MLMKIGCDACGQAEATVLCCADEAALCRRCDAAVHSANKLAGRHHRVALLSSAPAGSSSPGAGDDGGTHPACDICQEKTGHFFCVEDRALLCRSCDVAIHTATPHASTHHRFLITGVRVGVDQDHIGDVSGATVGSPSNSSANGSNSMPTSENFAIANGQRSEEGAGLIGGGEDDIGQQQQWPWSDIFADDGVGMDNTSAPWLSDLVPQLLMMKLTKGLLRLHSILV

SEQ ID NO: 207531 - protein, 184 aa, Triticum aestivum
  Clone ID: PAT_TA_101949.pep
AIRALATQLPAFRQKLSDGWYQVRIAGRDVSTSGLTAQLHETLPDGAVIHIVPRVAGAKSGGVFQIVLGAAAIAGSFFTAGATLAAWGAAIGAGGMTGILFSLGASMVLGGVAQMLAPKARTPRIQTTDNGKQNTYFSSLDNMVAQGNVLPVLYGEMRVGSRRGSQEISTVDEGDWGQVEEIGH

SEQ ID NO: 207532 - protein, 182 aa, Triticum aestivum
  Clone ID: PAT_TA_101950.pep
FRPRGGMEYECAPKARTTTRHHSGAITPTTSERNGPKNARERLSREAEKAKGQMVISRMPNTWAKWVHQTGLHETKKWPLESPHLQLWLKRYEVFSARDPSVMKKLQNLGMHRKTQSAFRFNTFSVKENGSPAAEERNTLSGRENVLSIKERKNMISSEENVLWEIRFHLTTWTVARSGVGR

SEQ ID NO: 207533 - protein, 155 aa, Triticum aestivum
  unsure (1)..(155): unsure at all Xaa locations
  Clone ID: PAT_TA_101951.pep
TDNPSFGNRTSFRPSVPTRGSTGKLTCCPWTTPFGLILGHDSPSVDEPCGGNLGFSGHWILTNVFVTQADILASASSTPAFAVASXKAERSPTDXILTSHSFGRSLSPVHLQRKGARSVSYYALFKGWLLLGKPPGCLCTPTSFITERSFRGLSW

SEQ ID NO: 207534 - protein, 122 aa, Triticum aestivum
  unsure (1)..(122): unsure at all Xaa locations
  Clone ID: PAT_TA_101952.pep
EEEAMKKTCKRTEKEGRREEARRGQKEKGGEKMRNVQANKVGQRGVTKDAKEKGGEGKRKSERENEREXDPQKDIVGKRGGEEKKSIRQNRKQRERTEKTHAKHTEYRERKIQRQGWIASSE

SEQ ID NO: 207535 - protein, 120 aa, Triticum aestivum
  unsure (1)..(120): unsure at all Xaa locations
  Clone ID: PAT_TA_101953.pep
MAAAFSSTVGAPASTPTNFLGKKLKKQVTSAVNYHGKSSKANRITAMAXENLDYKRNTDKGKGIAPHISNDHDDVTTRKAIVALILTNAPRLRCVVGLYNILKFHPPLTLQRQLDGQRDV

SEQ ID NO: 207536 - protein, 199 aa, Triticum aestivum
  unsure (1)..(199): unsure at all Xaa locations
  Clone ID: PAT_TA_101954.pep
MTVFRGPPGRPSALVSWWRRRPPLGFAAKVSIAIALGLSFVVTWTTLAPTSSSQQISTERTYFAADVADPPPGALAPPRNATARAVHRKPRPASPRARKKRRAPPGSRRPNATPSPDAAALRSNLTDPDARPEPEQPNKPKPEWEWEDKQEPELSVPEDDADATGKXAQEEENDDRAPALDGPTNPRAGAQEERTRAPR

SEQ ID NO: 207537 - protein, 191 aa, Triticum aestivum
  unsure (1)..(191): unsure at all Xaa locations
  Clone ID: PAT_TA_101955.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPXYYDGRYWTMWKLPMFGCTDATQVINEVEEVKKEYPDAYVRIIGFDNMRQGQCVSFIAFKPPGCEESGKATAHSPRATYKVPLCQL

SEQ ID NO: 207538 - protein, 294 aa, Triticum aestivum
  unsure (1)..(294): unsure at all Xaa locations
  Clone ID: PAT_TA_101956.pep
MADRHIIIIVFASILSAMAVVGIVFIWTRMRPRRDYLHDDMDGSGEIIRTIMSSQLGFRYEELRKATDDFNQINKLGQGGYGSVYKGVLPDGREIAVKRLYLNTRQWTDQFFNEVKLVSQVQHKNLVKLLGCSVEGPESLLVYEYLCNTSLDHYLFDAFKKNALDWERRSEIVLGAAEGLSYLHSGSEVRIIHRDIKGQHVMLDERFXPKIGDFGLARNFMEDQTHLSTGLAGTFXYMAPEYIVHGQVTXKGXLYSYGVLVLENRTGRRTTLRGVSARGCPMYSIEALTPDPLE

SEQ ID NO: 207539 - protein, 138 aa, Triticum aestivum
  Clone ID: PAT_TA_101957.pep
ARGEREREREREREREREREREREREIERERERERERERERERDRGGVPFPIFLFLCRIPLPCPLFFCVVTAHTPLFPLLLLFLRISLSASVCICVYARSFLSSLSFFFLLCAWLLVCLYIFLYFTFIFCCICSFLSQ

SEQ ID NO: 207540 - protein, 150 aa, Triticum aestivum
  unsure (1)..(150): unsure at all Xaa locations
  Clone ID: PAT_TA_101958.pep
TRRERERERERERERERERERLSSSFVDLLRDHFLDIDRARXLFFSRDCVSLPGRLPVASGGIPVWLLPALTRIFGDHSLSLSGGGAVGHPWGYAPGASATPVGFEACVQARNDGRDLSLQGGDIXRASCSWSPELSPACEVWRAILFEF

SEQ ID NO: 207541 - protein, 72 aa, Triticum aestivum
  Clone ID: PAT_TA_101959.pep
INQPQCDCHSGPLHVPAPGRKASIDTLAQYSTTGAPSAGWYGDCTCLNPLTAPTGCVIGSTGIYQKLLHACS

SEQ ID NO: 207542 - protein, 132 aa, Triticum aestivum
  Clone ID: PAT_TA_101960.pep
MGQGRRPAGAGSSGRGRTRRCGRRRRRGRGTAGARGWRAAAAGSGRGGGGGSSRRRAGRGRRAARHAAAGSRAARRAAAGSRAARHAAAAAGGGGGGGRAARGRGSRRRPGAGSAPTWQPPRRRGKGRGGSC

SEQ ID NO: 207543 - protein, 175 aa, Triticum aestivum; identical to SEQ ID NO: 115797
  Clone ID: PAT_TA_101961.pep

SEQ ID NO: 207544 - protein, 175 aa, Triticum aestivum
  Clone ID: PAT_TA_101962.pep
MAPTVMASSATSVAPFQGLKSTAGLPVSRRSNGASLGSVSNGGRIMCMQVWPIEGIKKFETLSYLPPLSTEALLKQVNYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 207545 - protein, 212 aa, Triticum aestivum
  unsure (1)..(212): unsure at all Xaa locations
  Clone ID: PAT_TA_101963.pep
TRHHKPKVLLDKIAYWTVKSLRVPTDIFFQRRYGCRAMMLETVAAVPGMVGGMLLHLRSLRRFEQSGGWIRALLEEAENERMHLMTFMEVAKPKWYERALVLAVQGVFFNAYFLGYIVYPKFAHRVVGYLEEEAIHSYTEFLRDLXAGRIENVPAPRIAIDYWRLPADARLKDVVTVVRADXAHHRDVNHFAADMHFQGLELNKTPAPLGYH

SEQ ID NO: 207546 - protein, 217 aa, Triticum aestivum
  Clone ID: PAT_TA_101964.pep
HEDSPAYEYPNQQPPGNLWYHDHAMGLTRVNILAGLLGAYRVADPAAEAPLGLPSGAEFDRNLVLFDRDFRSDGALFMNATGNNPDVHPQWQPEYFGAVVVANGKAWPFLRVRRRRYRFRILNASNARFFRLSLSGGLRFVHVGSDSVYLARPLPTEGFLLAPSEIADVVIDFAGAKHDAVTLRSDAPAPYPGDPGEKGDTGAVMKIGGASNPDTTR

SEQ ID NO: 207547 - protein, 78 aa, Triticum aestivum; identical to SEQ ID NO: 106952
  Clone ID: PAT_TA_101965.pep

SEQ ID NO: 207548 - protein, 176 aa, Triticum aestivum
  unsure (1)..(176): unsure at all Xaa locations
  Clone ID: PAT_TA_101966.pep
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKNEYPDAYVRVIGFDNLRQVQCXVSFIPFTPPGCEESRKA

SEQ ID NO: 207549 - protein, 175 aa, Triticum aestivum
  Clone ID: PAT_TA_101967.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIGFKPPGCEESSEA

SEQ ID NO: 207550 - protein, 223 aa, Triticum aestivum
  Clone ID: PAT_TA_101968.pep
MAETEYRCFVGGLAWATDDNNLQQAFSQYGEILDAKIINDRETGRSRGFGFVTFGSEESMRQAIEEMNGKELDGRNITVNEAQSRRSGGGGGGGGYGGQRGGGGGYGGGGGGYGGQGGGGYSQGGGGGYGQGGGGYRGQRGGGGYGGGGGGYRGGCGGSRGHLVATTGDRGRTDRAASTVKFFLAPAPCTLSARRSNTWGPVSHPLDTWRRTENKETRSVSFR

SEQ ID NO: 207551 - protein, 284 aa, Triticum aestivum
  unsure (1)..(284): unsure at all Xaa locations
  Clone ID: PAT_TA_101969.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPRGSFDPLGLADDPEAFXELKVKEXKNXXLAMFSMFGFFRQGIVTGRALXNLADHLPTLNNNAGPCPNFCPQVPVGFGLSETTCPSTSPQGALF

SEQ ID NO: 207552 - protein, 90 aa, Triticum aestivum
  Clone ID: PAT_TA_101970.pep
HEVFSTYPPVSVSGTGTLLLKVVRAFPGSMASVTYFSAVAPGMSLVEKQSLVHGAHTSALQRLVLGPRLEAFSLPLLTLKKQGHLVSLNL

SEQ ID NO: 207553 - protein, 96 aa, Triticum aestivum
  Clone ID: PAT_TA_101971.pep
QHNACIALPQPRFHGLGCSHFARRYYGNRFCFLFLWLLRCFSSPGCLLPAHGFSRQFKRLTYLGISGSMLIFNSQKHFVACYALPRLWVPRYPPPR

SEQ ID NO: 207554 - protein, 175 aa, Triticum aestivum
  unsure (1)..(175): unsure at all Xaa locations
  Clone ID: PAT_TA_101972.pep
MAPTVMASSATSVAPFQGLKSTAGLPVSRRSNGASXGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 207555 - protein, 175 aa, Triticum aestivum
  Clone ID: PAT_TA_101973.pep
MAPTVMASSATSVAPFQGLKSTAGLPVSRRSNGSCLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 207556 - protein, 164 aa, Triticum aestivum
  Clone ID: PAT_TA_101974.pep
SVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 207557 - protein, 175 aa, Triticum aestivum
  unsure (1)..(175): unsure at all Xaa locations
  Clone ID: PAT_TA_101975.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPXYYDGRYWTMWKLPMFGCTDATQVINEVEEVKKEYPDAYVRIIGFDNMRQVQCVSFIAFKPPGCEESGQA

SEQ ID NO: 207558 - protein, 175 aa, Triticum aestivum; identical to SEQ ID NO: 115797
  Clone ID: PAT_TA_101976.pep

SEQ ID NO: 207559 - protein, 175 aa, Triticum aestivum; identical to SEQ ID NO: 115797
  Clone ID: PAT_TA_101977.pep

SEQ ID NO: 207560 - protein, 113 aa, Triticum aestivum
  Clone ID: PAT_TA_101978.pep
PDILACRSTEPLEEHVTTKLSQFCNVPIPNIVNLHDVTNIWHIPLLLRDQKAHEAILKVLDLQLVGKVHREPKLSEWTERASKFDKLKTPVKIAMVGKYTGLSDSYLSVLKAL

SEQ ID NO: 207561 - protein, 61 aa, Triticum aestivum
  Clone ID: PAT_TA_101979.pep
DSSRHRKITMAAGHRSSGQKSPPKTLLNQPRRSHRTDKGKTRHDTRLSYLDRRHGTRGDDD

SEQ ID NO: 207562 - protein, 64 aa, Triticum aestivum
  Clone ID: PAT_TA_101980.pep
KKPIAMTHQSNAPAIIFACCFKSISCFSCVPIFFNSHFTSALPIIGSALSTKYEACSTPSFPPK

SEQ ID NO: 207563 - protein, 82 aa, Triticum aestivum
  Clone ID: PAT_TA_101981.pep
LLLLLLTEPLLLLLLLLLRAGAIHLLRLRPDRNTGGRRARANRSTDRRIGSNRSIDLVANFSRRIEQGNGGRGGEIFPRIFS

SEQ ID NO: 207564 - protein, 46 aa, Triticum aestivum
  Clone ID: PAT_TA_101982.pep
MKGGTVPTWLELLLATQFCAIGTNHLFSNRNECNRCGIDCEESKGA

SEQ ID NO: 207565 - protein, 111 aa, Triticum aestivum
  Clone ID: PAT_TA_101983.pep
VSTNEHQHDDNPMDATSPLLLIHYTSSSTIYNSEELKKYLKKFSLPAPCVSDPTHLPPTTPSPPSLPPPYKVAEATSTTSSTTVSTNPRAERAEAESRQHNGRGVAAPVRH

SEQ ID NO: 207566 - protein, 94 aa, Triticum aestivum
  unsure (1)..(94): unsure at all Xaa locations
  Clone ID: PAT_TA_101984.pep
IPEQSQCQAIHNVVHAIILHQQQKQQQQPSSQFSLQQPLQQYPLGQGXFRQSQQNPAAQGSVQPQQLPQFEEIRNLXLQTLPAMCNVYIPPYCT

SEQ ID NO: 207567 - protein, 59 aa, Triticum aestivum
  Clone ID: PAT_TA_101985.pep
GIPHSSGVLGNKWTAELPRGEGGNSSKYPSSRKNVDPLPGMRQRSNLQATFELKFHPAS

SEQ ID NO: 207568 - protein, 52 aa, Triticum aestivum
  Clone ID: PAT_TA_101986.pep
LTDAKSIPYNRESSSPRRDPGIQLKMDTRGGPTQPAQTKPNPHADADRRTPV

SEQ ID NO: 207569 - protein, 74 aa, Triticum aestivum
  Clone ID: PAT_TA_101987.pep
MFGFGHTTRTRRRSGPNQIFKIYCRASEDYCLAVRRVLAPVNPKDETQHWLKDMRFRPPSRRGGHAAFALVNKA

SEQ ID NO: 207570 - protein, 107 aa, Triticum aestivum
  unsure (1)..(107): unsure at all Xaa locations
  Clone ID: PAT_TA_101988.pep
APPAATKAKFRSRRRRGAGEGENGPYEADRPQVHRWQGPRKQLATKGRGSQRXHGQLKKPHRYRPGTVALREIRKYQKSTXLLIRKLPFQRLVREIAQDFKTDLRFQ

SEQ ID NO: 207571 - protein, 62 aa, Triticum aestivum
  Clone ID: PAT_TA_101989.pep
NSFFIGCSSGLIPEHLSRTEKREFAAWATARIARARCRGGSSATASGSSAPRRASRRVGPPR

SEQ ID NO: 207572 - protein, 58 aa, Triticum aestivum
  Clone ID: PAT_TA_101990.pep
TMSSVDMESSWSVSDESSTAIAAAPASGAGVGEDDMALCCGLCGSEGEGRRRFVGGCG

SEQ ID NO: 207573 - protein, 82 aa, Triticum aestivum
  Clone ID: PAT_TA_101991.pep
RPRSWGTSTAASSVAVFRRSSSDWVDLELQSTSHRGVPHFLLSMQSTVKAKGLAVPGASEAAGFKGWRGFGYLGGQRRGIRG

SEQ ID NO: 207574 - protein, 120 aa, Triticum aestivum
  Clone ID: PAT_TA_101992.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTT

SEQ ID NO: 207575 - protein, 64 aa, Triticum aestivum
  Clone ID: PAT_TA_101993.pep
RRIPAAARLQPLHHRAPELVRQAGQDTMHTLDLVFPLGHHAYSIFTFPSPACITFSLSIRCNQQ

SEQ ID NO: 207576 - protein, 45 aa, Triticum aestivum
  Clone ID: PAT_TA_101994.pep
LSTRPFPSLRRRRVPLATTAGDRRRAGSEVSAHLIAIPVALSRAL

SEQ ID NO: 207577 - protein, 47 aa, Triticum aestivum
  Clone ID: PAT_TA_101995.pep
LGRPTIDVVVNCSGVFRHLSINQMNLLDRAVKMVAELHEPIEMNYVR

SEQ ID NO: 207578 - protein, 53 aa, Triticum aestivum
  Clone ID: PAT_TA_101996.pep
MANTLRLYLTCIRNTLDAAMCLHNFPCQDVERHNKPDVELKTSPELLLNPVLI

SEQ ID NO: 207579 - protein, 130 aa, Triticum aestivum
  unsure (1)..(130): unsure at all Xaa locations
  Clone ID: PAT_TA_101997.pep
MKTFLVFALLTVAATSAIAQMETRCIPGLERPWQQQPLPSQQTFPQQPLFSQQQQQXLFPQQPSFSQQQPPFWQQQPPFXLQQPMLPQQPPFSQQQQLVLPQQPPFSQQQQPVLPPQQSPFPQQQQQHQQ

SEQ ID NO: 207580 - protein, 50 aa, Triticum aestivum
  unsure (1)..(50): unsure at all Xaa locations
  Clone ID: PAT_TA_101998.pep
MASKRILKELKDLQKDPPTSCSAGPVXEDMFHWQATIMGPSDSPFTGGLF

SEQ ID NO: 207581 - protein, 70 aa, Triticum aestivum
  Clone ID: PAT_TA_101999.pep
THYYNTLLSSSSHKGHTDRQTDRQTTLFFLFLTTQTTTNSTEFLPPYYIYNRQTDRHMHALGVGSGSRIA

SEQ ID NO: 207582 - protein, 92 aa, Triticum aestivum
  Clone ID: PAT_TA_102000.pep
RRPTLWTHLGAWPGAVHCVQDYRSEEDRIFSACKSRVMSVSIDDIGRCYIYVHCIDMYVNYVKIKVWVLVYVSIFGRKLELDRSSCDSCSPG

SEQ ID NO: 207583 - protein, 34 aa, Triticum aestivum
  Clone ID: PAT_TA_102001.pep
LYSSTFCSLQTADLLKVQNPKPINIVPSHSYSSK

SEQ ID NO: 207584 - protein, 87 aa, Triticum aestivum
  Clone ID: PAT_TA_102002.pep
ATPPARSAAAPPPTPSTMRPTQAAPAAAARRGGARARARRVTRDGGRAQLRSAHHQSTAQLAHGGRTCASASAKLQSNNVLRHTTSS

SEQ ID NO: 207585 - protein, 118 aa, Triticum aestivum
  Clone ID: PAT_TA_102003.pep
MKTFLVFALLAVVATSAIAQMETSCIPGLERPWQQQPLQLKETFPQQPPSSQQQQPFPQQPPFLQQQPSFSQQPLFSQKHLPVLPQQPAFSQQQQTVLPQQPAFSQQQHQQLLQQQIP

SEQ ID NO: 207586 - protein, 73 aa, Triticum aestivum
  Clone ID: PAT_TA_102004.pep
GQEAGRVRAGLLCRSVACPGEGRRAALEMFDVPRSSFDVVSSVYRVVGGMFWFIYRREVCGLGYHSNVYFRAG

SEQ ID NO: 207587 - protein, 77 aa, Triticum aestivum
  Clone ID: PAT_TA_102005.pep
IAHDAAVSVSARYHQIRASDLYVSELCNLAWSGCKRMPSSRVQYGSWCGPGHLAQRSTSDVRGIYRWIFLYQKDHLP

SEQ ID NO: 207588 - protein, 117 aa, Triticum aestivum
  Clone ID: PAT_TA_102006.pep
EQDPLLFSWLIYTAGHLLCFLHKCSRSHTSYVLCLTPPVSCVCQLLGACIVIDGRRKQASAAAAGGGAEAHERGQDDDDEGLVGGRRWRGRTVVGVRGRRRRRPQPPFMEGHAVRHR

SEQ ID NO: 207589 - protein, 72 aa, Triticum aestivum
  Clone ID: PAT_TA_102007.pep
SSGGMAYYYLHGHTCLHRLKKLRNTRFGKFIKTVRPKNNFTQRDNSPSSISGSRCSALNFPEHPSPASASPS

SEQ ID NO: 207590 - protein, 54 aa, Triticum aestivum
  Clone ID: PAT_TA_102008.pep
IFKGIHIYHAAVEFTSNGSDRIDWNLKNVLSRMHVTTTPLVVPYSVHASLLSIN

SEQ ID NO: 207591 - protein, 29 aa, Triticum aestivum
  Clone ID: PAT_TA_102009.pep
DRQHSSQHSCTYIARKTTELVLGSITPFH

SEQ ID NO: 207592 - protein, 36 aa, Triticum aestivum
  Clone ID: PAT_TA_102010.pep
AKITQHKYFWNSSRSVIISHTDISIFWCHDHLSLRI

SEQ ID NO: 207593 - protein, 110 aa, Triticum aestivum
  unsure (1)..(110): unsure at all Xaa locations
  Clone ID: PAT_TA_102011.pep
MAATKIRWGELDEDDDGGDLDFLLPPPVVVGPDANGLKKTIHYRFDDDGNKVKVTTTTRVVKLARTRLSKAAVERRSCAKXGDAATGDDASTRLTVVSTEEIFLERPRAP

SEQ ID NO: 207594 - protein, 65 aa, Triticum aestivum
  Clone ID: PAT_TA_102012.pep
GGSGRCPELRREEEAGDGACDCHDEEATSNIRPSSPDRDRSPPVYGGVATDPDDSAAPASCPAPG

SEQ ID NO: 207595 - protein, 72 aa, Triticum aestivum
  unsure (1)..(72): unsure at all Xaa locations
  Clone ID: PAT_TA_102013.pep
MAGTVPKLAAPRPAAAGPXPSQPLRAAAPAXALSARRFRVSLAGRARSPVIAMASAKEGNGAVTMRTTLHDL

SEQ ID NO: 207596 - protein, 114 aa, Triticum aestivum
  unsure (1)..(114): unsure at all Xaa locations
  Clone ID: PAT_TA_102014.pep
MAPKRGGKAPVPAKKKAADKVVNPLFEKRPKQFGIGGALPPXKDLHRFVKWPKVVRIQRQRRILKQRLKVPPALHQFTRTLDFFLATNLFKMLLKYRPEDKVAKKERLLKRAQA

SEQ ID NO: 207597 - protein, 152 aa, Triticum aestivum
  unsure (1)..(152): unsure at all Xaa locations
  Clone ID: PAT_TA_102015.pep
LIPSRKKNLPRAGDQSPSRCRSXVKTLTGKTITLEVESSDTIDNVKAKIQDKEGIPPDQQRLIFAGKQLEDDRTLADYNIQKESTLHLVLRLRGGMQIFVKTLFGKTITLEVESSDTIDNVKAKIQDKEGIPPDQQRLIFAGKQLEDGHTLA

SEQ ID NO: 207598 - protein, 113 aa, Triticum aestivum
  Clone ID: PAT_TA_102016.pep
EVLTLCFHQFCNKLATEWGRHSRGLLQTSRHLPTHCTSLCMSRSTRLRHEYNANLLLLATDMYPTCAASHGSLLARPSKGDGPAFCTWAVMAIPFILRSPGNGSASGRSCDCC

SEQ ID NO: 207599 - protein, 75 aa, Triticum aestivum
  Clone ID: PAT_TA_102017.pep
MGKTRGMGAGRKLKTHRRNQRWADKAYKKSHLGNEWKKPFAGSSHAKGIVLEKIGIEAKQPNSAIRKCARVQLVK

SEQ ID NO: 207600 - protein, 49 aa, Triticum aestivum
  Clone ID: PAT_TA_102018.pep
HRRQIFPQIINYMNEQASTHESARLYVHIFRIFKCQSVHFFRYLLLQLS

SEQ ID NO: 207601 - protein, 95 aa, Triticum aestivum
  Clone ID: PAT_TA_102019.pep
EIHLKSHGFLAGVTQIDRWLLLVLAGLKIVGGLGAGGLEDCRRLEIEKAQGGAGEDLGRWRGEGDRIAKGRGRGRRSAGGRAWGRRRRSRALVPI

SEQ ID NO: 207602 - protein, 46 aa, Triticum aestivum
  Clone ID: PAT_TA_102020.pep
RSGAVDKAGTEWVVVQWWMTSLLVSRGGGRGRCGCRIRSNAVDAAG

SEQ ID NO: 207603 - protein, 90 aa, Triticum aestivum
  Clone ID: PAT_TA_102021.pep
MSYPPPGTAYPPPGQQQPYPPPGNGYGYPPPGQEQQQQAYPPPAYGAPPPVAADYYQPKDGGAYPQQQQQAYGAPPPVAANYYPPPQQQQ

SEQ ID NO: 207604 - protein, 45 aa, Triticum aestivum
  Clone ID: PAT_TA_102022.pep
KAHRVVVNIWQFSLVFYYTSCQILIRAQQIGCCLLGDLDLSFNYP

SEQ ID NO: 207605 - protein, 60 aa, Triticum aestivum
  Clone ID: PAT_TA_102023.pep
LGKKKFVSVQTCLHRRIEANVPYVQVCINAPANSITYSANAPLLNPFEVLSGIEASHKEQ

SEQ ID NO: 207606 - protein, 50 aa, Triticum aestivum
  Clone ID: PAT_TA_102024.pep
HLRKHRRSYTPLSSHSFLHRDSCEYICLFCFSHIEQHMNFKLGSSTKHSY

SEQ ID NO: 207607 - protein, 128 aa, Triticum aestivum
  unsure (1)..(128): unsure at all Xaa locations
  Clone ID: PAT_TA_102025.pep
HEPQHPPFLQQQPSFXQQPLFSQKQQPVLPQQPAFSQQQQTVLPQQPAFSQQQHQQLLQQQIPIVHPSILQQLNPCKVFLQQQCSPVAMPQHLARSQMWQQSSCNVMQQQCCQQLPRIPEQSRYEAIR

SEQ ID NO: 207608 - protein, 51 aa, Triticum aestivum
  unsure (1)..(51): unsure at all Xaa locations
  Clone ID: PAT_TA_102026.pep
GMPNGLGFHPDHGWSQAVPPPAYLGHGEMEQCWWLVHQYXQPKVRSTGTSN

SEQ ID NO: 207609 - protein, 141 aa, Triticum aestivum
  Clone ID: PAT_TA_102027.pep
RFAVYNRSLWDTQLRGRFPRLFLLLTPRQRLLDVTLQRHHHAPLHRSGVHGHGVRPPSLPAELSEQRVERVPAGHEVLGDHRGQHPESVVRPAPVAQRAHHVRVRALPQRVPLAHHVVQYWPRAASTSPPRASACAIGSTC

SEQ ID NO: 207610 - protein, 96 aa, Triticum aestivum
  Clone ID: PAT_TA_102028.pep
MGMPGDDSRCRKHPPAPCGGVCPHCLCDRLLRLCPDCARTRPCPCASPSSPSSSASSASVGRVCSLIERERRIGRSRSVAGGVGADERRRSRVWGW

SEQ ID NO: 207611 - protein, 34 aa, Triticum aestivum
  Clone ID: PAT_TA_102029.pep
TRAQRWQRAAALGLAPPPHALCSDDQPCLWEGRV

SEQ ID NO: 207612 - protein, 100 aa, Triticum aestivum
  Clone ID: PAT_TA_102030.pep
AAPVHSNTGAQRHFFTSVTHQAKSKRSDTPAHNTNRLYIFIFEAPCISLAIPYLGAAEASSEVRRCCWLGFLHANLREKGRKQDGRVGKRRGWDGHKISC

SEQ ID NO: 207613 - protein, 53 aa, Triticum aestivum
  Clone ID: PAT_TA_102031.pep
PWVRLLMDDGVVESIDSLLNFDVPREVVGNMDIWSSDGMPMCGNFSEGSKPFI

SEQ ID NO: 207614 - protein, 86 aa, Triticum aestivum
  Clone ID: PAT_TA_102032.pep
MIACLKYGYRCFGNASGLILICLICCYAPGFHARLVAIIPFICLCLLVVHVDVGDGFRCMTAVCPEYRCYAVRYIQLVKCLDNGMV

SEQ ID NO: 207615 - protein, 66 aa, Triticum aestivum
  Clone ID: PAT_TA_102033.pep
HHHIHPRGPVGPVRQRRRLGRCRGRRRRSIVGRPLAYSIILAASDVPHIFGTCPPCLNRPCVYTDG

SEQ ID NO: 207616 - protein, 52 aa, Triticum aestivum
  Clone ID: PAT_TA_102034.pep
KCETGGGGRPGGVRHRSPHRVSYKIISGHFLEFRCRFIGQTKIETGFFGEKE

SEQ ID NO: 207617 - protein, 35 aa, Triticum aestivum
  Clone ID: PAT_TA_102035.pep
HEEIRNLALQTLPAMCNVYIPPYCTITPFGIFDTN

SEQ ID NO: 207618 - protein, 85 aa, Triticum aestivum
  Clone ID: PAT_TA_102036.pep
GHGKPVFSNIHLGLLLDLACLARVLLLVSSVQEQQLLFVVALLEKYKGLRSAFFFNEADHDLLHVLPCSLKHPSLFQIQLFSFWF

SEQ ID NO: 207619 - protein, 66 aa, Triticum aestivum
  unsure (1)..(66): unsure at all Xaa locations
  Clone ID: PAT_TA_102037.pep
PPLAAVLLSVVAAASASGSCVPGVAFRTDLLPHCRDYVXQQTCGTFTPGSKXPEWMTSASICSPMK

SEQ ID NO: 207620 - protein, 62 aa, Triticum aestivum
  Clone ID: PAT_TA_102038.pep
QSLQISSDPRFKVRKSLSSMASSSSGHENHEHGNGSSGPKVRNLTRILLYLLFSLFLSFLLN

SEQ ID NO: 207621 - protein, 114 aa, Triticum aestivum
  Clone ID: PAT_TA_102039.pep
AAAPGVNSPFVLAAARTQRKDPLDGLRYYTGGWNISSEHYWASVGFSAAPVFAAAGVWFAVFGAALFLAGCCYCCCSSRSTSYSRAALVVSLLLLLAFTAAAAIGCAVLYDGQG

SEQ ID NO: 207622 - protein, 77 aa, Triticum aestivum
  Clone ID: PAT_TA_102040.pep
TTKLVDQCASSIQRRAKSSPIECESLEKLQTLVYTLHQELTLCKLILEEDMTDRFERMRLSGIQKMTEAIYVMKNAR

SEQ ID NO: 207623 - protein, 98 aa, Triticum aestivum
  Clone ID: PAT_TA_102041.pep
HKGTPKKCLTTLRESVGSFFERHFGREVVDYLIDPFVAGTSAGDPESLSIRHAFPGLWNLEKKYGSLIVGAILSKLTAKGDSSKKGGASSGKGRSKRA

SEQ ID NO: 207624 - protein, 61 aa, Triticum aestivum
  Clone ID: PAT_TA_102042.pep
TRPAICDSFIRVHYQNPSDSIAQSKGDTRLLVIPTTPSSIFLPSPSLRAQPLMYRGYKKER

SEQ ID NO: 207625 - protein, 51 aa, Triticum aestivum
  Clone ID: PAT_TA_102043.pep
MDRRELRSYYKKIRSSFNIKNTYKVILLKKGVNLPSMFKILLSSPCLSHPF

SEQ ID NO: 207626 - protein, 57 aa, Triticum aestivum
  unsure (1)..(57): unsure at all Xaa locations
  Clone ID: PAT_TA_102044.pep
EHLDXQVSHVRLKKARTPAGELKYSQFHKXCISFVPLMIRGKAIREEPKVTIEFKYM

SEQ ID NO: 207627 - protein, 78 aa, Triticum aestivum
  Clone ID: PAT_TA_102045.pep
QQPSSQFSFQQPLQQYPLGQGSFRPSQQNPQAQGSVQPQQLPQFEEIRNLALQTLPAMCNVYIPPYCTIAPFGIFGTN

SEQ ID NO: 207628 - protein, 64 aa, Triticum aestivum
  Clone ID: PAT_TA_102046.pep
HHQGATPRRRDELIEAEVADLLRSAIPLSGNAGVYSKPEAKAWSVEGAVKWKNLAGYADIWDAS

SEQ ID NO: 207629 - protein, 65 aa, Triticum aestivum
  Clone ID: PAT_TA_102047.pep
KLEKRQQGRTLDSHIEEQFSGGRLLACISSRPGQCGRADGYILEGKELEFYMRKLQKKKGKGATA

SEQ ID NO: 207630 - protein, 50 aa, Triticum aestivum
  Clone ID: PAT_TA_102048.pep
LLCPKEKGALKPVIGEPSRTADGGNLKFAHLFCTLWRPEALVEDMDSMEP

SEQ ID NO: 207631 - protein, 38 aa, Triticum aestivum
  Clone ID: PAT_TA_102049.pep
IYVLQVQNKPMIGWVTTLLYHRILDIRGGRGTKINCGG

SEQ ID NO: 207632 - protein, 40 aa, Triticum aestivum
  Clone ID: PAT_TA_102050.pep
HHGISLPPHICGRNPLTTNFSNAGHLGTGYLWGANEEAGG

SEQ ID NO: 207633 - protein, 103 aa, Triticum aestivum
  Clone ID: PAT_TA_102051.pep
LAARNQLSQNTSLSGQVRDAYEGCLNDYATVRSSINRVANEMLPNCRFAGVADEFARGVKSLESCWIRLMRPPVKSTPLYNLVWADRYKLLLIHLLDGKLLGI

SEQ ID NO: 207634 - protein, 94 aa, Triticum aestivum
  Clone ID: PAT_TA_102052.pep
RSSSSLPAAMLTALPSSSEQMNLRSTQLQKRGRSLSCLLTLYIGYYYLLLYRSNLSFEMLVGLISRQQRIVSIYYLVHLGSSMWFNVGWARNNR

SEQ ID NO: 207635 - protein, 44 aa, Triticum aestivum
  Clone ID: PAT_TA_102053.pep
EGKMAPGVSRCYTGAMYAPRLLGRSIVSALVLQTNCGLLHFPNC

SEQ ID NO: 207636 - protein, 55 aa, Triticum aestivum
  Clone ID: PAT_TA_102054.pep
ASAVGADLAVMERDALRMREGGPFVFAQVKHGVGVEEIVDHVLRAWEIATGNRRR

SEQ ID NO: 207637 - protein, 36 aa, Triticum aestivum
  Clone ID: PAT_TA_102055.pep
SPSARGVGSRVVHPKLVRITCAVGYLTFVQMMPLSH

SEQ ID NO: 207638 - protein, 140 aa, Triticum aestivum
  Clone ID: PAT_TA_102056.pep
PCGRGALRLVLIAVSAAFLTYNVLLSSRSLLPLPTASFPAATTASSSSSSRRLASGRAGGTGGRRLFHTAVTASGSVYNTWQCRVMYHWFKQARRRAGGADMGGFTRILHSGRPDEFVHEIPTFVADPLPDGADQESLSR

SEQ ID NO: 207639 - protein, 20 aa, Triticum aestivum
  Clone ID: PAT_TA_102057.pep
VFGCCNALFMYLCEVTIVIH

SEQ ID NO: 207640 - protein, 96 aa, Triticum aestivum
  unsure (1)..(96): unsure at all Xaa locations
  Clone ID: PAT_TA_102058.pep
VLACFLAPCXPDAAYKVYWYWAAAPFRSPWWNAAACALEAASWVYRTAVFFMICVLFRVICYLQVLRMVGFAREFGRFADVAVVLEHHRRIRDQLR

SEQ ID NO: 207641 - protein, 97 aa, Triticum aestivum
  Clone ID: PAT_TA_102059.pep
PPPAPKPPPNPPKGPAPAPNPPCGPKPATPPPRGPPLTAPPKRPPSPPCSQQRRAWLRRNQHRLGCCDRQQEQRCRSRPPQACPCRPPPRRGTQEGG

SEQ ID NO: 207642 - protein, 94 aa, Triticum aestivum
  Clone ID: PAT_TA_102060.pep
FGTQHNIVLCIAKSSLLWKYRQPTSSSKQSNSERSSKQQQACGLTMWPGPKWSHVAAPQPSPATARMRKTGADKEKKAQEGNGSFSPCCSWQCL

SEQ ID NO: 207643 - protein, 41 aa, Triticum aestivum
  Clone ID: PAT_TA_102061.pep
FVAPVYRMEDVFLSVLTVVSALKPNWLLCNSYLLMVLKKKK

SEQ ID NO: 207644 - protein, 67 aa, Triticum aestivum
  Clone ID: PAT_TA_102062.pep
RRSGRAATVTSTLLASRAHGRAARPAMRGPRVSHRCESLLSRAGEEACVRACVRACKGQNDYTCSNV

SEQ ID NO: 207645 - protein, 35 aa, Triticum aestivum
  Clone ID: PAT_TA_102063.pep
HSRGNRDLLPKSNVSLHKSYVFVFWLVSEIKKELV

SEQ ID NO: 207646 - protein, 53 aa, Triticum aestivum
  Clone ID: PAT_TA_102064.pep
MLLVVTWPVTMALCFWLKNMAVSIYCLDIVSWCMYMSIYMFEFFCFVHTYLQK

SEQ ID NO: 207647 - protein, 50 aa, Triticum aestivum
  Clone ID: PAT_TA_102065.pep
FFLFSTLFLQFLISIRSKCFPSDVNHEETLVMDVEEDMASLQCCSSLVVE

SEQ ID NO: 207648 - protein, 85 aa, Triticum aestivum
  Clone ID: PAT_TA_102066.pep
IKVDMKAIIRMACDRVHLKCYSNVALLKGKLSKCFSQLKKSILQLLFTVWYRQSTCGHSTITNLNLLCSGSESNSTPKLQQPHCT

SEQ ID NO: 207649 - protein, 48 aa, Triticum aestivum
  Clone ID: PAT_TA_102067.pep
SCYFDISVKFVSGDGRHCLVCDVLYIELFMSCKFIIEAPICTRMQSVF

SEQ ID NO: 207650 - protein, 115 aa, Triticum aestivum
  unsure (1)..(115): unsure at all Xaa locations
  Clone ID: PAT_TA_102068.pep
DPQLQQPISQQQARXQQQQQQQQQQQQRQQILQQILQQQLIPCRDVVLQQLNIAHASSQVXQQSYQQLQQLCCQQLQQTPHQSRCQAIHNVVHAIILHQQQQQRQQQQPSSQFPY

SEQ ID NO: 207651 - protein, 37 aa, Triticum aestivum
  Clone ID: PAT_TA_102069.pep
FVALHMYLLSLGCDLSLLYCIVRFPLLKTHQLDRQKK

SEQ ID NO: 207652 - protein, 62 aa, Triticum aestivum
  Clone ID: PAT_TA_102070.pep
NSKTHFKLSKSICFLLLISMSHTFPCGILDYVFATIYQKTIGFVPTYLHGHISIELSYPIIC

SEQ ID NO: 207653 - protein, 57 aa, Triticum aestivum
  Clone ID: PAT_TA_102071.pep
HEFFFETNCTALLIFASISTFCSNTRMCSVCHRIGCNLSRDCKYCQLHGKALCTSRS

SEQ ID NO: 207654 - protein, 38 aa, Triticum aestivum
  Clone ID: PAT_TA_102072.pep
HAGHRAFSWTLSAAAAMKGGRGQRSGGLSGGEGGIRLR

SEQ ID NO: 207655 - protein, 43 aa, Triticum aestivum
  Clone ID: PAT_TA_102073.pep
CRAQCCTCSRLMHGAFLSAVIVSSCQCTYLSESRCRQSSNAVY

SEQ ID NO: 207656 - protein, 79 aa, Triticum aestivum
  unsure (1)..(79): unsure at all Xaa locations
  Clone ID: PAT_TA_102074.pep
DQAYSKRFQXKFKRRRQGKTDYRARLRLTNQDKNKYNTPKYRFVVRFTNNDVTAQIVYATIAGDIVMAAAYSHELPRYG

SEQ ID NO: 207657 - protein, 35 aa, Triticum aestivum
  Clone ID: PAT_TA_102075.pep
SPSASSMQEKSQHYLTCFPLQVKLGLLRALLEDVT

SEQ ID NO: 207658 - protein, 107 aa, Triticum aestivum
  Clone ID: PAT_TA_102076.pep
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKG

SEQ ID NO: 207659 - protein, 56 aa, Triticum aestivum
  Clone ID: PAT_TA_102077.pep
KKGSSSIYIRSQNEKICSELSEHNDQGDNVNSPAGDEHDLSTRKLNSYQAQLRAQK

SEQ ID NO: 207660 - protein, 78 aa, Triticum aestivum
  Clone ID: PAT_TA_102078.pep
KGLLPLAAWERLCRNLPSLATGWDGTLSQAATHHFTTNFCCVQSILLIQQDVQANPLDGARDESAKLGGLDITAARRK

SEQ ID NO: 207661 - protein, 43 aa, Triticum aestivum
  Clone ID: PAT_TA_102079.pep
IISRLVCFFFLIIDHVLHGQKKMLAFFWNKKICWASIEARPNS

SEQ ID NO: 207662 - protein, 176 aa, Triticum aestivum
  unsure (1)..(176): unsure at all Xaa locations
  Clone ID: PAT_TA_102080.pep
MGEPQFIIGTPMSDMLASMERDGRDPATLSLGSNYLLYFLYDYLPHPPVSPTAAHSLSGLPLVPDGVDRISRLPHMILRDIISRLPAKDAARTXALSSRWRPLWRAAPLSLVDSHLLQDGGAAGQFPIGVPSPRAVTAAVSHILAAHPGPFRCVHLTRSTMEEHRGEMSRWLDILV

SEQ ID NO: 207663 - protein, 143 aa, Triticum aestivum
  Clone ID: PAT_TA_102081.pep
MAGSAPHVMVLPFPAQGHVTPLMELSHRLVDHGFQVTFVCTDPIHKLLLDALQSNADGDNGGGEALDGIRLVSIPDGLADGDDRRDLCKFLDGISRCIPGYVEQLIRETKVRWLVGDANMRLCFEVAKKLGVRVACVFPASAA

SEQ ID NO: 207664 - protein, 204 aa, Triticum aestivum
  Clone ID: PAT_TA_102082.pep
LNSEGLLLPSKLIYLLISVVVFVSISCSLCIYFSLELAEWSTPRKMGKTEPVRKMAQPCHRCPPATPVGHQHRRGAPSRSSRGGEEDTPPDSLFTLWSVYNLFQCSTRCPSQQNLTCRCEILLASLTICFGRSNSTQKGQMICDYFFPTISLGTASQQINGIVGSVAMYAEYPLTIQDWILVYTSHPLSCSEIYNEICSGDDSG

SEQ ID NO: 207665 - protein, 137 aa, Triticum aestivum
  Clone ID: PAT_TA_102083.pep
LVELQRDEFIRGLINRKNSNDPEPATAERRVITRASLRKAEKDAGELKSPSHRFTSPVPTAKKRTFWDFGGESPSVLAGNGRKTRSHVAAETPTRAPSMLLQPGFTRRRAYQHWTLRRRMNAEDRHVHILLFFCQLC

SEQ ID NO: 207666 - protein, 93 aa, Triticum aestivum
  Clone ID: PAT_TA_102084.pep
MRECISIHIGQAGIQVGNACWELYCLEHGIQADGQMPGDKTVGGGDDALNTFFSETGAGKHVPRAVFVDLEPTVIDEVRTGAYRQLFHPEQLI

SEQ ID NO: 207667 - protein, 144 aa, Triticum aestivum
  Clone ID: PAT_TA_102085.pep
MGNYLTSRITAEKHVHVKTLKNSKGRPDVKFHDLPEDVLCAILSKLPVKEAVRTSVLSTDWRCTWTACPRLSFGVNDVCKNVKMKHQHTQMFIDRVNAALGKHCGRVVDQLEIKFIFESKLVDHLNNWIRFAMSTHAKNLAFDL

SEQ ID NO: 207668 - protein, 63 aa, Triticum aestivum
  Clone ID: PAT_TA_102086.pep
QLWESIQFSSLLLVSTDKATYISKRKPNLRSIFPYSYKLTHVNYILHCISLAALMMAVVHMNP

SEQ ID NO: 207669 - protein, 48 aa, Triticum aestivum
  Clone ID: PAT_TA_102087.pep
MALANLNTVEYPSLKLDIVRDGGTGESTFVKRHITGEYEKKYEPAIVV

SEQ ID NO: 207670 - protein, 183 aa, Triticum aestivum
  Clone ID: PAT_TA_102088.pep
RGDSRGGGQFSPSGGRGRGDGRDGRFSPSGGRGRGRNFNQGRGRGRNDWREGKSNFTSSDSPISGDCHIDSPASEGVRKRPPIIYDKKEVKQWVQARKKNYPTSANINKKLCQSQLDEQKKDEEAQMRRRELKEVIAKQKELGLELPELPPGYLSDTEGQPRGRQGDEKESNWKTRQGGGRFG

SEQ ID NO: 207671 - protein, 64 aa, Triticum aestivum
  Clone ID: PAT_TA_102089.pep
VLEWFPIVNSQLYFISIFSVISEVFYCDFSLNVCKCEIAPECWFLITRLLRTALFLSLYLLCES

SEQ ID NO: 207672 - protein, 105 aa, Triticum aestivum
  Clone ID: PAT_TA_102090.pep
DVAACHSPVLKEKTKAPSFVLQCAIQITVNDVSSASSSPEGARKGSHQRSNSTRSGCSTEAARSSGIGGSWMLPLPRRRKKTHAHKLEKEEDTHTLAHAHSAFTL

SEQ ID NO: 207673 - protein, 132 aa, Triticum aestivum
  Clone ID: PAT_TA_102091.pep
SVVLGIGSFLIDPLCRMIGARLVWAISNFIVFACMLATTILSWISYDLYSSKLQHIVGADKTVKTAALILFSLLGLPLSITYSVPFSVTAELTAGTGCGQGLATGVLNLAIAAPQIAVSLGAGPWDKLLGGG

SEQ ID NO: 207674 - protein, 79 aa, Triticum aestivum
  Clone ID: PAT_TA_102092.pep
NMSTLLAIRPISRIKISRSAFLHKRVSPTVASYLVGYNNHCCSLESDRNDVFICKYIFNKYVKPKSVFYQFIEAITFIF

SEQ ID NO: 207675 - protein, 134 aa, Triticum aestivum
  Clone ID: PAT_TA_102093.pep
MGSAHSSHSSISTAADEGDDDPSTASASEPSAPPPPAQAPAPPASASKVLEQEPEVLPCRAADSPLSPQPSVTGTPRLLGPNIKVWDPCHVLLPPPSPHQHLPQQGRTEALLEVVIVSHGECAFAMRPDLVGGR

SEQ ID NO: 207676 - protein, 130 aa, Triticum aestivum
  Clone ID: PAT_TA_102094.pep
MPPPARRRPSVSVAAALLAAALLLVLAAGAVAAADDGRTLLEIKKSFRDADNALNDWSGDGASPGYCSWRGVLCDNVTFQVAALNLSGFNLGGEISPAIGDLKSVVSIDFQSTGLSGQISDEIGDCSSLK

SEQ ID NO: 207677 - protein, 85 aa, Triticum aestivum
  Clone ID: PAT_TA_102095.pep
GHRPRPWCSTWETTKNKPPMEAMDVAPGGAKRSGAVLQYISAGEGREDLLAQLSRESQAHSGARVVVQRHVHVYQWKGNLRGSGS

SEQ ID NO: 207678 - protein, 68 aa, Triticum aestivum
  Clone ID: PAT_TA_102096.pep
CDTTSISSHKQSDASTPAHPLPRIQHHLHLPPQVLKYHPVCVRSVVLIHFFILMCSVQFDVPTAWPWP

SEQ ID NO: 207679 - protein, 53 aa, Triticum aestivum
  Clone ID: PAT_TA_102097.pep
QGQKPGGDQAGGREAQQHVHLHRHQKEAARVRGHLTQPLSQRVPRPLTILHDL

SEQ ID NO: 207680 - protein, 88 aa, Triticum aestivum
  Clone ID: PAT_TA_102098.pep
RTRGRTRGRKSEKPTEKKEPQKPPESWFDLKVNTHVYVTGLPEDVTAEEIVEVFSKCGIIKEDPETRKPRVKIYTDKETGRKKGDALV

SEQ ID NO: 207681 - protein, 112 aa, Triticum aestivum
  Clone ID: PAT_TA_102099.pep
IKESATKLVVDGLSGSSTLCSPVHPPGSWPPSLNSARSLPADQHMVASVGNTTELEWRQDSVLDDHPVAAAWQIDRRLLGRSMAYSMLVGTVERCHREDARLEIRSVARALG

SEQ ID NO: 207682 - protein, 74 aa, Triticum aestivum
  Clone ID: PAT_TA_102100.pep
DHCSEENGNHCNQVSQVCVTDPRFFHSFNNTLENLVRDGRFFQSFYVRVAPCITNSMRVQDEEAMLDMQVAGVV

SEQ ID NO: 207683 - protein, 122 aa, Triticum aestivum
  Clone ID: PAT_TA_102101.pep
DNAEELHSEIVEDDDRENENLQDEHDVWHDDESHGTEENWQDDFHDAALDTGPIPRIENSFNLRDEANLHNMELRELLSRRSVSNLLSNGFGDSLEQLIRSYVQRRGHAPLNWNLDTAMPTA

SEQ ID NO: 207684 - protein, 64 aa, Triticum aestivum
  Clone ID: PAT_TA_102102.pep
MSPRLKRRGEQIENRNVQRGYTRNKRQIIFCFHHKIASIDQIKQNQSSIPCSNLVDISCNITKA

SEQ ID NO: 207685 - protein, 110 aa, Triticum aestivum
  Clone ID: PAT_TA_102103.pep
MKPIVVHAAAVDRRWLLPLAVGSALSLFLLVLLTTVPLPFFPYSSPSPALFVEHKLAPTPPASRAAGSLPRIAYVISGSDRDAAALRRVLLALYHPRHLYVLHLDAEAPE

SEQ ID NO: 207686 - protein, 96 aa, Triticum aestivum
  Clone ID: PAT_TA_102104.pep
WLEQPEFWDAFSSAPVNSDSKMKLGKEQIDSPSRTGVGSRRVESYDSDFELVQKAIAGGVVPAFSSSGTGDETHLAARESSWSLLRRKFISRSLSR

SEQ ID NO: 207687 - protein, 110 aa, Triticum aestivum
  Clone ID: PAT_TA_102105.pep
KLKHEEASHLEDDEVLNAIAVEANHKSPLVNLDRPCSMGNVKESVVTMSESFAPRKKLKIKGPAQSKYLPMNTISSKENLKHEEAFHLEDDEVLNAIAVHERKLEMYLND

SEQ ID NO: 207688 - protein, 110 aa, Triticum aestivum
  Clone ID: PAT_TA_102106.pep
NLLPSATRRCEKSGGSPSQNLKNPAAAPGEQWGRRSPPEGAEGGSVVPGASRAGIRPATAAAAGDEVKATGWLLLTCEREKFVRRPGCLVWSKRSSQCPYFSPVYMGCLL

SEQ ID NO: 207689 - protein, 83 aa, Triticum aestivum
  unsure (1)..(83): unsure at all Xaa locations
  Clone ID: PAT_TA_102107.pep
LPLLVHHLLGVVHQSCEADRKNIHLHTLEGADESLSLRRADVMDXDSLRSAFDGCNGVFHVASPVSNDVVSSLAILQHIYVII

SEQ ID NO: 207690 - protein, 127 aa, Triticum aestivum
  Clone ID: PAT_TA_102108.pep
RKVTSAKPVVQDGQGQLAGSYTTALESASDLGSILVKNMSRLEKEILEAKKSNQCADSSEGSCKVVTDDAQASTEESESLKGQSEVLSDSNVKRNCDNRESVEESNCVQACTDSSQDKENRILSSHK

SEQ ID NO: 207691 - protein, 85 aa, Triticum aestivum
  Clone ID: PAT_TA_102109.pep
LCSHLTNDKRLGQLRNLISTRLDCQSLENRESARLKSPGKNDVKYQSPLTDNTDDSCTIQEKAGTIIHALIRQIIAKNRYHKLRK

SEQ ID NO: 207692 - protein, 122 aa, Triticum aestivum
  Clone ID: PAT_TA_102110.pep
LTPPVTPASPPRGGGGNPAAPPRPPPHLAPPPRHQRRSGWRSRAGSQEGGGGAPRLACAVPPLPLFPSTSAAHRRRRASSGSPTPRPPPDPFLSGSGCPWTSPARSPSSPPSVLDPWRAPAP

SEQ ID NO: 207693 - protein, 121 aa, Triticum aestivum
  Clone ID: PAT_TA_102111.pep
MVAHRFHQYQVVGRALPTPGDEQPKIYRMKLWATNEVRAKSKFWYFLRKLKKVKKANGQMLAINEIFEKNPTTIKNYGIWLRYQSRTGYHNMYKEYRDTTLNGGVEQMYTEMASRHRVRAP

SEQ ID NO: 207694 - protein, 63 aa, Triticum aestivum
  Clone ID: PAT_TA_102112.pep
FLINLINCFLITSFLGRDLAMLNPYICSLIEGFHEKRTETLHLLSIYIARNMHCICIKMLSSL

SEQ ID NO: 207695 - protein, 132 aa, Triticum aestivum
  Clone ID: PAT_TA_102113.pep
KEINEKKRKEDDVLIAIAAGNRRPIVPNMSFEYVDANIHDDLYKIVKYSCGEVCGSDQLDKVMRIWTTFLEPILGIPSRSHGAVDADLTKPKNGITKSGIANVGESNASPDGVAAQQGHGDESMQQEQAPSA

SEQ ID NO: 207696 - protein, 116 aa, Triticum aestivum
  Clone ID: PAT_TA_102114.pep
NLRVLKIQRCPAIKIFPLFESSHEFKIEQMSWLPSLRELIIHGCPNLLVPHPLPPSPTISKLSIVDVPTLPRIEGSSGDTLTIGSGSEGNDNCDPSSGMMTILDCKILAFHNLWGL

SEQ ID NO: 207697 - protein, 45 aa, Triticum aestivum
  Clone ID: PAT_TA_102115.pep
MPELPEVEAARLALEEHCVGKRIVRCSAAEDTKVIDGVAPSRLEA

SEQ ID NO: 207698 - protein, 106 aa, Triticum aestivum
  Clone ID: PAT_TA_102116.pep
IKSVLDEIPRSWCLRAQFLLMSKSRNISRLLAEQDEQRLEGQRRRRHGSSEGNVEEHAAAETEIEEAEEEDGDEEQQHVRMHDGKSYRITFPDFPGGPGTFEAAPS

SEQ ID NO: 207699 - protein, 56 aa, Triticum aestivum
  Clone ID: PAT_TA_102117.pep
PLLSPLFSSPHLPVSFLTGAPDAMGPPGKSRSGFPRCHRRPTSSPPVSDPPQPLPH

SEQ ID NO: 207700 - protein, 84 aa, Triticum aestivum
  Clone ID: PAT_TA_102118.pep
PSPQPTTPSSASGEERQGRAGRGGAEEEERGGLGSGQRGSARAAARAAARGHWGSGGGRRGWGQHIRSGGGGVARSEKKKKWFQ

SEQ ID NO: 207701 - protein, 75 aa, Triticum aestivum
  Clone ID: PAT_TA_102119.pep
YRVGEQPVAGDDWLNCSAGGRWPATETSLQHWCAATRLHCITGRLDIIAPVTRRPHTSSGMPHRRSSIAAPAARQ

SEQ ID NO: 207702 - protein, 160 aa, Triticum aestivum
  Clone ID: PAT_TA_102120.pep
HRAPQRQCRGVTQECPGTPTSSLPCRRRGASRPQAPWSCRTGPWPLPMACKRLTAGLQQMALETCNNGAAKARWGDAGGGTGDDGRELRKRPVAAPVGHRSRGSTKGGHGSGARVHSVIGAAQNEEIEEEARRSRHGRSVTDRIWVEGEAMDRGQLGRLR

SEQ ID NO: 207703 - protein, 153 aa, Triticum aestivum
  Clone ID: PAT_TA_102121.pep
GQLRDLIVIRSPRFFAGWTPNPRRVQLQDELGQGQKLQQLGSFKLLTDDHMGLLAAPICSFLSYSLTHLNLCEDDKIERFTKEQEDSLHLLTSLQRLDFGSFSKLQSLPAELHKFTNLKQLGVRSCPAVRSLPKDGLPKSLQELDVGECDNAE

SEQ ID NO: 207704 - protein, 60 aa, Triticum aestivum
  Clone ID: PAT_TA_102122.pep
YSYLIVIDDIWDEVLWTVIKCAFSSNNNFGSRLITTTRIVSVSEPRINHTLSLLTSLLAA

SEQ ID NO: 207705 - protein, 161 aa, Triticum aestivum
  Clone ID: PAT_TA_102123.pep
AMMQQNSDGSGLNVNQEVQDSSEFSQSALANISSSQVEQVDEPVGCHGQIHSNDGAHDSYSSCQEACHTKANDAASTSPETRHQLSISENDPDIHWQQDLSVADFDLQSELWQDISYQSLLTAPDSINAVSFFSPNYQHSACSSEVANNFEERLYPLHTYS

SEQ ID NO: 207706 - protein, 50 aa, Triticum aestivum
  Clone ID: PAT_TA_102124.pep
ADSLKDPFVPNDFADDDSNAMSLLVIFVFLSSFTSLYFSIFILLIFVLVV

SEQ ID NO: 207707 - protein, 173 aa, Triticum aestivum
  Clone ID: PAT_TA_102125.pep
HAGMYEEGRKYFSAMESTYQLRPTLEHYTCMVDLLGRAGRLKEAQELISSMPMPADGAVWGALLGACKIHKNVEIGEEAFEHVIKLEPSNVGYYVLMANIYTDTGQLEGVVRVRAMMRERGLKKEPGCSYVENKGRVHLFMADDHSHPQAKRIYELVIKLEQMVTERTDGTVE

SEQ ID NO: 207708 - protein, 80 aa, Triticum aestivum
  Clone ID: PAT_TA_102126.pep
RILLFEQAVDVFTKTAQNQLCVVGQIFYLFVLLPQIVGKMASLFLPSDDTYEQIMLGGSLARCILMFICTVCLMREKTII

SEQ ID NO: 207709 - protein, 50 aa, Triticum aestivum
  Clone ID: PAT_TA_102127.pep
PLLRHECSSFTLLRVCPLASPHPHALSPAGSQAMSLEPGQHEVSDAEAKT

SEQ ID NO: 207710 - protein, 145 aa, Triticum aestivum
  Clone ID: PAT_TA_102128.pep
VDLSIVEEIKGLFSSERDDEQGFLSPGHKTECIASARLDSSEDCNLVKRDINTEVICKEEEKQELVPSSDTRTLHETSNTDEPDEQRITLLQAAETSASADKQLSSELEDDEFKEHNFSSEETIGIFGVGSVKSNLFHLHEDSHT

SEQ ID NO: 207711 - protein, 105 aa, Triticum aestivum
  unsure (1)..(105): unsure at all Xaa locations
  Clone ID: PAT_TA_102129.pep
MLWIILQFFFYRSYVAVKDAENMDWMTQLQMAMGIAYCQEHMLKLNLPARLRNLISTXYVATVSDLDVWNGTKGSDSVTDDCIMLYFIVHQYGIMLKLNLHTIAY

SEQ ID NO: 207712 - protein, 53 aa, Triticum aestivum
  Clone ID: PAT_TA_102130.pep
VETKKNWIISFTLLLISIGLPSSELTIHIIYQYRADQLIFIKTHIRIIIGLGF

SEQ ID NO: 207713 - protein, 73 aa, Triticum aestivum
  Clone ID: PAT_TA_102131.pep
LCFNFDFASASVFSKVFLEHLKRGTGSYISLRRREVFLFIRKTEPKNLTFSVNQGKPNKNLKMERKKKEKKEH

SEQ ID NO: 207714 - protein, 97 aa, Triticum aestivum
  Clone ID: PAT_TA_102132.pep
RLLVVACIEEKKINVDAPSYFWSWGIYIHYATIVHVLRVLVQRHHHGQIVVMHKRTCGRTPFLSNDVVVGWMWSLQQSPQHFNLDAPLEMYSWSQAC

SEQ ID NO: 207715 - protein, 132 aa, Triticum aestivum
  Clone ID: PAT_TA_102133.pep
KEEDTDRERGLESRDGETSRAIHPWEGVCAAAAVGTGSHELLSFFSFPLGIFVVGAIRRCPLRSLMHFAISKCFSQCASLNFSLLLDRESVARLTSLRHMGVGFCCRQVSAICTLILRRFSCQRGNPCSARS

SEQ ID NO: 207716 - protein, 65 aa, Triticum aestivum
  Clone ID: PAT_TA_102134.pep
SDLRFVPKDCRPRYANLDKDEKHHRLANPWQWRPTALSLMELVYMRGYGNCTASSLQKGCSVGAH

SEQ ID NO: 207717 - protein, 116 aa, Triticum aestivum
  Clone ID: PAT_TA_102135.pep
RQTEYTCECGQFEHTGMLCSHVLRVMEILHVEGIPSKHILKRWTKDARDILPKDVVQYQRDNSVNMSLTCRHSTLYLRAMEVVRLGDSSAEAFDHILDGFEALLVSGAPFGKRRDG

SEQ ID NO: 207718 - protein, 71 aa, Triticum aestivum
  Clone ID: PAT_TA_102136.pep
ALSDLSRDSLLPSFLYSPRSFAAAASPRFPSSPSPYQAPAAAPAARLVGAGGVGGGRPFSIRAPNEKIEMY

SEQ ID NO: 207719 - protein, 140 aa, Triticum aestivum
  Clone ID: PAT_TA_102137.pep
LPPGRRRHRTGRHLDVLRPLHRHEKLLLHGPHRGKENTHPKTPLAFASAPDTAYLKPLKNPPKTQGRRGKGTTAGELRHGGGGEWKAKSKGLLAWMEGGEEAIREVLLRLFGGGEGEGDEEGMGNGVAALAGLGWVRAGD

SEQ ID NO: 207720 - protein, 41 aa, Triticum aestivum
  Clone ID: PAT_TA_102138.pep
LGVRRRCTAWWSWVRILLGAGVTPHQQAWSSIRDGGSRGFV

SEQ ID NO: 207721 - protein, 167 aa, Triticum aestivum
  Clone ID: PAT_TA_102139.pep
RLSHHLARHFSIFNHLQLRSSDRIDQFFKGLSKSSQVSLLKVLDLEGCLCFLKKKHQYLKEICSKMLLLKYLSLRRTDITQLPSEINNLRELEVLDIRETKVPPHATAHILLLKLKLLLAGHIDPSNFESNPRIPHRIDKMVNVEVLSNVKAKQSHDLKDIGRLWQL

SEQ ID NO: 207722 - protein, 120 aa, Triticum aestivum
  Clone ID: PAT_TA_102140.pep
TWSRSSLTLPPRLLTSLPRFHLTARAAAAARSLCYCSRGGEEQAWGRRGGSQRQGYLSSVGRESKGSRAAALLRSAASLKERNDRPLAAFTAALGERGVNAGPSVASPGTGRDAATTTTT

SEQ ID NO: 207723 - protein, 58 aa, Triticum aestivum
  Clone ID: PAT_TA_102141.pep
SFLRGKQNISYHHSAAMKYFSSIKKSLVVNGIPTHGLKRQNTDELLICNPCLHLLGWQ

SEQ ID NO: 207724 - protein, 174 aa, Triticum aestivum
  Clone ID: PAT_TA_102142.pep
RTCLLARRWRGVWRSVPTLCFTGAKGWGSADRFAQFVDHLLHLRCGGDGPPLDSCDFDFDHDGFMLWPANKRRASIWLWKALPRVRALGLCIVEELETWTRLSDKHLFSQHLTRLELAGVSVSDSVVDFSGCPALVQLSMDYCDVFVRQLVSPSLKHLRVTRCYTSRNYRILIS

SEQ ID NO: 207725 - protein, 113 aa, Triticum aestivum
  unsure (1)..(113): unsure at all Xaa locations
  Clone ID: PAT_TA_102143.pep
MAGDGDHPGANKREREAVGRPEAPSKGGGDAVKRKKPYDAPGARGGGSKEKPQPVTAMEKRVAAEKCXNSLWQEIFLPESRKPDYKLVKEITVLCQKVRCCNLSGKERSKLLT

SEQ ID NO: 207726 - protein, 153 aa, Triticum aestivum
  Clone ID: PAT_TA_102144.pep
MPKTSSSPSPTVAPMNPLLPSSSSYLKSHHPPDPDPGSPNPSPCSYLLHVDADDEALIQIPGGPNPSPGGPVASSLALPPVDPTPHISSQFYTFTAASHALMLRCILAGRPAVAEEVRAATSPSVLASWRAVWKDRNEDTAYLTAWKRIQDKL

SEQ ID NO: 207727 - protein, 161 aa, Triticum aestivum
  Clone ID: PAT_TA_102145.pep
LDYEREEIHLELGQFITRDERCIGYADEFSPYYVYGNEVTLYNNNLKKLRKLIRNRTIPNSYYVCHMTKTFATPRKTMYFLVPFSKGSIFPHMDANNELPVSNGDGTVNAKVRFIKGVDNRATITKNWSAFFRQEEMVKGRVYAFAFKCSAKGLRMIVYPL

SEQ ID NO: 207728 - protein, 130 aa, Triticum aestivum
  Clone ID: PAT_TA_102146.pep
LLYRLPVWASLIKHAAVYNNIFAWSRSARSFSFWARYPGARGRLGLRQARLLASPSSPASAACAPAADGGRLLDPVAVDWAHGAGIRAAQANPTRDHVGAASPASSSSLPHPAADGRSRRRPPRVVVARH

SEQ ID NO: 207729 - protein, 171 aa, Triticum aestivum
  Clone ID: PAT_TA_102147.pep
GPVVAKLGALLGREYKLRRRTQKDVRFIKSKLKSMHSILWATWEKEVLDVESKNLKKEALDLANDMHDAIDDFILIMDPSRRNKRLMVQSKIEASRPFQEFKTRVDDVSGRCRRRWRWEKNKSSEPISSLFSRRGVKSSPPSKQPPPARAPFVCKDASELIGLGKWRDELI

SEQ ID NO: 207730 - protein, 38 aa, Triticum aestivum
  Clone ID: PAT_TA_102148.pep
SCKGKFICQVIVSNFALMLSYAHQVGCCVCHCLLLFLC

SEQ ID NO: 207731 - protein, 68 aa, Triticum aestivum
  Clone ID: PAT_TA_102149.pep
RKRRGRKEKGPKEGVRVGNRLKRRKGLKTEEWPQWWWWWWWKQFIPLSSQSPLPGVSLDAQRKGRGPA

SEQ ID NO: 207732 - protein, 93 aa, Triticum aestivum
  Clone ID: PAT_TA_102150.pep
VDPQLPRARIYGFHRDRKRHLPRSLGAPAGDRRSAGEGECAPKRSRRRGSGGAQARASERRTRGERWRRRCRALGFRVRGRWIRTGGLGAPAM

SEQ ID NO: 207733 - protein, 124 aa, Triticum aestivum
  Clone ID: PAT_TA_102151.pep
LPKSKDAPPAADAVSAPPCPVEDKPPQVQKIEVVAPAAAAADKDEDGKDHKEHEDGEKTAAVPLPKSNLKKANCGDDGVCAPKGNVKWLDLLGKDLTEVKEFEPSESGDSMDDEGISTCVCVIQ

SEQ ID NO: 207734 - protein, 73 aa, Triticum aestivum
  Clone ID: PAT_TA_102152.pep
SPKLLPCSPPRSPPVFAPDHPLPLLPMLTLGHQSFLLPETISCSPPNSHWRLLLTILCCLLYGPPKLLAACAR

SEQ ID NO: 207735 - protein, 145 aa, Triticum aestivum
  Clone ID: PAT_TA_102153.pep
VEAISERMFAAENASELFLVTSKELVNRINTMQYQLSASGCRESDLKAKLEQSLVQLNALNGSLEMMQNGGEENASQDSMQRQRLSTPEFFALQHKVQKLEEWLRESCSQLQFVTVSTEGNEKEQNMSPSEISRFRNIINDIKDA

SEQ ID NO: 207736 - protein, 129 aa, Triticum aestivum
  Clone ID: PAT_TA_102154.pep
AKSGESDDDEVGKSVENLKKLVPRTLEEFAKGVVSAQENSSAAEESTAESPEEEKRPLQKGDRVKYVGESVLVEADHRTLSNGQRGEIYEINGDQVAVLFHPPEEKLDDGKNNEANKEQDAKPSVCWVD

SEQ ID NO: 207737 - protein, 132 aa, Triticum aestivum
  unsure (1)..(132): unsure at all Xaa locations
  Clone ID: PAT_TA_102155.pep
GRVGERAACSVRRARASERKKKRRRLPLHVSGAERRGGRAEQRSAARGHVDRAEERARASRRRGRPVRPRRPLRRLRXPPASGGRGGSSGGRDSDSPAAAAQWEWDGEEVEGGDGEVQSNYKGPFDTMDALN

SEQ ID NO: 207738 - protein, 95 aa, Triticum aestivum
  Clone ID: PAT_TA_102156.pep
AYQQQLQYHQYYQQHYPGYNPYTQQYQQYGQYQQCTQPQTQVAPQNVAQVPAQPAPYAQPQFLEAPQAQHIVPNQSQNPQLQAPAVQPQPQQNPP

SEQ ID NO: 207739 - protein, 67 aa, Triticum aestivum
  Clone ID: PAT_TA_102157.pep
LKKYTICHYDIFLKLCIEPLPIYLDHRIVMHQNYRITTYHCSVVFCVYQYLYHYNTPFLNLDAPPTC

SEQ ID NO: 207740 - protein, 156 aa, Triticum aestivum
  Clone ID: PAT_TA_102158.pep
GDLCGVVELQQLLDILELTHQSISRFLELDSYSLMISEMQENLSLVSYSSRISSQIWNEMQTDFLPNFILCNTTQRFVRSLKGAHHSSQRSDASTGKPYFYCGSHDLTMAYQGLAGLYRDFFGIPHMFAVVKLLGSRSLPGIIRALLDHISSKITA

SEQ ID NO: 207741 - protein, 66 aa, Triticum aestivum
  Clone ID: PAT_TA_102159.pep
KQPLSRVFFLSLGKFRVHFSLGVGFSSLFPSAFSMKKFCPKSHPFNANVERHLGRPKSNQIFWGPH

SEQ ID NO: 207742 - protein, 94 aa, Triticum aestivum
  Clone ID: PAT_TA_102160.pep
QKRMIKNRESAARSRARKQAYTNELENKISRLEEEIEHLKELKKLEPVMQFLPQQEAGERQQQLRRHAVLYMPQPEAEPKQHRHQLRRINSASF

SEQ ID NO: 207743 - protein, 144 aa, Triticum aestivum
  Clone ID: PAT_TA_102161.pep
MKITALLVLRSPGDASSSSSSSAGGGGAGEQQQAAVLANASDVTRFGFFQRPAAREFIVFVARTVALRTRAGTRQTVQHQEYKVHCYNQGGLCAVAFTDDHYPVRSAFSLLGKVLEEYLKSFGDSWRTAEDKATQHWQYLDDAL

SEQ ID NO: 207744 - protein, 59 aa, Triticum aestivum
  Clone ID: PAT_TA_102162.pep
TLFFFLPYLPILSTKKYQEFLLGSERLISHSTTCCYYPAQYYVMNINNENNMYALSVLG

SEQ ID NO: 207745 - protein, 51 aa, Triticum aestivum
  Clone ID: PAT_TA_102163.pep
GAAAPLSPPVALLPHSPQPQTQELRFPCRADPWAPEGLICSSREEARAGGD

SEQ ID NO: 207746 - protein, 177 aa, Triticum aestivum
  Clone ID: PAT_TA_102164.pep
PSLHRAAPVVSALQRRPGKMEHLQDGHYVRLRSREHGTYLHADEDGHGVSLQHLRASMNVAWVVHLYDQGNADALAQHMLLHSAAYGRYLVATNAPAPLGHRGRRVEQRNYDDQEEVAIRWEAVAAGADSGNDVLLRNVAGRHLRNGAWRYLRANGRYIHTGASVDAFDNFSTKMHW

SEQ ID NO: 207747 - protein, 161 aa, Triticum aestivum
  Clone ID: PAT_TA_102165.pep
NLNLVPSSAFSSPAAAVGAFRFGLGASFFPTPHFLPPPPLPPSFVRCHAHQKLLPLPYLSTTLLVVGFGGSCSALLRSTYLPASLASRASLLPLFGPCVTLIPSPHRTNARTRARRSSLLLPAGSVFGRFLGLRLDWLGAVAWARRAATDLCGIPAREDGR

SEQ ID NO: 207748 - protein, 80 aa, Triticum aestivum
  Clone ID: PAT_TA_102166.pep
MDDGLSVKERICFLNSMMDLGSDVQVRAAGGLLAILDSERLLDTLEQMEGGASIAIDSVAQISLYRFLKLDAAAHEALHI

SEQ ID NO: 207749 - protein, 131 aa, Triticum aestivum
  Clone ID: PAT_TA_102167.pep
RSCSACRSNGSHRPALSKLQCSARCSNGALAGVSHCDAAALSSASSKLQSSSSVPQWSARRRLLVLQWSLPAALGTAMQRLTAASVLQSALPAAAVMLLQRRPRRRSKQGWLMRCGEEDIECALTVFQGLR

SEQ ID NO: 207750 - protein, 158 aa, Triticum aestivum
  Clone ID: PAT_TA_102168.pep
LTPAARDQPPPAFKSSRPPSPRRTRSGRAPEWTAAETLALVAAVAAVDDDGWARSVSAFQKWAIVAENIAFSDAGGAPSRRRGRAAGECKRRWEALVAEYGAVRRWEGRTGGSYWRMSAAARRKAGLPAEFDAEVYGIMDALIRVDEALLGGAGGGEG

SEQ ID NO: 207751 - protein, 173 aa, Triticum aestivum
  Clone ID: PAT_TA_102169.pep
GLSSQQNKDDSILTWTDVMDKSIKASTSIERSVNSDADEDPSQSTSDHGNKPNSEESKYKEMIFGEDALKILPSAPYCLGRPIRRGHFNISQNYSLHQVLEDLRTIWNWMLTEKLHINPKDRHLYSAILVLGETFDNREMKEMLSIVLCDLGFSTAVVHQEALAAAFGNGLST

SEQ ID NO: 207752 - protein, 168 aa, Triticum aestivum
  Clone ID: PAT_TA_102170.pep
VDAAAAEDELRSGCEADMQAEDAWDSSAADLESRCLDSYIEWLRKEVSLTEEENCKLSAQISVIGETVFKDTIPLDAEIESLESSLNTLDSEGLKHLEASPISTDSGFNQIDIEKDCEYEELKLDHQIGKSEMDLKLLQIQSISMQRDEEIWQLQSLVSGPKVLEFKD

SEQ ID NO: 207753 - protein, 94 aa, Triticum aestivum
  Clone ID: PAT_TA_102171.pep
ISRFLFFLSFFCFSIGPVFLLMPATGPCWRFWTCSRWEVSQAARDRSVVPPCHAERFVRNQVDRNLTFAPYRGSTYLQFPRAKIPLRDRLLPFL

SEQ ID NO: 207754 - protein, 125 aa, Triticum aestivum
  Clone ID: PAT_TA_102172.pep
MAAKCYPTVSDEYLAAVAKAKRKLRGFIAEKNCAPLMLRLAWHSAGTFDVATKTGGPFGTMKCPAELAHGANAGLDIAVRLLEPIKEQFPILSYADFYQLAGVVAVEVTGGPEVPFHPGRQDKPE

SEQ ID NO: 207755 - protein, 154 aa, Triticum aestivum
  Clone ID: PAT_TA_102173.pep
AFLEAIENLGFDYIASGHYAHVVHPHVENAKEPSVLQLLKDEDLAVYLSVNGAHLLQDEVRSLAVQMDLPNQARKDSQGICFLGKVKFSEFVQRHVGEMEGILLEAETGDYLGMHRGFWFYTIGQRQGLRLSGGPWNYYSLDKRRRTFRVGSLN

SEQ ID NO: 207756 - protein, 116 aa, Triticum aestivum
  Clone ID: PAT_TA_102174.pep
QHVEDMVVELPVVQQEMSSHVHQSASGHAQIVAGPASGGVRLESSPPSSELSTRKMTPRAPGWNKRLRIGAAAPSRPPCPNRISAFEKAVRGFAENPTENVITPVTGTTFDSVGEA

SEQ ID NO: 207757 - protein, 146 aa, Triticum aestivum
  Clone ID: PAT_TA_102175.pep
MESSTKTKEEREYVNIEWALFFYECGISFNAASSRQFEIAIEAACQYGSGHKPPSAYELREPLLNACVKETTTLRKQHEAAWKQFGCTLMSDGWSDKRGRHLINFLVNSPEGTVFLESIDASSESHSAQMIADLLEKRIMEIGKEN

SEQ ID NO: 207758 - protein, 87 aa, Triticum aestivum
  Clone ID: PAT_TA_102176.pep
DAWADAWVAVKHLYETKLKDASILIPLLSSFPKEEELPIFPRLGDLLPDKVQDALARILQGSAHTGPAVTPAEGLIAIHDINPEKDK

SEQ ID NO: 207759 - protein, 51 aa, Triticum aestivum
  Clone ID: PAT_TA_102177.pep
RCNALNVIARDKYYKHARSTRTNAHSTPTLTYIPIARSRVPRRRLPCTGRR

SEQ ID NO: 207760 - protein, 168 aa, Triticum aestivum
  Clone ID: PAT_TA_102178.pep
SEKKAKKTKPTLASASGPTKKPSFSANKRIHVTPFPESETPMRPQKIMKSEEMKDKLNGDVQEGKDKASASDKLGGFSLSPFFWLREGEDAEGGTLETLSEPPSLATPLRHNAPTFSDIKGSDAGTPPNTTPNSKAVVPDAFDSEIFEWSQRPCSPELRSTPQKKQGK

SEQ ID NO: 207761 - protein, 152 aa, Triticum aestivum
  Clone ID: PAT_TA_102179.pep
SSLPCLAFVPPPPLPRPAATVDCIPTPVFGPGRGRPLPQPRQKLLSDCSNHAMPRLDDAANRPEEDFVVVSATPEMQAESALLSTNAAVAWFEGAREDVPCHAVAVAFASTFGFRQAAVSVVRHFPEQYLVRFMYQTQLCRRGQPRRLPRRQ

SEQ ID NO: 207762 - protein, 70 aa, Triticum aestivum
  Clone ID: PAT_TA_102180.pep
LERTCPLHHTFQWTRQHSCQRIDVQLCKKTDCTRASALTRAKICALKIANHLQIHHNFRIIDPYLRQKLT

SEQ ID NO: 207763 - protein, 81 aa, Triticum aestivum
  Clone ID: PAT_TA_102181.pep
DERLGDMQLFDKQHVIIPDHLQVTESEKYGLSFGSFGTSFEQAPSFSNDHGSEKSSILPEYESSQDLEEVAEEPASSHKSA

SEQ ID NO: 207764 - protein, 147 aa, Triticum aestivum
  Clone ID: PAT_TA_102182.pep
ENIQSTQSSPNIYGINKGNATPVFRKNRQPMEDVGNLEVRNNATPTQKALKFDIPGSGILVEHNSPNSVKNCWVDNAAVGDNQFENSNSVREQEPNLTTHTLASNLFYQRYTPGPQRGRVESIPSQESDEFNGVTNSCSSDQDMVMS

SEQ ID NO: 207765 - protein, 118 aa, Triticum aestivum
  Clone ID: PAT_TA_102183.pep
MGGSADPEEPAPTPTPSPSPAKPSPSSSDAKRLRRCVQSRLPFGSGRPGGGARVVPPAPAAEEAAGKEAAEEPEKGKKKARPRRSAAGRKPSSNKETTGLDPGSKDEVTLVDESPQKK

SEQ ID NO: 207766 - protein, 69 aa, Triticum aestivum
  Clone ID: PAT_TA_102184.pep
CPIHQIASSSVPHSSPGYGIRRAGWTRIGAAAVAGAKLQTGDLDPRHHHRGPHGGDGARGRGGGGGGGR

SEQ ID NO: 207767 - protein, 100 aa, Triticum aestivum
  Clone ID: PAT_TA_102185.pep
APPPCARPRRPPGPARRRAAPRRSRRRRRAPRRAARRGPRRRGPTAAAAARSGTSPTASRRPRPPPRRRNPSPPRSRSIDRSRIVSGVSDRLGRAAISFG

SEQ ID NO: 207768 - protein, 104 aa, Triticum aestivum
  Clone ID: PAT_TA_102186.pep
RRVAHPSHRVRRLGIICILSLAVIIVLVLLVFYLRHKLSRNSSLVIVPAGKAKATVEPTSTDELLGRKSREPLSINLATFQHSLLRVTIDDILKATKNFSKEHI

SEQ ID NO: 207769 - protein, 104 aa, Triticum aestivum
  Clone ID: PAT_TA_102187.pep
PGEGICQQAGRLVRQMCELQTAVLGRQKSPLQQSKLSTDQNRAAEVAIKSVMLVGVPTARTTYPDLGDVPKQPRKPASCKNCGVVGHHRNNFTKAMELRLAGGV

SEQ ID NO: 207770 - protein, 69 aa, Triticum aestivum
  Clone ID: PAT_TA_102188.pep
EYYDPFPPFHSILASPPTHAYKRNHALTPSPTPNHRLRLRLRFNGRTEPPPCNALSRPALPPPPRVLSQ

SEQ ID NO: 207771 - protein, 94 aa, Triticum aestivum
  Clone ID: PAT_TA_102189.pep
PDTCFRRSHSTWSERTCSPSPPDWRAAGARSSHLPRAAKWYNIRGMRDPGHIHAVFMSPDEFKWRPYGGSSFALTQAKGGCWVHCNELTTSKGL

SEQ ID NO: 207772 - protein, 101 aa, Triticum aestivum
  unsure (1)..(101): unsure at all Xaa locations
  Clone ID: PAT_TA_102190.pep
KGISVSWHEADAPAALIRGALDLDXGVVLSTATPYMIMRPDVFRVFAKAFDAAITRYSSFHREPRRHHRQVGVSIKTAKLSSLMDGCQKWRAGGRRIRRAR

SEQ ID NO: 207773 - protein, 55 aa, Triticum aestivum
  Clone ID: PAT_TA_102191.pep
WVSYGERFEGFCRAVLPGGLMHPTVQGNLKTTPQLLGLPKYEDYHSVMSETGCTR

SEQ ID NO: 207774 - protein, 89 aa, Triticum aestivum
  Clone ID: PAT_TA_102192.pep
NRSISRETRASVTLLQFLVTTTTNITLLVPSAPLVPPKTSQWVQKSSVTVSREEVLPLQYQPSSSVQENHESQKQFQARVKASELMHQW

SEQ ID NO: 207775 - protein, 129 aa, Triticum aestivum
  Clone ID: PAT_TA_102193.pep
SFKGKKERVDGSTCEVGREVEGPKCKNADLRRGSKSLAAAPIPFRAWHHISLPHPSFFTSGRRHGQAGVVVRHPATTPLPSLQRHPSPTPTPTTSIHHSPPSPATAASCTPDQTRAARASGHPRERPRA

SEQ ID NO: 207776 - protein, 87 aa, Triticum aestivum
  Clone ID: PAT_TA_102194.pep
TEILLSPLIYESRWVYKLVFVPNPARDDFVTAAICDIDRLAYVTGGARRWAMLDPVRLSSGDQLGDVDYHEKGRVYWLTRYGDVHVL

SEQ ID NO: 207777 - protein, 43 aa, Triticum aestivum
  Clone ID: PAT_TA_102195.pep
SGREESWAAYLMIFNLIYNYLCVCLKMPLVHLEKSNLNVCQLP

SEQ ID NO: 207778 - protein, 129 aa, Triticum aestivum
  Clone ID: PAT_TA_102196.pep
PRPATSSPAPARGIIPDPRGRRRRRRPSRTSPAVPARRRPPRATTRTRTRRSTTRPTTPGGPPRPASGSRRSNSSPRPRRRRRRPVLPPKPRTPKTPPTTVPPRRMPVRAEGRMRAPWAARSRAPTRAM

SEQ ID NO: 207779 - protein, 43 aa, Triticum aestivum
  Clone ID: PAT_TA_102197.pep
TEPIIVGESNAPNISSSLTSNNSECNQRKHSPIMCNQIIKKGT

SEQ ID NO: 207780 - protein, 122 aa, Triticum aestivum
  Clone ID: PAT_TA_102198.pep
GRVGSPSSTQPRLRSPFLFTMENHLPGVASRRGAGSALLRTHTNIVALGEEFVGGEAEKVGEWEEEEELVQQISSGSAGRGRAMAAAAFGLRVERYLSVPPGRQAHGEARSPRYMAVFHLHL

SEQ ID NO: 207781 - protein, 47 aa, Triticum aestivum
  Clone ID: PAT_TA_102199.pep
LFFFFFLKLTRIISIILDKKNWHHLGIVRPSWVLHMFKNQIIRSTLN

SEQ ID NO: 207782 - protein, 49 aa, Triticum aestivum; identical to SEQ ID NO: 147490
  Clone ID: PAT_TA_102200.pep

SEQ ID NO: 207783 - protein, 148 aa, Triticum aestivum
  Clone ID: PAT_TA_102201.pep
EALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVAVGVIKGVEKKDPTG

SEQ ID NO: 207784 - protein, 103 aa, Triticum aestivum
  Clone ID: PAT_TA_102202.pep
CCFCLPAKKNVAFVSSEVTYVCRCLKCNNNIMHLSVIMTVICKENISEPFILQLLFRKNNCAWLLRCCFLRCAPDLCCGKLLANALLRKDFREKDFVHRKPYY

SEQ ID NO: 207785 - protein, 159 aa, Triticum aestivum
  Clone ID: PAT_TA_102203.pep
RSKAQCILAMTATATTQTLQEIVNALEIPSGNLIQTSQIRENLKLSISMSDNRLKDLMLLLKSPPFVNMRSIIVYCKFQTETDYVCKHLCDNNINAKSYHSGLLMKKRSRVQELFCSNKIRVVVATVAFGMGLDKSDVEGVIHYRLPESLEEYIQVRTS

SEQ ID NO: 207786 - protein, 178 aa, Triticum aestivum
  Clone ID: PAT_TA_102204.pep
VLKSKLEEHHTEASSLLQDSGYQLTNLKEQNKELTQKLAEQTLKAEEFKNLSIQLRELKEKAEAGKKEKEGSLFAIQDSLRIAFIKEQYESKVQELKSQVFVSKKYSEEMLLKLQSALDEVETGRKNEIALAKRIEELSMKVSELEVEMQDLSADKRELSNAYDSIMTDLECTKLNFD

SEQ ID NO: 207787 - protein, 151 aa, Triticum aestivum
  Clone ID: PAT_TA_102205.pep
IEDGTTLKTFTQLLHRNRKVDFIEQFNEKLLVKQDKENLQIIDVRNSGLIEVNKTEFMTPSAFIFLYENNLFLTFCNRTVAAWNFRGELVTSFDDHELWHPNCNTNNIYITADQDLIISYCKVSGGGTNDADDEGQEGSRMGSINMSNIFT

SEQ ID NO: 207788 - protein, 140 aa, Triticum aestivum
  Clone ID: PAT_TA_102206.pep
DSSSHDPPRDSCRGAPATAMAHPPPLLSSPPTSVASIQAEYPQSRCSVLNPALSLRSTPGISAATLHGEIGRRPLREIHGRRRRCRPPRRGMWNCGGWADAYPRPSLSRGSHRTGVSGAPGLVGQAEAFSAPGPMLVGAS

SEQ ID NO: 207789 - protein, 128 aa, Triticum aestivum
  Clone ID: PAT_TA_102207.pep
RSPKRRMPLLLLLALLLLAVVVLLLVSAAIGVLVMRRRQQRWQFAEEDEEGWEMIDYSPHRISYKDLHDATNGFRDVIGVGGFGRVYHGGLPRSGVEVAVKKVSHGSQQGLQEFLSEITSMSRLRHRN

SEQ ID NO: 207790 - protein, 126 aa, Triticum aestivum
  unsure (1)..(126): unsure at all Xaa locations
  Clone ID: PAT_TA_102208.pep
GLTKICMFSRQETKVRLPPNTKAVRDICITPGGLAIFASLGRKLSLLSMTTNNVVLQYDLXAPGWSCSGDQTGPNHVYAGLQNGMLLVFDTRQTKGPLHSLSGLSTNPVHTIHSVVDDSGSMKIIS

SEQ ID NO: 207791 - protein, 35 aa, Triticum aestivum
  Clone ID: PAT_TA_102209.pep
PFFFLFFFFFFFFFFRNEIEESITKRPEHNVQKYY

SEQ ID NO: 207792 - protein, 43 aa, Triticum aestivum
  Clone ID: PAT_TA_102210.pep
FTCCRGLKVVIYTYMPIHNCYYLICFPLGIYNARSLHRRLRTK

SEQ ID NO: 207793 - protein, 125 aa, Triticum aestivum
  Clone ID: PAT_TA_102211.pep
MAAKGDGPAIGIDLGTTYSCVGVWQHDRVEIIANDQGNRTTPSYVAFTDSERLIGDAAKNQVAMNPINTVFDAKRLIGRRFTDSTVQSDIKLWPFKVVAGPGDKPMINVQYKGEEKQFAAEEISS

SEQ ID NO: 207794 - protein, 48 aa, Triticum aestivum
  Clone ID: PAT_TA_102212.pep
HFMRMFTGLYVIYWDLLKIYAHKFLDLSILPFYVRKWAGSFIGNIHTS

SEQ ID NO: 207795 - protein, 58 aa, Triticum aestivum
  Clone ID: PAT_TA_102213.pep
AVFSQISSSSLLSIVFKFYGHGALGCIINELFHFIKFLGSCSKPYVFIASADIEIHLL

SEQ ID NO: 207796 - protein, 68 aa, Triticum aestivum
  Clone ID: PAT_TA_102214.pep
RFHPLIPTRSIKTRPNEKKYVVDSDARMTSHGRLKPPSEQVLDYASIPPDDPNRFCRLEGKNKQMVNN

SEQ ID NO: 207797 - protein, 56 aa, Triticum aestivum
  Clone ID: PAT_TA_102215.pep
LIICVLGLRRGGGCCSLFRFLFSNTRRSACHCVLEEECRDGACCVSLVWCLLSCER

SEQ ID NO: 207798 - protein, 72 aa, Triticum aestivum
  Clone ID: PAT_TA_102216.pep
NYGRVLRITEEFYPQEKQSMADKCMCFWNYMRLRSTFTLATHLFKHSIKWPYNTRQRGVVVVCTYHIYRNHA

SEQ ID NO: 207799 - protein, 105 aa, Triticum aestivum
  unsure (1)..(105): unsure at all Xaa locations
  Clone ID: PAT_TA_102217.pep
EGCAQDLNIVKRRQSDTFICLPEATEEAVSCNKDQAGREKRELLVDKYXFGQSDSSRFALGKPEICKSQCLDVEKRTLRIPNPPPRPSVSLPHSGPSNGSTVNPP

SEQ ID NO: 207800 - protein, 80 aa, Triticum aestivum
  Clone ID: PAT_TA_102218.pep
QARRWGGSRGFVAWWRRPSGGEEGRRRGRGKEGAAAGDGKVVLERGGGVDLDRGEREGGCGRKGGEVSDLGRVWYDRFLL

SEQ ID NO: 207801 - protein, 68 aa, Triticum aestivum
  Clone ID: PAT_TA_102219.pep
MKILHQEVGSLKKLSLLFSFSLFGFFSQYMLLQKKVGRPHVATVAGDSGGSNPLGLQGHCVLSSLPPS

SEQ ID NO: 207802 - protein, 57 aa, Triticum aestivum
  Clone ID: PAT_TA_102220.pep
DAWAEIPRPPRPLPPPHHLSAASAPGGHGEQGGAAAGCSQPACDLSVASTGGRCTSG

SEQ ID NO: 207803 - protein, 85 aa, Triticum aestivum
  Clone ID: PAT_TA_102221.pep
GSSLHQVNLSALSVFFFKLRLFAAYFYQAIGKVYDEFGKLISLLLYGSDLMGEENIFQNFFFVQFWTKKKRKKGIYRHSVTPYIP

SEQ ID NO: 207804 - protein, 60 aa, Triticum aestivum
  Clone ID: PAT_TA_102222.pep
VYIISGLSTPHTHTPSHTQTPTQTHTDTHKHPSIWILLLRHTPLHILSSSRYVYIPRPSL

SEQ ID NO: 207805 - protein, 100 aa, Triticum aestivum
  Clone ID: PAT_TA_102223.pep
SRSGFAHALRSPRGTCKRVKALAASSSRQARAPSASSRPCSLLSHDAALEPAPPPPRLLPAPSSTTPPPSMRRKGRRRHVGDTQRRRAGAQQKPTPNPIR

SEQ ID NO: 207806 - protein, 82 aa, Triticum aestivum
  Clone ID: PAT_TA_102224.pep
PDHTCWKGSDTYQTFTACQLLAAGEPANASSVHGSIPSATTTVHLTKQIGRIEVRPSAAPTGTGHRGNGMQDGRTPTLPVQP

SEQ ID NO: 207807 - protein, 77 aa, Triticum aestivum
  Clone ID: PAT_TA_102225.pep
SSSIRCKEKISENFENKRITLANKKQFSTVPKLCGLDININFRLRASICKKNRPNRSYETQVMIKRSSNSNLFENKF

SEQ ID NO: 207808 - protein, 78 aa, Triticum aestivum
  Clone ID: PAT_TA_102226.pep
TFNIIVNSKHQVTRAINHVAIRFLLSHNIRIKVFLLNNVTVKFIQALTSRFIIGNITFMRSYKRIYPLLPISRYQVQV

SEQ ID NO: 207809 - protein, 99 aa, Triticum aestivum
  Clone ID: PAT_TA_102227.pep
RTICEAPSHKKARLGFHPPPPPCSTAAAPSPATPPPPHLPLRRRPYCSTLSPLSLSLLTSWFPEFRPPSIPRDVADHQDATIAYHHRRRRRSQGRCRSS

SEQ ID NO: 207810 - protein, 83 aa, Triticum aestivum
  Clone ID: PAT_TA_102228.pep
EPLASGFISKLEFCLQESRSQIRKLQRMGEKRDKQLKELKDQMAMKQPKGPRRDEGKKPFWENDTFKFVAGMSMLVVMVLAKR

SEQ ID NO: 207811 - protein, 100 aa, Triticum aestivum
  Clone ID: PAT_TA_102229.pep
VQKYIKVYKPKCQNRRYIGWAIKNYRYVGDVSFIQRQRPHSTGSVHPMPPGMASKPPNNASLSSRGSIDCLISSSSEGIVDRFSNSQGFDRSSGSVMRYL

SEQ ID NO: 207812 - protein, 99 aa, Triticum aestivum
  Clone ID: PAT_TA_102230.pep
DQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFI

SEQ ID NO: 207813 - protein, 72 aa, Triticum aestivum
  unsure (1)..(72): unsure at all Xaa locations
  Clone ID: PAT_TA_102231.pep
MKTMQQGWLSNWLVKHEVVHRSLGFDHRGIETLQIKAGDWDSIAVILYVYGYNYLRSQCAYDVXPGGSLASV

SEQ ID NO: 207814 - protein, 100 aa, Triticum aestivum
  Clone ID: PAT_TA_102232.pep
RSQPQPHQHSIVNFRFLAVKMRRTRNLLLLRNGGRPSPLRPTSAWRRKTVDHAPPSSTLFKEGVVPAAAVLSTTRLTAAPADAALEHQQREYAVELARTT

SEQ ID NO: 207815 - protein, 66 aa, Triticum aestivum
  Clone ID: PAT_TA_102233.pep
MGKMPVRMKAVVYALSPFQQQVMPGLWKDITTKIHHKVSENWISATLLITPVVGTYQYAMWYKEQE

SEQ ID NO: 207816 - protein, 100 aa, Triticum aestivum
  Clone ID: PAT_TA_102234.pep
RYLQFLQGLQVLEEHPQQPVRDDASAQREAPHRRQELDVHLALPCVLADAQGADGQRVIPVQQVLLQQLEGLPVDVQREGAGFGGEGHVQVVGAAVLLYP

SEQ ID NO: 207817 - protein, 57 aa, Triticum aestivum
  unsure (1)..(57): unsure at all Xaa locations
  Clone ID: PAT_TA_102235.pep
IGFPILPYRRVPXIXFDFKPRKMVSRAGLHXLGLILQSSXHSPXSFPPSVLPASPFR

SEQ ID NO: 207818 - protein, 96 aa, Triticum aestivum
  Clone ID: PAT_TA_102236.pep
IFSAPQPAGFGADDAEEQNTRATARSRLSGEQLRQGPDHGLLHHVLGYSSVSSVLRSRRYDDEDSRANICLPLLLARKDAIELWIFTTILHFFVIV

SEQ ID NO: 207819 - protein, 43 aa, Triticum aestivum
  unsure (1)..(43): unsure at all Xaa locations
  Clone ID: PAT_TA_102237.pep
FXLFXSLLWRICAYSTLLSRTSIYKIYTTVKHRLLSTKNFISI

SEQ ID NO: 207820 - protein, 100 aa, Triticum aestivum
  Clone ID: PAT_TA_102238.pep
QEKCWEQYDSSGKAEKTADKWCSLDPNTPLDVGHAHVWHERWGETYDGSGGSVKYTDKWAERSEGDGWSKWGDKWDEHFDPNGHGVKQGETWWEGKYGDR

SEQ ID NO: 207821 - protein, 70 aa, Triticum aestivum
  Clone ID: PAT_TA_102239.pep
FQVDLTTYTSEELLTPPQPLKNPTRTKHEGRSRVQPPVRRQGHVKIFTCSIIRKKGEKKRGEKTMNRWVP

SEQ ID NO: 207822 - protein, 100 aa, Triticum aestivum
  Clone ID: PAT_TA_102240.pep
QITDVGRLMAELPLDPSLSRTLIEANELGCLSQALTVAAVLSAEITLRQTRSKEMEGKRKRQQLPDGSGWGDHVQLLQIFESWDQADYDPRWCSDHDLQV

SEQ ID NO: 207823 - protein, 56 aa, Triticum aestivum
  Clone ID: PAT_TA_102241.pep
RPKLGIKARIDLSGAIFGTQFFNRALIILRSFFLFSNNLTPRQEIKKFICIKRFLN

SEQ ID NO: 207824 - protein, 52 aa, Triticum aestivum
  Clone ID: PAT_TA_102242.pep
CVLILYFLDAPFEPIKLTLYRKKVRSIWKLSAESTHSHYSNKAFGPKQVGVG

SEQ ID NO: 207825 - protein, 100 aa, Triticum aestivum
  Clone ID: PAT_TA_102243.pep
LFKRSVTFVERNESDFTARVAEWGRLHEFADMIWQPQHNKVIYRQDDRVDVSTPGNGLGELFLFRSVPTALLVGGRAIEEQLQENGTDIARCAAEQEGFT

SEQ ID NO: 207826 - protein, 100 aa, Triticum aestivum
  Clone ID: PAT_TA_102244.pep
VLLLGGLGVVLLTNPIYSAFSLGLVLVCISLFYFLLNSYFVAVAQLLIYVGAINVLIIFAVMFVNGSEWSKDKNYWTIGDGFTSLVCITIVFSLMTTIPD

SEQ ID NO: 207827 - protein, 99 aa, Triticum aestivum
  unsure (1)..(99): unsure at all Xaa locations
  Clone ID: PAT_TA_102245.pep
ALCSEFMNGGTDTTVTLLEWIVAELVQHPDVQTKVYEEVKANPELNNMQAMPYLKAVVLEGLRXHPPGHXXLPHGVQSGDAEIAAYAVPKGAEVNFLVA

SEQ ID NO: 207828 - protein, 61 aa, Triticum aestivum
  Clone ID: PAT_TA_102246.pep
HATEISFLFWLLNSAVSLQCLNWYIGRHKKLSLLVSTYTTSLTDSTFQTYKGLALINCRVP

SEQ ID NO: 207829 - protein, 78 aa, Triticum aestivum
  Clone ID: PAT_TA_102247.pep
PVLAMPFSLLLLLLIFFLLYSTPSLFVAALTFLDHETSMVFLPLLLPHLMCCCERQAGRRQLWWRWRQICNTWLQVES

SEQ ID NO: 207830 - protein, 52 aa, Triticum aestivum
  Clone ID: PAT_TA_102248.pep
MYPEMDEGVNTASQTLIMGVAPSKGTPSFEAAAENGGCKCGPNCTCNPCTCK

SEQ ID NO: 207831 - protein, 62 aa, Triticum aestivum
  Clone ID: PAT_TA_102249.pep
PLLWVAIPMRLLLFRRVYSSRSLPGSCGCWELLMPVVNHEDTIHESRGVAVSPSSLHEYLIC

SEQ ID NO: 207832 - protein, 77 aa, Triticum aestivum
  Clone ID: PAT_TA_102250.pep
SLALASLALKRKLVHCARWRPPGLGRHVSRHVNLARCPLHRYLSSSGAGLARPPPGRSWYCLPREAWPLTRVLVCRC

SEQ ID NO: 207833 - protein, 92 aa, Triticum aestivum
  Clone ID: PAT_TA_102251.pep
ILWLIQLHDRYIDATHRYTCCLHMLSCVPFGHYIEMKYIFSTCFVLFCVLYITFLCCLCRNVSSIFLMLSFWLQNPLFISITNGSFILLNST

SEQ ID NO: 207834 - protein, 97 aa, Triticum aestivum
  unsure (1)..(97): unsure at all Xaa locations
  Clone ID: PAT_TA_102252.pep
MLRPAAAAVYPSSYHAPPPRFPAFPSGRRSAAIAVRCVNRDAPDTSKAKLKVGSPIVITEEPXMLKTAASVPSLRQNAGRVKPGDAGRIMAQKPKDV

SEQ ID NO: 207835 - protein, 99 aa, Triticum aestivum
  Clone ID: PAT_TA_102253.pep
CEEFPQTAACRGDGLARPPAGTTCVVMCATTAYRRGHASACTPAVGRLCRRAASRDMVVLCLREEPCVGYRCREVGAPLGLCRRRPPCRGRPQVRAQPC

SEQ ID NO: 207836 - protein, 78 aa, Triticum aestivum
  unsure (1)..(78): unsure at all Xaa locations
  Clone ID: PAT_TA_102254.pep
FHPSFILVMDRSPRFGSISSDNRPIKTRFRYGSGGFRSLNQATAYESPAHSSTGTRDSTCSMLLGSERKLVMLSATGX

SEQ ID NO: 207837 - protein, 80 aa, Triticum aestivum
  unsure (1)..(80): unsure at all Xaa locations
  Clone ID: PAT_TA_102255.pep
QHPITGYSRKMSQAATRVSQPLFRLHCHDFFYGQSLRINXAKRFMRYKGATCLENPASDQSSCGVKLSGATARRCAKRPA

SEQ ID NO: 207838 - protein, 97 aa, Triticum aestivum
  unsure (1)..(97): unsure at all Xaa locations
  Clone ID: PAT_TA_102256.pep
PISSVISCVVVCVCLRRAVVRLSLSCEARAXAQCPLSSLRCPPRSPQLSRLEVQLIVQLTRGCARRTYPHLRTTAQPCTTVSRSEAPSLQRSRHASL

SEQ ID NO: 207839 - protein, 85 aa, Triticum aestivum
  unsure (1)..(85): unsure at all Xaa locations
  Clone ID: PAT_TA_102257.pep
TKPIVSELXNKDFDSYXLSESXLVIYSQKIVIKTCGTTMLLXTIPRILELAEELCMPLAAASTRGMVIFPXHSXXHRSFSEEGDA

SEQ ID NO: 207840 - protein, 77 aa, Triticum aestivum
  unsure (1)..(77): unsure at all Xaa locations
  Clone ID: PAT_TA_102258.pep
SETVSEALFDTPRHCLSSNHMILFPAMFSAKPYKFISLLTTICKGASLSDPXHTSHQRGGVWKXKAAGCACHVCDDH

SEQ ID NO: 207841 - protein, 51 aa, Triticum aestivum
  unsure (1)..(51): unsure at all Xaa locations
  Clone ID: PAT_TA_102259.pep
SITTKVVCSGRCHLPRPPIILXAKSDVPCTTYTMKESQPTFGQYXCVENTF

SEQ ID NO: 207842 - protein, 46 aa, Triticum aestivum
  Clone ID: PAT_TA_102260.pep
SSCDRPRFFNLVRRDQNESLICGSLEDRNMTIVSISCFALIATSQS

SEQ ID NO: 207843 - protein, 100 aa, Triticum aestivum
  Clone ID: PAT_TA_102261.pep
ELARPGTIAKTQIQKPRDDVLQPSLGQIIAQEMKDSLVDAVQVDQRSVSSSTNNSKEVNIVPAEMQHSEKREESHREQEIDNTEKDSLPDKITADNEKPS

SEQ ID NO: 207844 - protein, 49 aa, Triticum aestivum
  unsure (1)..(49): unsure at all Xaa locations
  Clone ID: PAT_TA_102262.pep
MSVKMRTTCTWTERPYEALLFPAIGFGPFLRSLGGXRRRPXFRGGPSHQ

SEQ ID NO: 207845 - protein, 69 aa, Triticum aestivum
  Clone ID: PAT_TA_102263.pep
CRSCRIRHEGSQIFSEGGLDYLGNPSLVHAQSILAIVTGKGPLENLADHLADPVNNNAWAFATNFVPGK

SEQ ID NO: 207846 - protein, 70 aa, Triticum aestivum
  Clone ID: PAT_TA_102264.pep
GTSSCRIRHEFGTRRLATLAQSRTILFGLYDVHSILLKILFLRKFSNKHPLGQMNGVAKIPLDGGSTFLC

SEQ ID NO: 207847 - protein, 95 aa, Triticum aestivum
  unsure (1)..(95): unsure at all Xaa locations
  Clone ID: PAT_TA_102265.pep
YYLCRLKIPPFLPTTSRPPDPXANGSVXSRLPRLRLLVREHYHEFRRYGQEAIQRHQRYNLHSCRTLRRRFVSHGPMILPRPYEETADIVXRWPA

SEQ ID NO: 207848 - protein, 67 aa, Triticum aestivum
  unsure (1)..(67): unsure at all Xaa locations
  Clone ID: PAT_TA_102266.pep
RRLYRERRHRRGSPARPRRGGAYAQQASSSAAACSQARRGRVGSQRRXRCGGALSGRRVARAEFGTS

SEQ ID NO: 207849 - protein, 67 aa, Triticum aestivum
  unsure (1)..(67): unsure at all Xaa locations
  Clone ID: PAT_TA_102267.pep
SLLTKXVKNQEVEGFIMTPLFFSLSIFXNRFLLVWGRRVFLFFTTVTICSCSVSSYERLFILLSYIR

SEQ ID NO: 207850 - protein, 100 aa, Triticum aestivum
  unsure (1)..(100): unsure at all Xaa locations
  Clone ID: PAT_TA_102268.pep
LVRFARAARALVFCFLFLXMTILLCMIEMPYPGTVLLWVQLWGKXWVAFACLXAFGXNVGTFRNTGKHIFTHAHTNMHAHPYECRHAHQYPYEHLGRPNR

SEQ ID NO: 207851 - protein, 73 aa, Triticum aestivum
  unsure (1)..(73): unsure at all Xaa locations
  Clone ID: PAT_TA_102269.pep
ICSWCYVYGFHVSVVLIVCVMYFILNLLVSFVLVIGGVIVGSDQRPSKPLSCIFXDLHVTXSAGVISCLLLQV

SEQ ID NO: 207852 - protein, 101 aa, Triticum aestivum
  unsure (1)..(101): unsure at all Xaa locations
  Clone ID: PAT_TA_102270.pep
NGVVEYAQQXEKLGNTLLELXSEALGLKPSHLADIECNQAQVLLCHYYPPXQPELAIGTKPHSDGXFLTILLQDEIGGLQIFKEERWVDXTPTPXAFIVNI

SEQ ID NO: 207853 - protein, 80 aa, Triticum aestivum
  Clone ID: PAT_TA_102271.pep
NAVIDRQKNHGMHFRVLAKALRMSGGDHIHSGTVVGKLEGEREMTLGFVDLLRDDFIEKDRARGIFFTQDWVSMPGVIPV

SEQ ID NO: 207854 - protein, 100 aa, Triticum aestivum
  unsure (1)..(100): unsure at all Xaa locations
  Clone ID: PAT_TA_102272.pep
ARARAEFTSDEKRNTDKWKGXLAYDISDDQQDITRVMVIVDSVXQAPTADVTHEARLSSYEYVXSXGLTKYDFHNTMXGFYIAPAFMDKLVXHLSKNFMX

SEQ ID NO: 207855 - protein, 88 aa, Triticum aestivum
  unsure (1)..(88): unsure at all Xaa locations
  Clone ID: PAT_TA_102273.pep
YYVHVHIHSHRVAFTYEHAFSSHVGEHGHTHILILGXSKKDKWKRKAQSNVRVDKTAMXLYMWPVVSELTTAMHHLCPRSRGHPSLSS

SEQ ID NO: 207856 - protein, 99 aa, Triticum aestivum
  unsure (1)..(99): unsure at all Xaa locations
  Clone ID: PAT_TA_102274.pep
YAPPACRYRRRSNHDEYMSSCRLAGCCCFLTPKDVTCAAPRPARXSTAFRPATPSPAAWSTSAPRTRTTAPEMRRAVHEGLAPVGEAAARALKPSSHGG

SEQ ID NO: 207857 - protein, 76 aa, Triticum aestivum
  unsure (1)..(76): unsure at all Xaa locations
  Clone ID: PAT_TA_102275.pep
SPXXSGFLSLMRQAPYDSLASSDSITRSRFIKALHSVRKRKGRKGGQDRIRTLDLLQITPCNARIGGNLCFQATER

SEQ ID NO: 207858 - protein, 78 aa, Triticum aestivum
  Clone ID: PAT_TA_102276.pep
ESAPREPRGAANKAVVARRPSSAILGLMADRACPSVTTGHAFPPSPWALLQPLDRGYAYSSPLNARRDPRKRPVRPCE

SEQ ID NO: 207859 - protein, 86 aa, Triticum aestivum
  unsure (1)..(86): unsure at all Xaa locations
  Clone ID: PAT_TA_102277.pep
ASANSVPAAAVRQRMQALSAPERRTRSAPPGXSFILLRDRVNTPDDDPPRNTYLLRTPTLLASRRSHEHYRCAIILLYIYNXSELS

SEQ ID NO: 207860 - protein, 47 aa, Triticum aestivum
  Clone ID: PAT_TA_102278.pep
HGHTHILRTNKKDKWRRKTQSNVRVDKTAMALYMWPVVSELFRVPNS

SEQ ID NO: 207861 - protein, 92 aa, Triticum aestivum
  Clone ID: PAT_TA_102279.pep
DHHRYIQEEHRATLAHSGRRTQSYSCTVLATELELATPSSETEGTQSLSLLLQALKCATPSLNSQVSTEPLPNRVHIAPQSSYYKPICLSFV

SEQ ID NO: 207862 - protein, 68 aa, Triticum aestivum
  Clone ID: PAT_TA_102280.pep
ERYGFSAQLKLYPFPSAWTRRDMKYLTKTGFHSTFLFLNNNLCYQLFRVFKVILLIVSYPIFDFDSMV

SEQ ID NO: 207863 - protein, 62 aa, Triticum aestivum
  Clone ID: PAT_TA_102281.pep
ENSARGCQVEDRTCLISELSVVAAQEKVMLDECRELLAMAAELEVQESSLRTHLMQVKDLSR

SEQ ID NO: 207864 - protein, 58 aa, Triticum aestivum
  unsure (1)..(58): unsure at all Xaa locations
  Clone ID: PAT_TA_102282.pep
SGFPYSXDIFSCFFHQTIYCKASPILMSNVGGLFDNASIALALKERPXLHLSNPLSST

SEQ ID NO: 207865 - protein, 99 aa, Triticum aestivum
  unsure (1)..(99): unsure at all Xaa locations
  Clone ID: PAT_TA_102283.pep
IPLGVDWPVAVDVGTVRCTTWYXALLADXPAVGVDVAVKPPPSPRGLSPCLXATAQRGEESPAGEDARSSRXIARYHELPSRSSLKFFFWLSSIHQPGS

SEQ ID NO: 207866 - protein, 93 aa, Triticum aestivum
  Clone ID: PAT_TA_102284.pep
ATQLLCQSHYIFIHPNRKKPTHFSCFFDQALMGHRSDITVSLSSDSTIPPVTHKTMYVRRAGRSAALLVVLSTDDGGAITDYSGRRLQVGGGS

SEQ ID NO: 207867 - protein, 91 aa, Triticum aestivum
  unsure (1)..(91): unsure at all Xaa locations
  Clone ID: PAT_TA_102285.pep
PGWEARAAIGQSGLMAIYDTLXNQVGLLNVGLSFVIGXAEVWSFLLISNQMLVSLKVLVCLFPSCSSCSSSMSLANKVRCALIATLDCFLQ

SEQ ID NO: 207868 - protein, 99 aa, Triticum aestivum
  Clone ID: PAT_TA_102286.pep
LQWSSGKASLTHRLCMLRCSFAAAMKQLIALCCCNAASLSMCSSAAGHAAARSTSRSCSSAVDVPQCGRASPTQLCRGHAGASSQPSSTATRGKQATGI

SEQ ID NO: 207869 - protein, 84 aa, Triticum aestivum
  unsure (1)..(84): unsure at all Xaa locations
  Clone ID: PAT_TA_102287.pep
FGVQKNWPSSHALLSSRRSGRPYYSDEPPPPPRLAAPWAVSVCFNPPANRCCSLSRPSPPLGQXPQIEPPLVPNSARAARARAN

SEQ ID NO: 207870 - protein, 98 aa, Triticum aestivum
  unsure (1)..(98): unsure at all Xaa locations
  Clone ID: PAT_TA_102288.pep
AYLSGECIECMATSDNVVRAGLTPKYRDVQTLCXMLTYKQIFPEILRGVLCKPYVRRYTPXTDEFEVXXAACCSGEVVVMPPVPGPXIFLVMTGEGEV

SEQ ID NO: 207871 - protein, 53 aa, Triticum aestivum
  unsure (1)..(53): unsure at all Xaa locations
  Clone ID: PAT_TA_102289.pep
LISPQKKGYVHSYDTIFSLSRFLDSKSKINQIQTKIPLIXPKEFTYIHSPLYF

SEQ ID NO: 207872 - protein, 50 aa, Triticum aestivum
  unsure (1)..(50): unsure at all Xaa locations
  Clone ID: PAT_TA_102290.pep
GSWYXQQCGSQAGGAXPNCLCXSNSGLRSTYDYCGGXCRAVNGCGGAAVG

SEQ ID NO: 207873 - protein, 70 aa, Triticum aestivum
  unsure (1)..(70): unsure at all Xaa locations
  Clone ID: PAT_TA_102291.pep
SWFSPKCVEAQQLTGHLGVKHCFGAGCAERTKSRQTLNTRYDPSTVIPVESSEEEDWGDSKYMNXVPQTX

SEQ ID NO: 207874 - protein, 100 aa, Triticum aestivum
  Clone ID: PAT_TA_102292.pep
YFMQHRRPQLVAPPAAAPLPSLQRHRQQQGDGDGPEKLQRCSGPAPPETLHRRSAPTPPETLHRRTLPTAGAPSQHRRTHKHRAAVSQRMGPAGQYGRCL

SEQ ID NO: 207875 - protein, 99 aa, Triticum aestivum
  Clone ID: PAT_TA_102293.pep
DIQALLRRCPCLRVLKIISLDARRIVIQSASLQELHILNAVKRCEYDTYSIDIAAPALKHLNLSVFTHHNCSLNISAPMVEQFSWECKYAYMATGIGEL

SEQ ID NO: 207876 - protein, 66 aa, Triticum aestivum
  unsure (1)..(66): unsure at all Xaa locations
  Clone ID: PAT_TA_102294.pep
GIILGFEIVAKEYXLCEITCLGYTSNTIFXHHKRDILQYIYIYIYIILLSSQTGRCCRCSHCLAHF

SEQ ID NO: 207877 - protein, 69 aa, Triticum aestivum
  unsure (1)..(69): unsure at all Xaa locations
  Clone ID: PAT_TA_102295.pep
PNLYPHSRFISVVXCQLEVPRTMHSLIGPPEYPATLTWEWMHKDVVSAEYNHKVKVQRFLSIHQKASCQ

SEQ ID NO: 207878 - protein, 74 aa, Triticum aestivum
  Clone ID: PAT_TA_102296.pep
PRLADRSEVITTVGDVAPGWCPNLSRRISREAGGQGRANLSRRLDYWHPTVTPEICIGGRWAMLIEAPRGAALA

SEQ ID NO: 207879 - protein, 100 aa, Triticum aestivum
  unsure (1)..(100): unsure at all Xaa locations
  Clone ID: PAT_TA_102297.pep
MIXPGRRRGRAXEVPQVLAWPXGLWCPTAAAPSKRAVRVGIDRSQPTRSTPCIGARXKRDRRPLPRISREEVRFRRHLRRPIEAAATLHQYRGPIVVTKI

SEQ ID NO: 207880 - protein, 52 aa, Triticum aestivum
  unsure (1)..(52): unsure at all Xaa locations
  Clone ID: PAT_TA_102298.pep
SXFHLPSCGSQTPFQAVGYFIPSRARSRPSSSLSQLLKHSISCCPGAFPKMS

SEQ ID NO: 207881 - protein, 79 aa, Triticum aestivum
  unsure (1)..(79): unsure at all Xaa locations
  Clone ID: PAT_TA_102299.pep
HQATKALRTSASERVAAAHQNSSGMKNVRARSLRWAGPHQGTRRFEGILXVTAALAXLHRERRDNGPWXKILPTGAPSC

SEQ ID NO: 207882 - protein, 100 aa, Triticum aestivum
  unsure (1)..(100): unsure at all Xaa locations
  Clone ID: PAT_TA_102300.pep
LWRESHPRSGMLAGESCSKLPSAFALEDQCPSGRETLCTLRXLLEAXAHRTCLLELVPWPRVCTRLESEXSRVVLTMLGPPERGLLRFHLSWQKAQSHSR

SEQ ID NO: 207883 - protein, 85 aa, Triticum aestivum
  unsure (1)..(85): unsure at all Xaa locations
  Clone ID: PAT_TA_102301.pep
NISSHCRRASFGWXTSARASLVIVASXKRRXSRLPTLRACGEWCQGGVDAVGRAXKGKGVTSLPTSIEQTLWVQPVYTQKNGSSV

SEQ ID NO: 207884 - protein, 63 aa, Triticum aestivum
  unsure (1)..(63): unsure at all Xaa locations
  Clone ID: PAT_TA_102302.pep
VPNSARGQEQTRLCTQTVVGSYXYMAPEYLYRGEISAQSDIYXLGLXIIEIAXRRAESSRKRP

SEQ ID NO: 207885 - protein, 64 aa, Triticum aestivum
  Clone ID: PAT_TA_102303.pep
CRIRHEELKVKELKNGRLAMFSMFGFFVQAIVTGKGPVENLFDHVADPVNNNAWPFATNFAPAC

SEQ ID NO: 207886 - protein, 53 aa, Triticum aestivum
  Clone ID: PAT_TA_102304.pep
ERLHGKKFIVSYRNDQTLNAEFFYFKVQATEHLENEAPLESLPMINTIVVLDV

SEQ ID NO: 207887 - protein, 71 aa, Triticum aestivum
  Clone ID: PAT_TA_102305.pep
IVIPMMFREMKWYYVVIAYLLAPALGFCNAYGAGLTDINMAYNYGLWIFPSALLALAKISPPFCMAFRPTH

SEQ ID NO: 207888 - protein, 65 aa, Triticum aestivum
  unsure (1)..(65): unsure at all Xaa locations
  Clone ID: PAT_TA_102306.pep
TVKAEAVAKDTSSIXERRGGAMNVVKPXRRRPXXAKTQYISLHDAIGACNSASFHSYDRWXGLXV

SEQ ID NO: 207889 - protein, 82 aa, Triticum aestivum
  unsure (1)..(82): unsure at all Xaa locations
  Clone ID: PAT_TA_102307.pep
MAAAFFSTVGAPASTPTNFXGKKLKKQVTSXVNYHGKSSKANRVTVMAXAENIDEKRNTXTKWKGLAYRFFDXPGGHTRGXG

SEQ ID NO: 207890 - protein, 63 aa, Triticum aestivum
  unsure (1)..(63): unsure at all Xaa locations
  Clone ID: PAT_TA_102308.pep
MAGFGSLAPKTKNFVVAGGLLLSSSVXYYTMRAVGGTDELQVAIDKFEDMKKNDAGNSSTAGS

SEQ ID NO: 207891 - protein, 56 aa, Triticum aestivum
  unsure (1)..(56): unsure at all Xaa locations
  Clone ID: PAT_TA_102309.pep
RHISHFVRRAGTMAGYKPAXNIFYEDKSRERRATGYRFVASCSTDSKTQCVYDRWD

SEQ ID NO: 207892 - protein, 62 aa, Triticum aestivum
  unsure (1)..(62): unsure at all Xaa locations
  Clone ID: PAT_TA_102310.pep
MGKVHGSLARAXKVRGQTPKVAKQDKKKKPRGRAHKRMQYNRRFVTAVVGFGKKRGPNSSEK

SEQ ID NO: 207893 - protein, 58 aa, Triticum aestivum
  Clone ID: PAT_TA_102311.pep
PANAQRHRIEQGVAAVAAVGAGGYAYHEHREQKQASYGAKEQQYGYARMPQQQGYYCN

SEQ ID NO: 207894 - protein, 82 aa, Triticum aestivum
  unsure (1)..(82): unsure at all Xaa locations
  Clone ID: PAT_TA_102312.pep
MVNGYLFREYIGAQFTGVXRFSDVPVNPGLSFHFILAFAIDYFMATQSSKPAPANGVFAPYXDTANLSPRAVAXXKAAHPNL

SEQ ID NO: 207895 - protein, 75 aa, Triticum aestivum
  unsure (1)..(75): unsure at all Xaa locations
  Clone ID: PAT_TA_102313.pep
VFSTYPPVVSGTGTPLLKVVRAFPGSMAWVTYFSAVAPGMSLVXKQWLVHGAHTSALQRLVLGPRLEGGPTQFAL

SEQ ID NO: 207896 - protein, 100 aa, Triticum aestivum
  unsure (1)..(100): unsure at all Xaa locations
  Clone ID: PAT_TA_102314.pep
LXLSGYSLIIRILRFGLLVKIADYKXNAILQILRYNFHSPSXGTVGRRSVGLSLFAVRRGCXKRLVERRFPADVVNAAVMYRXXRRWDGPPSCVSNRRAV

SEQ ID NO: 207897 - protein, 51 aa, Triticum aestivum
  Clone ID: PAT_TA_102315.pep
ARGQGGGESGRRSARTRTARPLRRQARTRMDMEEQRRPPPRHAAIDVRSKR

SEQ ID NO: 207898 - protein, 96 aa, Triticum aestivum
  Clone ID: PAT_TA_102316.pep
CTCTRSKQDHHVGFAGSFYKIDYNLSAWCYSPDSFLQVAGFICEPRRGSPAGESATSTSPGASPERGRRDSSSGVRCFVFFTGGERSRASVHSSSC

SEQ ID NO: 207899 - protein, 95 aa, Triticum aestivum
  unsure (1)..(95): unsure at all Xaa locations
  Clone ID: PAT_TA_102317.pep
DRSPXPEIDXKAKTENREVEDTDKCSHPPSRGDDGVKSNAKQPIGFKIDXNSNIKSSTTSEYRSAFTVRGKVEDGCTTSSDVGSTLGDQCKLAVS

SEQ ID NO: 207900 - protein, 91 aa, Triticum aestivum
  unsure (1)..(91): unsure at all Xaa locations
  Clone ID: PAT_TA_102318.pep
TGTSCYACCCTQAQVAGRVVRSPRPTASAGKELKDEGCGEADERRQRHVEVEQHPWPTAGLPGAAAPAGRATAGGAGEARAGAXGHRAAME

SEQ ID NO: 207901 - protein, 100 aa, Triticum aestivum
  unsure (1)..(100): unsure at all Xaa locations
  Clone ID: PAT_TA_102319.pep
SLLSCXAGASPHSVGDDDDSPRSKGEPAFVARYARSLFHRAXALLSLARAPLLIGRAAPAPTARARXDARFLAXPDAAXGSDFGALGVXWCRSKTGKIVE

SEQ ID NO: 207902 - protein, 71 aa, Triticum aestivum
  unsure (1)..(71): unsure at all Xaa locations
  Clone ID: PAT_TA_102320.pep
MAAASAAAXAEGTVIAIHSLDEWTIQIEEANSAKKLVVIDFTASWCGPCRIIAPVFADLAKKHTNAVFLKV

SEQ ID NO: 207903 - protein, 76 aa, Triticum aestivum
  Clone ID: PAT_TA_102321.pep
AREGEMGEKGEEGHLSAFACRSICHGQPPLAMTVEAAKTVETALGKELTAAAGHVAAKLVGRLVPLSSSSLDPRCR

SEQ ID NO: 207904 - protein, 100 aa, Triticum aestivum
  unsure (1)..(100): unsure at all Xaa locations
  Clone ID: PAT_TA_102322.pep
GTSIAPLIIPFGVAYFALGWIIVKNQVLRVYXPSYESNGRMWPHMHTRIIAALLIYQITMVGVILLKKXLYSPVLVPLIPISFIFAYICHMRFYPAFAKT

SEQ ID NO: 207905 - protein, 70 aa, Triticum aestivum
  unsure (1)..(70): unsure at all Xaa locations
  Clone ID: PAT_TA_102323.pep
ARARAEFGTRAWVTYFSAVAPGMSLVEKQWLVHGAHTSALQRLVLGPRLEAFSLPLLTLKKQXHLASLNL

SEQ ID NO: 207906 - protein, 90 aa, Triticum aestivum
  unsure (1)..(90): unsure at all Xaa locations
  Clone ID: PAT_TA_102324.pep
MALRGVHTVAPFQGLKCTAGMPVARRXGNSSFGNVSXGGRIRCMXVWPIEGIKKFETLYYLTPITVEDLLKQIENLLRSRGCLLEGPVPP

SEQ ID NO: 207907 - protein, 97 aa, Triticum aestivum
  unsure (1)..(97): unsure at all Xaa locations
  Clone ID: PAT_TA_102325.pep
XQKVFVLSPLYDPMKGEAMQKHVQEVELQYLYEMLGQGLRPVSSVCAGNVVAIQGLGHHILKSXTLXSTKNCWPFSSMMLSDGKTRAEFLQPXGPLV

SEQ ID NO: 207908 - protein, 41 aa, Triticum aestivum
  Clone ID: PAT_TA_102326.pep
GTRPCAPSVEAEPLGRFILACTPEGLDELARGQPAACTTAQ

SEQ ID NO: 207909 - protein, 100 aa, Triticum aestivum
  unsure (1)..(100): unsure at all Xaa locations
  Clone ID: PAT_TA_102327.pep
AVPKTSRLHRESFFCRSSVDAGPLPPMLLLLASKKQGCLEHKARVTPFNAAGGGAHRAPVTAATTGRDAATTSGGGCCCWCGKAKVEVRSWRAGXRRDSS

SEQ ID NO: 207910 - protein, 53 aa, Triticum aestivum
  unsure (1)..(53): unsure at all Xaa locations
  Clone ID: PAT_TA_102328.pep
DPHKAXVIGDTIGDPLKDTSGPSLNILIKLMAXESLVFXPFFATHGGILFKLF

SEQ ID NO: 207911 - protein, 188 aa, Triticum aestivum; identical to SEQ ID NO: 179719
  unsure (1)..(188): unsure at all Xaa locations
  Clone ID: PAT_TA_102329.pep

SEQ ID NO: 207912 - protein, 167 aa, Triticum aestivum
  unsure (1)..(167): unsure at all Xaa locations
  Clone ID: PAT_TA_102330.pep
MQIFVKTLTGKTITLEVESSDTIDNVKAKIQDKEGIPPDQQRLIFAGKQLEDGRTLADYNIQKESTLHLVLXLRGGMQIFVKTLTGKTITLEVESSDTIDNVKAKIQDKEGIPPDQQRLIFAGKQLEDGRTLADYNIQKESTLHLVLRLRGGMQIFVKTLTGKNHHP

SEQ ID NO: 207913 - protein, 78 aa, Triticum aestivum; identical to SEQ ID NO: 179720
  unsure (1)..(78): unsure at all Xaa locations
  Clone ID: PAT_TA_102331.pep

SEQ ID NO: 207914 - protein, 136 aa, Triticum aestivum; identical to SEQ ID NO: 179721
  unsure (1)..(136): unsure at all Xaa locations
  Clone ID: PAT_TA_102332.pep

SEQ ID NO: 207915 - protein, 92 aa, Triticum aestivum
  Clone ID: PAT_TA_102333.pep
LFYSLLGVTSQSLLFSFLPACSFCGVGQNSVCDTLSGRHAPLKELFVYPVTVCCSYRSVSSDLVSPVFFRACPDVSCASCTGSPRAADRHRP

SEQ ID NO: 207916 - protein, 166 aa, Triticum aestivum; identical to SEQ ID NO: 179723
  Clone ID: PAT_TA_102334.pep

SEQ ID NO: 207917 - protein, 143 aa, Triticum aestivum; identical to SEQ ID NO: 179734
  Clone ID: PAT_TA_102335.pep

SEQ ID NO: 207918 - protein, 147 aa, Triticum aestivum; identical to SEQ ID NO: 179743
  Clone ID: PAT_TA_102336.pep

SEQ ID NO: 207919 - protein, 49 aa, Triticum aestivum; identical to SEQ ID NO: 147490
  Clone ID: PAT_TA_102337.pep

SEQ ID NO: 207920 - protein, 111 aa, Triticum aestivum
  Clone ID: PAT_TA_102338.pep
QPVGRVMASQLNSTYGLSFVSTTGPALPSAGSNLVAWSPPVQSSLIPGPNDGRGVEQTVYCRWYWETLPFPGFADVQLLGDRGRVRPAAFGIPVPGWVREALCMLVLTLCG

SEQ ID NO: 207921 - protein, 47 aa, Triticum aestivum
  Clone ID: PAT_TA_102339.pep
RGCCRIRDNGVCRKLPITLLGLLYILGDYADCRRTWLRARGRMRLPG

SEQ ID NO: 207922 - protein, 143 aa, Triticum aestivum
  Clone ID: PAT_TA_102340.pep
HYLYPEYPQPDRRPRPQGPKSVPRLLRLPSGAGAVPLIRWLQPVEAKTRGRTGPPFPCPKAASSGCIPTRTIRGAAVLARCSGWRACYATQRFDTAGSGSRAKKDCWSLASAGCARHHRLLPFGIGSRTGTTVCAPFFEVNVA

SEQ ID NO: 207923 - protein, 70 aa, Triticum aestivum
  Clone ID: PAT_TA_102341.pep
PSVTHPGGGFHVLNLRSQIGLPRWDPIKQFWVTHNKGNRHYKHSFCVKKGLVRLWRMRTRPRLCLERFVN

SEQ ID NO: 207924 - protein, 81 aa, Triticum aestivum
  Clone ID: PAT_TA_102342.pep
DRLTKSNILRGRKRATGLKTTDRSSICLNESEKAYLKGPIRKLRGRRERMGTGGELKGMYRDWELQNSQNVLADGGRVHCG

SEQ ID NO: 207925 - protein, 120 aa, Triticum aestivum
  Clone ID: PAT_TA_102343.pep
QTLAAARRRTRSWPGRRRSMRGKFLVAAPSTRRTNRPAYAAHGPWKHGSPTVTIDAGCFPWVPPGRHLAPMIAALHRPERNCTHTARMFQCFLPPPAYQSEHLFPSFPPGPIQSGNVASK

SEQ ID NO: 207926 - protein, 84 aa, Triticum aestivum
  Clone ID: PAT_TA_102344.pep
SLGQLMADFQSLTGLGNQFLRNLPDLNLIDLVFEERHPRNTYPYIRPNFEYKRSRFNPIRYHHPTSTSYGLLLLLPSWPLCLPS

SEQ ID NO: 207927 - protein, 241 aa, Triticum aestivum
  unsure (1)..(241): unsure at all Xaa locations
  Clone ID: PAT_TA_102345.pep
LWIPTSYPARSLPTTPGPESPSATHPLAAAPYPIWSTPIPVPPGPQPPLPSSPPTPLPPPPATSPSPSGCADRPPPVHPIALSASNASPRPPSPTHPQTPPSPAXPAFAFSAPVRPSPVVPPAPYPFTASPPPHPPAPRESQPPVPPDSPLGQDPPRTPQHPTNPRTPTPPVPPAVPPPXPYPRSRAAPVTVYPHSRPLSLSLTRPGPGSHSDEPLLPPTGPSSPTTVPPQPHPRFSTLPP

SEQ ID NO: 207928 - protein, 151 aa, Triticum aestivum
  Clone ID: PAT_TA_102346.pep
TWHCTISSSRTAGTKHASDPDRARVPGIYHFGNIRFGPSDSYRGDLRGYDSSDVRPKDRYVRCVDRKGRGHSCVRSNWGRRVCAYGMKRNGVWALIKRQGRDTWGKPPWPGRLAIRSGSMLRSGTSDIGVRYTGRLRLSLGQEYREMMSLV

SEQ ID NO: 207929 - protein, 118 aa, Triticum aestivum
  Clone ID: PAT_TA_102347.pep
DHNGPATGNCVHQCPLCCFAVSWNIGISGFTNFQHVPVREHRKATHKSVKSPWVACPTLEAVALNIPQLRRHQACRPPTEATESYRKEPSEKAGAPVALSHNESQPAKAALPRLSTPA

SEQ ID NO: 207930 - protein, 138 aa, Triticum aestivum
  Clone ID: PAT_TA_102348.pep
LLIAYVSYMAASSDASVGIHSAGRLVTIQRASGGADRCDRLQPIARLQPYRGAADVNSSRCGRECYLLYGASTKPAGHLRVRKWHSPRVMAAFSSTPTHRRNRFVSFIRRIFKRWSKARGEHAWGHDVGREDGNGWSK

SEQ ID NO: 207931 - protein, 95 aa, Triticum aestivum
  Clone ID: PAT_TA_102349.pep
VCRCSWSHLIVGCFTTCIARYLSHIRIGSGCIFSHSLRDGFLPPQSLLRVCCAAIGLFYHLCTSLVLFISHCSDDALLIILLSSILGIFVDMCAL

SEQ ID NO: 207932 - protein, 70 aa, Triticum aestivum
  Clone ID: PAT_TA_102350.pep
NSLFLLIKLIISITHIYCRNDFNFLQLIFRNSSIQHFHILLNALVNYMNLLPTNPSFLDFTSMNLIMKLI

SEQ ID NO: 207933 - protein, 61 aa, Triticum aestivum
  Clone ID: PAT_TA_102351.pep
PNKSAPLTHETNSSAIPLRPDNCISCIQLSLWFTSCKQTHQHRLVERRNSILTRLTTIHLG

SEQ ID NO: 207934 - protein, 100 aa, Triticum aestivum
  Clone ID: PAT_TA_102352.pep
TVWLTIVDTANGDLVEAYSPGHRAEGFTRPWQYPRIASIPVRRSVCMLGCAVVRMPLPDRRRHQAVTGESPGSWSRIDQCTPPAGVVIADGSYQMLQCAS

SEQ ID NO: 207935 - protein, 135 aa, Triticum aestivum
  Clone ID: PAT_TA_102353.pep
TTVSRTMTHLNFPCTRIQSDHSVQYRLQRGLLFRDRRCILVQSPVLRCRRPSKHVLLLRVLCHYEHFILPVCPRDAYFGRRSVGQHRAVHKNPCNSVSNILYCSCYPSLGTWRAVVEATKSAVSCSSLRYVERQL

SEQ ID NO: 207936 - protein, 49 aa, Triticum aestivum
  Clone ID: PAT_TA_102354.pep
SIEILMNTTVLLLRYDYFTLHVPYTYFISYYLIKTFSDLRSFPIYSHIL

SEQ ID NO: 207937 - protein, 149 aa, Triticum aestivum
  unsure (1)..(149): unsure at all Xaa locations
  Clone ID: PAT_TA_102355.pep
PSTVHNVLPPAVATAPFPLLSVNAPDSPPHTALSRHYPPTSSPTAPTRHRRLYPHSPYLPPPPHLVPPLASAPALXHPPPSVVRSPHALTTPRXPFLTPPPSQHPANPRLPAQPPRLCAPTSLMRAPPFLEHWPAQAESYLVTRRDPPH

SEQ ID NO: 207938 - protein, 104 aa, Triticum aestivum
  Clone ID: PAT_TA_102356.pep
QYYLEGTAKRCTIPCPHVQSCTGIGHQTLTLRGGRYEDGLRFRQFSSPACSVELSGRTGKSGIISELRLLIVITTGLLARSMVSSRRRVDLLSSYIGNCSTGHG

SEQ ID NO: 207939 - protein, 111 aa, Triticum aestivum
  Clone ID: PAT_TA_102357.pep
LESAIIRNHNRTAASPWSISTLTPQFSRRCQPLNLFGYYPENGDPAMPGVIAASLLFPATASLSLKPMGKFGRLRAQTMVHVSTSSRSKSVTADMHIQTLIHYTDHSKHFP

SEQ ID NO: 207940 - protein, 81 aa, Triticum aestivum
  Clone ID: PAT_TA_102358.pep
RVKLQILNRSKMRKVHSMRQFTSLKCTKTDHTLSTTSGYNSAPRRYVTSVDRSLLHVGRLNTCLVGFSDSACRSRQVTTAS

SEQ ID NO: 207941 - protein, 101 aa, Triticum aestivum
  Clone ID: PAT_TA_102359.pep
DTAGTTRATPVSPQVVTEERSPSPECANSRRGGHAHRAKWRTLAQDQPYPVLSIRDAHDTSKHDRCESGSSNELSEDLTSKSDKLTTAYSSAHLMTCGRHS

SEQ ID NO: 207942 - protein, 109 aa, Triticum aestivum
  Clone ID: PAT_TA_102360.pep
WHVHDTYRTYSLRGPSHHGSVLELHQAIVLHDRSEIFHPIAVGQAPMIAYLDPELWQSIYKILAIRPVVILWDRGWQVTPRCENIRTIEEPGLQDCYRSLARQPRHSTM

SEQ ID NO: 207943 - protein, 99 aa, Triticum aestivum
  Clone ID: PAT_TA_102361.pep
TAIRRADLCGEDGIVGTSQVASCDPSRSIPDNAGKRALTTSARPSLNCLTRQNSLRHAGDLTWRAGLHNATRSEPIAPLLYSAGMSYNASSARLTLSRF

SEQ ID NO: 207944 - protein, 314 aa, Triticum aestivum
  unsure (1)..(314): unsure at all Xaa locations
  Clone ID: PAT_TA_102362.pep
MPTAARQTLACARLATTVAPGFPPHPREDAAYPAPPSPFQPQASQRSHVPPRTXLPVRPASGPPFRHALPSTHPQLCAPPPKPFSTMPLPPHRDNPPPNLLPLPFLDLLATTPPFPPSRPQPARSLRLPAQTRRTYRTPSSPYPPRESSCSRTPTPIRSSPLVPLPRSLSTPYVPPLHLIAGSGHTPPRSVSGRSVREATRPTRRCPATRATPTASRAAHPARLPLIGFSTLQHRLDAPPAVLLRVAPPQMIPLSATPASQLPCRPKLRRLLPGRSPQRRVPQKRQTPLVLFCRPHLSAAPLSSPPTSSGARRT

SEQ ID NO: 207945 - protein, 146 aa, Triticum aestivum
  Clone ID: PAT_TA_102363.pep
LPAPYCTAPIVSTRSFRVLPESNRSPIKSHARAHKLQRPTNYRAPSPNHPLMFLTLAWLHNVLSDQLCTSDSLLTGAQFRPHVPTISYTPSQDYHLRCMLLKVPFASTRFPSNNALVEPVYSTQGLSILLHVLHNKARQTLTLTSL

SEQ ID NO: 207946 - protein, 179 aa, Triticum aestivum
  Clone ID: PAT_TA_102364.pep
LFFGSDVGSLKELLRFTRARFQSRVWLGSRGAYFSLMASCSLFLSPEIRFYLRGDAMLRRSRPQLAAVLYLSFTFLCLDSISTFDGIFALRDISFGLNSLNSSGRRLGCVFRLRESHLFDYLSYCGFIFVSVLYLAFSGFGAAKRTANVAEWSRIFPGVGLVTLVYPLLDQHFLLPLSR

SEQ ID NO: 207947 - protein, 98 aa, Triticum aestivum
  Clone ID: PAT_TA_102365.pep
GLPVLAKSWDAELQPASAQWGLTPCEGALGEPSGRSITDSAVAEAVSNLSTDWSSGANGPISHHAMTAKKYPPSQCRLVVWDESYGMPADARIDVTHA

SEQ ID NO: 207948 - protein, 137 aa, Triticum aestivum
  Clone ID: PAT_TA_102366.pep
SSNLDNISTHIYGYAHKLPFPIVSQTHSNRPTRILVHTILQLMQMNLGPLSRQDSITILEHLYDMRLGKTHHLLWKTRSSRKIDKTRHRQRIEFPLVLQRFMILGVSKLPGYILYDPIQIRSHNFLSQHHPFHTMRV

SEQ ID NO: 207949 - protein, 151 aa, Triticum aestivum
  Clone ID: PAT_TA_102367.pep
QGDNPLSAETFKPADFGGWCDFKSGVLRASLFARKYRRMTFAPIRAGITRYSVTTHLPGLKGPLSKSPAQFAKRAVAHRALRCNMITRQPGSYRRRVKRFRYCNMRHLGPAHTPRHAWFGHWDARREMSSPLVPHPSLRTADLQTTTQGRI

SEQ ID NO: 207950 - protein, 69 aa, Triticum aestivum
  Clone ID: PAT_TA_102368.pep
NVLLPHKAFVQLVYWITIIDTTLRTVGIRCPSRWVGFRYDAGRLAFSPTVTVSLGIERILYVSYEASGS

SEQ ID NO: 207951 - protein, 156 aa, Triticum aestivum
  Clone ID: PAT_TA_102369.pep
VAQRVYIVRDLIGNVITTQVEARISSCWGRREPKLNFAGMGTTTMQAGNLVAYYTHLGQKVGSPVASLGGLEGSLVLVHCQEASFYRASGMEVGKLETNEELGAHFAPYSFAVGCYYTACRHANWGLCGPGVPGPQEAVSALLPSFALSYGSSSDS

SEQ ID NO: 207952 - protein, 85 aa, Triticum aestivum
  Clone ID: PAT_TA_102370.pep
SMIPDIHYTTSFRTVSLCSNIILHSSHHHLPYFFMFNLYFAISTQYYSSPLLILSLHSRLIFLSTLRLLLISHRYYCGIFYHRCL

SEQ ID NO: 207953 - protein, 110 aa, Triticum aestivum
  Clone ID: PAT_TA_102371.pep
LSHLRQDTTERTVISLYAELNSYSPSLYAVEAINPPRSFIHSCSDLNKMIPKRIAVALLATVSRHVNPPPSAIDGNHPYRSDYLGREARRSSPPPYDATASSHLDQDSPL

SEQ ID NO: 207954 - protein, 94 aa, Triticum aestivum
  Clone ID: PAT_TA_102372.pep
RQFGRAKFSNVWAVSCWIVCQSFVRTTSVLLTAHCIGLRVSFMRHLCWVVYFDSFRSHGFNSLLLSPVFCTIVICVSCLSVVAVLLMTLASLML

SEQ ID NO: 207955 - protein, 59 aa, Triticum aestivum
  Clone ID: PAT_TA_102373.pep
RAAPLVGCLDQADSSLLNAANLWSHAYLCGTNIQPEPITHFPIHPRNARLVRLRSHRPP

SEQ ID NO: 207956 - protein, 72 aa, Triticum aestivum
  Clone ID: PAT_TA_102374.pep
MTWLYVQHFALFFCYLIGRCKFALTPLTTRTAISTFEKTSRYYSGRVSKFGTINSKLVTSGGHSIRSFSVRG

SEQ ID NO: 207957 - protein, 116 aa, Triticum aestivum
  Clone ID: PAT_TA_102375.pep
VEPDPLLGDVPARIEPKAVCGKLTEKPSMVERYDLRRSRVTPCDILQVSGVEGSAVRSRNNHGSLYTAFRATCVNTPDASAGALWTDLSISDMSLGSEREKYISVAGMCYFSVMHC

SEQ ID NO: 207958 - protein, 113 aa, Triticum aestivum
  Clone ID: PAT_TA_102376.pep
YTLITITPSRGWPNTPTKRPLSEPSFTCPSLIYSQPPPPRFPPQVSSPTPNYLHPSASGPRPQPLLNPPPAGSPFYPPMAFRHLPNTQAPAPPSSHPAFGPSPLSIRPTYSPR

SEQ ID NO: 207959 - protein, 82 aa, Triticum aestivum
  Clone ID: PAT_TA_102377.pep
VVQEEPSGMWDTGNPSHGRIRVPHSIGRISFQCERVVICSIVHFSSDWVGLVAGRPGMCSGRLRRESEVAWLRRLWRNLSEG

SEQ ID NO: 207960 - protein, 112 aa, Triticum aestivum
  Clone ID: PAT_TA_102378.pep
LGLAGYRLAFMLFSIQSLVSPSVDRDPVLVSRVALALFFSSLFSLYCVLLILSSILRVLLQSFFHITGIIGRSYISRYYLKLHFLHGSFCWWRTYLNAHSCVVLTSLPFIFV

SEQ ID NO: 207961 - protein, 66 aa, Triticum aestivum
  Clone ID: PAT_TA_102379.pep
QGGMSLMRVPDLERTLSGQLIVSLGVSHQTQMYSIDRFGAQSTHESNHRGEKSPRSNNADGNDNPG

SEQ ID NO: 207962 - protein, 110 aa, Triticum aestivum
  Clone ID: PAT_TA_102380.pep
AWDWYGLTCRVSDRSFCYEKGTAMFVIPGRVVQVRSRVLLVLLLINPVFKWSGLVFASYSYITNSVSFRIGRSPVSQAGGTEAVAIEPGGFIVLGIADGIDQNCMPPCGG

SEQ ID NO: 207963 - protein, 39 aa, Triticum aestivum
  Clone ID: PAT_TA_102381.pep
TSYVQELRSNVKVTELKYNQQIYFLNTKTDSTSNSEIAS

SEQ ID NO: 207964 - protein, 59 aa, Triticum aestivum
  Clone ID: PAT_TA_102382.pep
TPVSILTRGPLNRTSPRLNVTHAKSVVNLPGTNSSRISNPRCHATVYVLNNARQTNTAP

SEQ ID NO: 207965 - protein, 171 aa, Triticum aestivum
  Clone ID: PAT_TA_102383.pep
ESVKTMRNDRRYPSTIKLSVKRSEMNTVKLWGDVENIKHRQTPRETRPTKHSQSRSDPESEYQEVSMYRRIQPTLQKTNRTTQLRDVDGHGTPILTEPCTIPRLTFLELRHRTSNRLHNESFPTEAPHSYENTGHGEAAQGHGYTREYKLHKAQVGDPKQESKEEWEQAKR

SEQ ID NO: 207966 - protein, 73 aa, Triticum aestivum
  Clone ID: PAT_TA_102384.pep
AQMPRSHVMVTNPLRICVGNVSSYRQWPGISASVIPTRETQEMQHPRPASFHSGALVSPCESALSACAVGMTL

SEQ ID NO: 207967 - protein, 80 aa, Triticum aestivum
  Clone ID: PAT_TA_102385.pep
SSSTIRNRSAGSTKSRTNDAEPISLRNSSPADSSARLSKQLLLGGPTDYATIKSIVRESLVDRSWRKARVCRRPLKVKNQ

SEQ ID NO: 207968 - protein, 149 aa, Triticum aestivum
  Clone ID: PAT_TA_102386.pep
HQGSSHLRQLSVNPGDSSPALVKKVVQGTRGANGYTRNPKSAYCIGPPARQTKMSFPRRLEGQKRFEQLVNEAGISKRTCYNNQDLFDSMGDTDELGTKAVNAIGKHITHQEDRSNDPNERTICAAHTTTQAKWWALKCTHPSALSSIL

SEQ ID NO: 207969 - protein, 98 aa, Triticum aestivum
  Clone ID: PAT_TA_102387.pep
AHVELLDRQTNYPNRPTLSDPTNVQRSIPQTPVIYFLEWRNKTVLSTGLDTIGRVESDCPAARPLQLGEQPKLIRMHTPRSQSKVQTEHVTISNYYAK

SEQ ID NO: 207970 - protein, 176 aa, Triticum aestivum
  Clone ID: PAT_TA_102388.pep
CSSENRIFAAVPNRVYTSTTLGYLNREVSWGDRTIKLADDGTQQGQKLRGQGVIQQTIVRGHLETSETAEPARMVPRDRPRQARLLGAGPFTHNKTSGCRICVLRRYWVRCAVLKERPVGRRGKRRADRSGRPVSWGGTVGEGAPTGRALPKGGRPRMEGPGSVGSTLDLGWVAKQ

SEQ ID NO: 207971 - protein, 133 aa, Triticum aestivum
  Clone ID: PAT_TA_102389.pep
KLKTYSQSGSSAPECEDQTPYTHAAADRVILPHDVILPPCKLDSAQLDRAGSENQAHPIVFYPYGTIPPLSHNVRGHPTVPPRPAPGISAPCYPTRPHPRLSAQSFASSAGSLRSDVRSRTYHSLGGPSPGSR

SEQ ID NO: 207972 - protein, 92 aa, Triticum aestivum
  Clone ID: PAT_TA_102390.pep
ACLGYRSFRYHIVRYRLSLYCTLSDAWDFTIIAHSVPLNLRSKVRLPEPVRPFTPPYYAVIVSQSLFTIHVVQEILRLIVPDRWSKKTPVIT

SEQ ID NO: 207973 - protein, 61 aa, Triticum aestivum
  Clone ID: PAT_TA_102391.pep
LIKIIKFPRHCILLPIIITQPIPRILDNLSYPLIFPQPFSKYLFLLIDQNIHFSSSICNVF

SEQ ID NO: 207974 - protein, 467 aa, Triticum aestivum
  unsure (1)..(467): unsure at all Xaa locations
  Clone ID: PAT_TA_102392.pep
MCLRHPTGHRTTIVRSSTASPCANSLPHLCALQAPPPPDIPXAAPLIAPCREPDYPPPPTNAPHIPPPGPXPGYPPALSGYRHLPGTRAGTAPXAPCMPPQSSARAASLPPPAGTDPDAPPEPPRLKGASYPSRTAPIRAPSPTTTRPALTRELTLCRPPIPLPPTAAEHTASPVQAPNPVLNLLAHPPGPHLPHPSAFNPLLTPRLPHHTGLSLPASHIPDAAIHQSAPIGPPGSCRRHSAPPPPNPPGVRPAQPRSVPPAYAPSATAAPPSVPTLARXTTAARIPARPPTLSPGFHPAPLPVTPPVPRPCDPPLYFSTTGAPHHPYDPPDLSRAFACTRARSPEPLERSASHTSPLRPPGLHVILPPPLWPYYAPPPAPCPPSLFTDRAPAASSSXPFVPHASPPRGACRQSPPLSRGHRLPAVPPTNPRPPPPRPRDPPPGPPARGAPSPAWFRAPSEYARPVL

SEQ ID NO: 207975 - protein, 107 aa, Triticum aestivum
  Clone ID: PAT_TA_102393.pep
RRKLGRDRVKNWDVYRFVGSKKVRFCTKHMDIVRVTGRVSHSLSESRRRRDSTLGLGRWKSPVQIRLESSPRHGGECGEINVQEGITSYVKVTLSLRIVLTRLSRIL

SEQ ID NO: 207976 - protein, 91 aa, Triticum aestivum
  Clone ID: PAT_TA_102394.pep
LRVLCAFRNIYSGYFHPCGNLSVTRARSSWSYGSIVLQDSCISLLAGCYLLKFYVAPGPIRQFLQFTPNSRSPYTHSLRSHSVISSGSSCM

SEQ ID NO: 207977 - protein, 81 aa, Triticum aestivum
  Clone ID: PAT_TA_102395.pep
IPQVPMPVVGIPQYRSPGFPVHSFVCQCASNSRTPTCTISAPGVYPVCSYPSAYAGPAICELGDTRCVYGPSQFIILRYPL

SEQ ID NO: 207978 - protein, 57 aa, Triticum aestivum
  Clone ID: PAT_TA_102396.pep
SMLVHNPHEDKPATQYAILSQHQWRRAADPKVIDYTLPRSITDQQHCIKMRHGCDRV

SEQ ID NO: 207979 - protein, 139 aa, Triticum aestivum
  Clone ID: PAT_TA_102397.pep
DFRFAINLRASQRQARHYRRSPPRLWANAASSGWEIREVSPGVGVPEDKSAPDTRTPHCSGRKKVPRPITRPIIWSLLDVRHHPLIRLTSRGGHNRVFSHHSVHHSTNGRSLRERAHYVAPAQYLVGGDPLRPRTVLEE

SEQ ID NO: 207980 - protein, 33 aa, Triticum aestivum
  Clone ID: PAT_TA_102398.pep
NFPVDQWIMGPTTRVLADYYFPDQLIHHASPSL

SEQ ID NO: 207981 - protein, 89 aa, Triticum aestivum
  Clone ID: PAT_TA_102399.pep
CPTILITSSIKLGRVLEFRTSTSAEFWHPTLQPPYPRFGGSSNAIYPTPNSEIRTGMSPYGCRPEGQRYPLSALHLCPQLDAKTYRPNK

SEQ ID NO: 207982 - protein, 69 aa, Triticum aestivum
  Clone ID: PAT_TA_102400.pep
RNLIAKTHVPLTIRYYSSTLLKIEPCEILRFQAQIQHLYNNRRPNSYPIVNIYYYYLQLFTDRILYQLL

SEQ ID NO: 207983 - protein, 266 aa, Triticum aestivum
  unsure (1)..(266): unsure at all Xaa locations
  Clone ID: PAT_TA_102401.pep
RGLRYPPHGQIPPRSHSACVPQSAPRSPTPGAQAMPPAIALYPTPPPPRAPIRRGPHAHRAPPPNPPTRSPIPFPPGHCVQVAPPPGPRDRPLPSHTQPXPQNSPQGPSPPSPSARFLTRAQPSGPSIVRGTPLGRPLSPTIPNLCAAPHQGAPPPVPTPADPCHQQDVGARTPLPRAPPFHECPRSTPHPPDQPAPPGHGTRDLSQLSPPPQTXPPFAGQPISPAILPLGTTPLPKKPTGPPLPPPPGGPRRRVHLLAPADSGQR

SEQ ID NO: 207984 - protein, 54 aa, Triticum aestivum
  Clone ID: PAT_TA_102402.pep
ARQVSEVRIEAIIVHRGRIRLEVKLCGRQCHVVSCGRCIRCCIRVLASGLCVAL

SEQ ID NO: 207985 - protein, 125 aa, Triticum aestivum
  Clone ID: PAT_TA_102403.pep
CCRRGCVHVISQQRGNSMSPTVAPPRQYVTSHLRYLECEGRCTLAMIISSSPYTKTIEVVRRCLRNSFICAVMVVLLFAVCNLTRYGLELLAFASYLFSFRRLRISFVCVVLLSWRSHLVSFKFN

SEQ ID NO: 207986 - protein, 107 aa, Triticum aestivum
  Clone ID: PAT_TA_102404.pep
CQLTLTGHYTPSHQLRLTAADERTQLPPLSGTLRVRLYDVGPDPHHTRPCRPIRASADLTVVPYDLQAYYGTGKSKSRQITCQVSYGTRAGATRVYCCLVRRLNTLC

SEQ ID NO: 207987 - protein, 95 aa, Triticum aestivum
  Clone ID: PAT_TA_102405.pep
NPRLLGPPDYKAPHMGRLRQSHVTLRNFTREDSTNTQRVHTYQAVGLPNVHPNKPDPQVNPHTRMSIREVEGINNGTLETPRGLPKSKTIGPCSV

SEQ ID NO: 207988 - protein, 47 aa, Triticum aestivum
  Clone ID: PAT_TA_102406.pep
LSRFVVVILIYGALQVARSRVSEGSAALRVGLSYVGSSGLKLEMTTQ

SEQ ID NO: 207989 - protein, 43 aa, Triticum aestivum
  Clone ID: PAT_TA_102407.pep
SHQKLNVKPKFKLILFLLLKFFITYYHYIKIFELSPRKSYYVP

SEQ ID NO: 207990 - protein, 128 aa, Triticum aestivum
  Clone ID: PAT_TA_102408.pep
PACSDSPIRPGIYYRGPICHCHGQPLHVTCVIALGTTPRLHCSRARANPVSRAPSRRPAPSTAPPQGPAQPRPRAYSMPHTSPNGVSSRPHCSLFRALRPPEPTIIHLALKVPSLLRPPSSHGALRPS

SEQ ID NO: 207991 - protein, 97 aa, Triticum aestivum
  Clone ID: PAT_TA_102409.pep
NHQLPKLTFSIPNTSNRSKPPNLSCYRHPMTNHTRAHPRSGGPRPTLGIYVHDSLHPRKLHSNPPSDFPTYPSSLRPGSPCVSLIHPTRSSDARNAN

SEQ ID NO: 207992 - protein, 73 aa, Triticum aestivum
  Clone ID: PAT_TA_102410.pep
LDSAIITLFSVGNLYDRSGIIQGLLDNLLELLLCLDVSIFKHLRWTDGSQSSACVKPPTTSHEHKLPGAYYRS

SEQ ID NO: 207993 - protein, 61 aa, Triticum aestivum
  Clone ID: PAT_TA_102411.pep
APLAPGPGPYTPTKGENSNTREAEFPPLSKPKDGQGPLKSPAHRPLPPYPIKGLKPGETKP

SEQ ID NO: 207994 - protein, 63 aa, Triticum aestivum
  Clone ID: PAT_TA_102412.pep
KRLVDSRRGSALAELTTPSSFHRKTPKLSSPYHQKLPTSPRSDGQYLPRGYPFCPQRTKPIPN

SEQ ID NO: 207995 - protein, 56 aa, Triticum aestivum
  Clone ID: PAT_TA_102413.pep
FITFPPCSRAIPVIKSQRGMVRVICFFFHLPATSLVESRVYSHQHVHGGSGYPIDL

SEQ ID NO: 207996 - protein, 138 aa, Triticum aestivum
  Clone ID: PAT_TA_102414.pep
ASDGRTHPVRPGPQPAGAARGALRCHRGEAELVRNGAARPKREALWLGETAFGLKAHGRWPQRPNNIRPHLLRVVPDPGGPEAQATWPGVPGPGRVMARARWVRSAGGGRGRAAGAEGEKRDAGRLSAIVWVQAMAEC

SEQ ID NO: 207997 - protein, 64 aa, Triticum aestivum
  Clone ID: PAT_TA_102415.pep
DPEFTSRKGLEEGNKKNLPYHNPPSQLTNVLLGGRLDWRKRRVEEPIISRLKSCVLIGSFCYIP

SEQ ID NO: 207998 - protein, 89 aa, Triticum aestivum
  Clone ID: PAT_TA_102416.pep
THCELNSAPVRHITAHGREMCEGWNGVRDAVAKSVDLAVRWNQLSLKAMTNVGEIPYRGNYGPRTAGKGSPQRLHKKYPPREDCKPQTA

SEQ ID NO: 207999 - protein, 35 aa, Triticum aestivum
  Clone ID: PAT_TA_102417.pep
SFPFSSFSFIDFSFIQSQRNILQSYIESLASCPKQ

SEQ ID NO: 208000 - protein, 107 aa, Triticum aestivum
  Clone ID: PAT_TA_102418.pep
IAFLKQTEKSKPGQKFGRPLGWGGSAALSCRGTDLLHYWQTRWFHFRLVFSWGLGAELPLWFSIMLGAQIHPLDSPFSVFFWERLTDYLGTMAMFGKPLFCYASCRF

SEQ ID NO: 208001 - protein, 103 aa, Triticum aestivum
  Clone ID: PAT_TA_102419.pep
EGPVRRSRPGNQRNRLVPECGPFRTACSRAALEGRDCPDIEPFRPGRRRLRAGPLRYAPFGGPGTIRPAMEPDLPLFAVPPWDGGFRARRYGSTERGRGRSCG

SEQ ID NO: 208002 - protein, 156 aa, Triticum aestivum
  Clone ID: PAT_TA_102420.pep
MRLYGADCPPRFFAPTLDVLYDRSTSRFSLRLVSAPVASGMPSADPLVSGIHTPFEGVSPLTDPLFFSQTFGPVQAVVLPRWPRNVNGRPTGHVPPRLAHTPVYAGFKPPIPLKDLFESLKPESEPVRARAEVRRCGPPGGRPGGRRRKGGARAGR

SEQ ID NO: 208003 - protein, 107 aa, Triticum aestivum
  Clone ID: PAT_TA_102421.pep
RTVGFGGRMQAWSGAQWYDLPSDAGIKLHVSRPSGSGPFLLRTPRRAFTQITRHPGPSAFLRKRGRFPAHGFHGSDKGVLTPRIFAWPRQCRSGPLLYFNQIEQFRS

SEQ ID NO: 208004 - protein, 162 aa, Triticum aestivum
  Clone ID: PAT_TA_102422.pep
ILSYADFYQLAGVVAVEVTGRDLRSPSNPGETGTMPESLPPGTAGLSWMATPRASWNNLRGQGWFISRPGLGVLELDPADEVAWPSFSGVGSAPPWRKGMPNQRGRMGSRGLVRSGCGLGDTGSKTPLFGISILEQKLPLSFDAGWAFLFYGWGGREKGEGD

SEQ ID NO: 208005 - protein, 137 aa, Triticum aestivum
  unsure (1)..(137): unsure at all Xaa locations
  Clone ID: PAT_TA_102423.pep
RPPXASSLSIGGKSVPRATLASTGHSDYQGSLVLDPHTPSSSRSLFLLIRTTAHRYSSLVLRPSLLPPSLSLRLLAALHLSVPSCLASPASRCLPPFRSDLGPRYLAFLTVLPHPYLAVVASLHSLAALASAPTLSW

SEQ ID NO: 208006 - protein, 106 aa, Triticum aestivum
  Clone ID: PAT_TA_102424.pep
PHRVFRTLGSTHPLGLVPGPAPRAQASGPPGFLAVRTPGGHGKPPRNPDLRSVDTVRSGRGGSTVRPQPPTVPEVHGAIARHHPRSLRPEIAGARRQPSSSATEEL

SEQ ID NO: 208007 - protein, 94 aa, Triticum aestivum
  Clone ID: PAT_TA_102425.pep
HSYRIAEEANDDSSDAVLPGCLGSWLSRRAAVMPTSCNPADANRNDLDDVAGIRNDGLNIKIGPSSKHSPHPCRFQTFMDKTNPRSSGHRDPKT

SEQ ID NO: 208008 - protein, 82 aa, Triticum aestivum
  Clone ID: PAT_TA_102426.pep
TAGVRLRVFALLLSFFPFVPSGPESHLQLAPNGYQPQLLTRVASTPTPIPDPPRPLVLLQIQPLGSPMGGSGWFWYLCLFPR

SEQ ID NO: 208009 - protein, 91 aa, Triticum aestivum
  Clone ID: PAT_TA_102427.pep
GQRHDVRHVHTARWKGRLESPNNRTCFAPFSLQDLKYIASSGPGRHLPRITNVDAAPPNRLAWLGACMTSVVARGRRARPKGRRKEEGRRC

SEQ ID NO: 208010 - protein, 96 aa, Triticum aestivum
  Clone ID: PAT_TA_102428.pep
RCCRLVLLLLLDTAWSSSSFELIRPPAASGALTNVALTGLQAAPGISDPLSFRVVRNGSNLCPPSQQPGSTVAETDLHSRPSRRPAVLRSAQVITA

SEQ ID NO: 208011 - protein, 104 aa, Triticum aestivum
  Clone ID: PAT_TA_102429.pep
STGISIHKELTMKSHQRNEVNPMAACSDFHFHSSQQQFPDNRETASACAAAIQEVIEYKDMAAPTCPPRVTPGALRDFLWLGFGERQVCVTGCCGVVSALMAMV

SEQ ID NO: 208012 - protein, 112 aa, Triticum aestivum
  Clone ID: PAT_TA_102430.pep
FPNSASSPICTRDLSPFPLSCGHMVERAHVSCHCSHRLCHSECLGCTSRLDAPLTDVWVQYRSVPLRLLYPGRCCCLILRSELHTDTVGRHDSFLLFLSVRCIACCIRSFLY

SEQ ID NO: 208013 - protein, 73 aa, Triticum aestivum
  Clone ID: PAT_TA_102431.pep
RTAGGLLEYRKSGPRRPSGPANPLARDGGPALGSLTTRVTWSRAPNAVQLPHYCRPPIRPSLVLYSMRFPDTQ

SEQ ID NO: 208014 - protein, 32 aa, Triticum aestivum
  Clone ID: PAT_TA_102432.pep
TLDPPEMKSTTRTVHITPQLGVRKHKVKFFEL

SEQ ID NO: 208015 - protein, 42 aa, Triticum aestivum
  Clone ID: PAT_TA_102433.pep
PLTPDFVFCVCHYDFLSRHGAPRCCLECGCSLSCGCPRLPTF

SEQ ID NO: 208016 - protein, 28 aa, Triticum aestivum
  Clone ID: PAT_TA_102434.pep
ISSHSKGDQLSVSSSKDRSTSNFLCLAS

SEQ ID NO: 208017 - protein, 61 aa, Triticum aestivum
  Clone ID: PAT_TA_102435.pep
QGGPCTDTGAQQIAVLRGRDRDGPWASVSRSRWRSPADRRIRVVPGQVAIGQRARGLGHHG

SEQ ID NO: 208018 - protein, 53 aa, Triticum aestivum
  Clone ID: PAT_TA_102436.pep
GAGLRVYDWLGKGKQRCRGRGFGLNRSEVRAFDSWVRGHPLLSSLARRGRCKQ

SEQ ID NO: 208019 - protein, 77 aa, Triticum aestivum
  Clone ID: PAT_TA_102437.pep
ILQCSSTSQLITALHTGSLQRHGRCWHSSPVQIDIPSREKSVTGGKAGYLERLRNPNHNSTKGKARLKCPEFNLMWV

SEQ ID NO: 208020 - protein, 94 aa, Triticum aestivum
  Clone ID: PAT_TA_102438.pep
CTGGRLETYAGLPPRLGHGNRAPDTSIPGRLSWMRKARAWEREPGPKLIAKPRPSVPLQAAGTGVQFAMPGLVNRPRVFLRNWEQRGPVEPQTA

SEQ ID NO: 208021 - protein, 107 aa, Triticum aestivum
  Clone ID: PAT_TA_102439.pep
ALLTIIAGPFKDARSSLAGRRLQADYTQVLNNYTATRTDVNGREITGHSTAADFCQCQAWRQTWLRKGRFGCGALCRVLTARMGERGDGAARRLSWVNASVFPTSRR

SEQ ID NO: 208022 - protein, 108 aa, Triticum aestivum
  Clone ID: PAT_TA_102440.pep
FPPELRRRHELSRLGLYQRTSFFWRLRIASKPNPRGQTSSRPSKAVQNYFGPFGFCLGGLSAVGPGRFAHFMFPFPLCPILINVNQLGLNASYLNQLPLYCPAMGYFA

SEQ ID NO: 208023 - protein, 75 aa, Triticum aestivum
  Clone ID: PAT_TA_102441.pep
PLQIIAIVAVNPPNNLRSQFNTFLPKSFLPELTLVPFFRPPGSSRSAPWPSDIGTALKTAAILSTELEAIARAEG

SEQ ID NO: 208024 - protein, 235 aa, Triticum aestivum
  unsure (1)..(235): unsure at all Xaa locations
  Clone ID: PAT_TA_102442.pep
WRLRPATILPTPQPAHLPRAPTGRPTRPPKGGTIRPKNPRGHTLALPNKAPPLKTPXSASIPARPLWVDQPSPEQARPTGPQSGTLCSAPSTTSENYPTIARISLPPFSPPELRAPGPREGPSARHKPDGRSPKGSPPRNAFRTLTFPDHFFPPARRDFRPXPPVPPSPRAPPRRGGHPRPPTQPPVTPRPHPRGVSPPSAPFRGAAPFSRFRIRGPPNFPPRPPKRRGTHPPRP

SEQ ID NO: 208025 - protein, 132 aa, Triticum aestivum
  Clone ID: PAT_TA_102443.pep
TTAQGWHPAWTLYPQSAKFKGARTCFAPICKHVTYFRVWGTHPFCFFKSPKSHCIWALDNGLWFFGGGQLNLVKSKKITTQPRLLLGLFRDWTPIESFGIAQLELVFFPTTVTRRLPGRMGGSHLQGPLSIL

SEQ ID NO: 208026 - protein, 114 aa, Triticum aestivum
  Clone ID: PAT_TA_102444.pep
RPWGGLMELAPKLHHLNCRLRLHLTPAFSSPGENPGRVAPTCPIKWHIGGLTAAGGRRAGFSSIEFGAAFLPVFCLRLPNGTSARPASGGRVSGPWGAEAGGYPRLPTCNCALG

SEQ ID NO: 208027 - protein, 42 aa, Triticum aestivum
  Clone ID: PAT_TA_102445.pep
RGSVVCRGVCIVLALCDVAGTVGQEARAGKFSSRIWGRLWQA

SEQ ID NO: 208028 - protein, 62 aa, Triticum aestivum
  Clone ID: PAT_TA_102446.pep
FFLVTLKQSMDAIVAYSGANRKCQSRVVTTEICLLSFVGTVFLRFKDSELTDSQSTPMRASE

SEQ ID NO: 208029 - protein, 119 aa, Triticum aestivum
  Clone ID: PAT_TA_102447.pep
IKNIQMATVATPCRQFCFNSILFCNRRNAYNSWFRNTTPTIPANWVSLDPDPPHDSQAKVLAKVNSGFANSGTAAGPVTTAQPKAPVQYHHSLRTAPLQLIQLNPPMTTSRTSKRATAT

SEQ ID NO: 208030 - protein, 61 aa, Triticum aestivum
  Clone ID: PAT_TA_102448.pep
HTPTTNFVCASFGVSVREPTHATTQALYYQILRWEVNIQNDKFCQRAVATKTCGGLTGADH

SEQ ID NO: 208031 - protein, 93 aa, Triticum aestivum
  Clone ID: PAT_TA_102449.pep
PWPGPISEVDSIPEAGFVGSEPGPGSIWDCPFFPSLQGLWYSDQGQVICLLSLFIHITFRGSTPRAVKCKNLGYPESSYSRCPQVCKISRSTG

SEQ ID NO: 208032 - protein, 65 aa, Triticum aestivum
  Clone ID: PAT_TA_102450.pep
PFPPGFNLFSPPGIYLFRPPARSARVGPFSQRGPVFLSGTQEAELLATFETIQGAYSRGGKIRLR

SEQ ID NO: 208033 - protein, 112 aa, Triticum aestivum
  Clone ID: PAT_TA_102451.pep
KGTRRPNAKHLLGTVRKHFKTNPFRSGTTDTKGLIASPERRPIEDPSPQKNVKTNHRWSESNRAQNSQRLIPKPQGEELERSCPHLATRGQEIGTRQTPGYNRVAEREGTTI

SEQ ID NO: 208034 - protein, 79 aa, Triticum aestivum
  Clone ID: PAT_TA_102452.pep
ITLKAMCELNNKSTALAPSRQYEIYNNIAWNKLGMDLLLQRIGVAKVYPIAGCYGSKTSYVHGSNLYFATADYSSVREM

SEQ ID NO: 208035 - protein, 108 aa, Triticum aestivum
  Clone ID: PAT_TA_102453.pep
KIPEGFSSRCRCFLNAGFNSLGSVSISKTINNPADAPPTGPRFPRDLPAPFQLFPPKPINIQYSNTGFNPLGTPHLGPIATLRVQRFAYVKLIPYIVMGPKHKSFCGS

SEQ ID NO: 208036 - protein, 85 aa, Triticum aestivum
  Clone ID: PAT_TA_102454.pep
LPSVRFILDANLRLSHSTCLHWLSSLSCISRANSKENVTMKLRRKARVSGSRALVVHFAAIPDAHGRASTESLGLVRGAVTCYSD

SEQ ID NO: 208037 - protein, 62 aa, Triticum aestivum
  Clone ID: PAT_TA_102455.pep
TCNFRIEFHFGFNEIFIPFTGRSTSPNPNELLTYPRSLWKFKRLRFQDFIPVLGLRDLCIWF

SEQ ID NO: 208038 - protein, 61 aa, Triticum aestivum
  Clone ID: PAT_TA_102456.pep
FFSSSFFFFFLKQTNISFIFPGKTMTERYTNQATTLINTTSIGTLSDQLQNTEVHRPFYTL

SEQ ID NO: 208039 - protein, 61 aa, Triticum aestivum
  Clone ID: PAT_TA_102457.pep
LLGLFGLLSGLRAFLTGANSLPYLCFLDDRHDAQIMNVYSRFFYIQYFILLTRRNNVYVLL

SEQ ID NO: 208040 - protein, 208 aa, Triticum aestivum
  Clone ID: PAT_TA_102458.pep
PTRRTPRVRGGPAQTAFGGRAARCSCVSTTDPSPERATQCQRPRPHPPRNPPGPTTAPPHPHRQPPSRTPPRTVRQFTPRPRGGTGARIATQKFRRPPTVPQPKPNPSGSPLTRRPSRLRGRRPTLRAGPASPPSAAPTGIPAVPSGRSPSRQPYRHPGTSLSPRANRSQVVEADRSESGINSARTYCPGDLNLVTTSRCCFLLSREN

SEQ ID NO: 208041 - protein, 85 aa, Triticum aestivum
  Clone ID: PAT_TA_102459.pep
RQRRRVHQVTFSSHPQPRIPNAAEPAPAPNLWLATIPTGAHSGFGRRGRHLLSPRPASNHGSQRRKVACKASKAVFLAKCRHFNQ

SEQ ID NO: 208042 - protein, 96 aa, Triticum aestivum
  Clone ID: PAT_TA_102460.pep
IANEAQHLNRPLPNTLRKPELGRLAALTAGNFSSLTAILMQEVSTTRTNRVHFLKYQSPCLLNCLAKRLKAKPPDHPRANHPRPRTGGPFNRGLWS

SEQ ID NO: 208043 - protein, 27 aa, Triticum aestivum
  Clone ID: PAT_TA_102461.pep
PNIKEIVNNLALSVNNNNRVQIVKGKF

SEQ ID NO: 208044 - protein, 93 aa, Triticum aestivum
  Clone ID: PAT_TA_102462.pep
GYIAPPNGKTQVLDSGGMGSPVAQHMRTFFPGLPLQPFESFSFRGLPKGFRPIFVPNRLPHPPGLRSFMDRSYGGLDPCPPYRASFIVMGLCI

SEQ ID NO: 208045 - protein, 129 aa, Triticum aestivum
  Clone ID: PAT_TA_102463.pep
STIGILTRPLDVNFDQRRASPRTSDTFNPAGGPKDRRVPSRGLEKSCIYLYSVLALFGVEPQGCWGVLVAPQDAVPRWLTRASTAASHSLGSKVLARLTSDPYRTRFAYVTALRRTGTLTWIQEDLCHY

SEQ ID NO: 208046 - protein, 89 aa, Triticum aestivum
  Clone ID: PAT_TA_102464.pep
SYRSSIKGKPQCNCDLSELIVFIHQNHQPKKRVTLSYASLHLHEYICMTAGKSRTGKLQCSNPNQMKPQAGLFVGVQQRPINFSFPSAT

SEQ ID NO: 208047 - protein, 43 aa, Triticum aestivum
  Clone ID: PAT_TA_102465.pep
GKIKIGINGFGRIGRLVARVALQSDDVELVAVKRPHSSPTGVQ

SEQ ID NO: 208048 - protein, 43 aa, Triticum aestivum
  Clone ID: PAT_TA_102466.pep
IKNFALTLRFTKFIIKISNNLTMTYIFIVANILFFIFLIYHFS

SEQ ID NO: 208049 - protein, 74 aa, Triticum aestivum
  Clone ID: PAT_TA_102467.pep
APMLLQFLLFKAERDRLWFLLPAYLFVMRQQTNYTGYAETIRQTTLGFLAQYLAVKHFLILRPSVNFIHPGFKA

SEQ ID NO: 208050 - protein, 64 aa, Triticum aestivum
  Clone ID: PAT_TA_102468.pep
WCAGWFVAGRSRRAASIVSRRPVVMPAGPTRRSMRSPHHHRLAAIDRRARGSSQSRLRLLFEPV

SEQ ID NO: 208051 - protein, 73 aa, Triticum aestivum
  Clone ID: PAT_TA_102469.pep
SMSHNAKACVLCVPPVGSESKTSKRHRSMAAPSHLMRVANVRPWHTIEGGWALEEGHPFPTYPFSVGITFRVY

SEQ ID NO: 208052 - protein, 83 aa, Triticum aestivum
  Clone ID: PAT_TA_102470.pep
RRYDCDLRNCYDSFPRCASSRPFILYRSMFILANDKIATLYGHDCLVDLSGIRGRSFTLLNWQDSRQLRSGIYHPQDNMETAS

SEQ ID NO: 208053 - protein, 55 aa, Triticum aestivum
  Clone ID: PAT_TA_102471.pep
YIPCRLQQLAHIHPRGFCQRYRVTILATILDPGNSSPLQSHPPYHSSRRGHFRPR

SEQ ID NO: 208054 - protein, 85 aa, Triticum aestivum
  Clone ID: PAT_TA_102472.pep
CSERCSRSVPRKDWGIRGIGGAGSQAFRLCGPQDSLNTNGLPPHLRATRRAPRRAFLHERRSPNDARPGAEHARETVTALLCDRA

SEQ ID NO: 208055 - protein, 68 aa, Triticum aestivum
  Clone ID: PAT_TA_102473.pep
IIGTCICTVCHSVQSCALVACGLFMSRCMYDRITGHLPFCRGILIPLFFDSYSVQSRKKKKKEIKKTK

SEQ ID NO: 208056 - protein, 123 aa, Triticum aestivum
  Clone ID: PAT_TA_102474.pep
KAPGAPGHFAKFRGHGSRSTFRHVGKTLHALLAKYWQLQPTGNGGGKVPPGHLGPVNQRFESISGFSVNRGASEMGTDLSRSPQAGPTQGSPRTFALRQWTYIGTCRSARSRIGASRMIGMLS

SEQ ID NO: 208057 - protein, 122 aa, Triticum aestivum
  Clone ID: PAT_TA_102475.pep
GVVSQYGLPNRPLPTRQRASPGRDEAVGASVPLTRTSKILEKSTRRPRRALDPMPGLENGWFQTVRYRPIPTPDRKVRERSFLARLARSAGRAHSVDKEGFSRNSCFAHLPLLLGFPRNPGS

SEQ ID NO: 208058 - protein, 133 aa, Triticum aestivum
  Clone ID: PAT_TA_102476.pep
LLHPLHVSQVQTEVLGHRPDCDTEASFRSLKAFTTNKTHFSKILTSPSTSQASYIYGLAPTISPRTPKHRQNSATRPPAYIPLPYLDRGQPPTPPNVCAGDSTAFRHLDPRHPKARFNDWSGSPPPFRTAREG

SEQ ID NO: 208059 - protein, 59 aa, Triticum aestivum
  Clone ID: PAT_TA_102477.pep
FFSLLLRGKIARRFQFDFTEINIIYNCSIRKEESTCIVALIAMDPRTPLKPYPNKSKKP

SEQ ID NO: 208060 - protein, 100 aa, Triticum aestivum
  Clone ID: PAT_TA_102478.pep
LAVKGHELRLPSPEEPLGPTSDPPSLAVQTPVVKGKGPRSIISTNRKGPGHCEGRMASVHGSYSPIDRHVRVFLPYPKWQRFTFPVPPTSNHPYKDRRPY

SEQ ID NO: 208061 - protein, 305 aa, Triticum aestivum
  unsure (1)..(305): unsure at all Xaa locations
  Clone ID: PAT_TA_102479.pep
GGPSTPLRRHRLAYQPSSPSRGPPKTVPSSPLSPFPRPSSPPSPYPPQNPXVLRSKPHRRPRPHGTHHHRPRIPPPTTRVPAKPRTALPPLPHHCPHSNTHPPGPAPPFDPPDLAPTRPPLILLTPPARASNRTALALAYTSRPANRGXPTKPPPQLTPLPRSSGTWPPDPLSTQPRAPPXNAPRPPPHSRAETSNSPRRPRHHPPCSPVRPRRTLRATAIVTAAPLXPPPSPPHIPPVSIPPPPESSARGPILPRPLPSRTRLIPLPPPGLRLSRPTGASPLAPTLPGCPSSRKPSATGQLCIL

SEQ ID NO: 208062 - protein, 87 aa, Triticum aestivum
  Clone ID: PAT_TA_102480.pep
MLAQARYIEDSDEERVCSWTDATVFASGALKPYWLALATARSFAMSYRTKYVALYFNESTDVTYELQLESRCSHTALIRKHKNCLSE

SEQ ID NO: 208063 - protein, 99 aa, Triticum aestivum
  Clone ID: PAT_TA_102481.pep
NLPGTRERITLVVQWFIALRRQLLNSPIRTTWGLPIKGFLNVLVFPNLQDGLIIEYHQYYSFRLSISMTLRCIAFMLITRTLAGIGRLLGEKFLKFSWS

SEQ ID NO: 208064 - protein, 95 aa, Triticum aestivum
  Clone ID: PAT_TA_102482.pep
SVGRRVHYNYSSWSHKSTITAPVRNARTSVAWASKVASTAAADLPHDSGWISQATKCPIKSSPTAPDTHAAVIPAHERQIVDPKRRLCWPVSGPT

SEQ ID NO: 208065 - protein, 113 aa, Triticum aestivum
  Clone ID: PAT_TA_102483.pep
TSPFNYACCCFDLPRLVTAQVDKPMFRLLTLAILNRKSPRSNCCRCGGMRRGFGRSLLGGCIPFRGLCSYRHFMLPSVPALGRHSGGFQVNLRPSSNSVEGPLITLDSCCRLF

SEQ ID NO: 208066 - protein, 161 aa, Triticum aestivum
  Clone ID: PAT_TA_102484.pep
PSHTRQYRADHRPAARVGTRPRSLARFNFGATDLRPSPVLSTCQAIPQPRHPLRPRSYPAGAPVFFPPPFAPLPEAPAGHPPNAPDPRFVHSMETRRTTAASRQPPNRPEAQSTLVPRAAVPPKQPRPTVPTHPHPLPISPPQPATKRFPPQATRPPNPPP

SEQ ID NO: 208067 - protein, 82 aa, Triticum aestivum
  Clone ID: PAT_TA_102485.pep
VIYAVEVRELDIYVMYVSSVTYLVIQCIDVTYLVTARTYIHDFTELGQACTLLRYVSRELIESGSYVVYVRTRLVPSLISVF

SEQ ID NO: 208068 - protein, 75 aa, Triticum aestivum
  Clone ID: PAT_TA_102486.pep
LEGITSFNSVQEGQSSTSRNGHGVFELPAIWRRKPAKWFGSDPNLSCIDLSSNAENFRASDYVEYASVDDKHAAD

SEQ ID NO: 208069 - protein, 72 aa, Triticum aestivum
  Clone ID: PAT_TA_102487.pep
NPGRPYFIQCVCVRFLAVSPVGWLPLFLFCISYRSSVASPIMGTFLVRYKEFGPSLGNYFLKDFQSYRIVGI

SEQ ID NO: 208070 - protein, 50 aa, Triticum aestivum
  Clone ID: PAT_TA_102488.pep
KNTKIKKKQCNIKYNSNIKCKLWRNFHLTNSKRNLKSNFSGTYIALLFII

SEQ ID NO: 208071 - protein, 78 aa, Triticum aestivum
  Clone ID: PAT_TA_102489.pep
MALRRDHGWKVTVCRGGGGSGGYMVMVLRLRVIYMGSGAEEVIRIDRNSDCQPDWLKWREIETSTGELGKIRVKREVH

SEQ ID NO: 208072 - protein, 43 aa, Triticum aestivum
  Clone ID: PAT_TA_102490.pep
IVRHQHHIMASPQALAALNAVQARSGCVEVADAANQVSDQRNS

SEQ ID NO: 208073 - protein, 80 aa, Triticum aestivum
  Clone ID: PAT_TA_102491.pep
IAPGAALEPLLHGNRHGATQRIAAISTAPILPACGTCRRGPHRPANLNMLDTTDSLSGAHLRHNLLVLMRDLDRHTLAFC

SEQ ID NO: 208074 - protein, 97 aa, Triticum aestivum
  Clone ID: PAT_TA_102492.pep
VRYVARLAAGPTSHCLWSVSTLGYHRPKAHAAAVQGAAPSGPPESVSSECSQPVWQSAPTSQSRIVLANYWVQPNVLPMLPVNFPTISMSTINRALL

SEQ ID NO: 208075 - protein, 112 aa, Triticum aestivum
  Clone ID: PAT_TA_102493.pep
QTVSVSDRVGIITSTYHSLINKHNSSFTKRAEGYKGKRAPGRGNCGGGGPMWSGGGGKEQTRIRFLAAVTPSATHRSGLLGVDHANLHDDVISTNTADTTKEATNVTRTMPR

SEQ ID NO: 208076 - protein, 34 aa, Triticum aestivum
  Clone ID: PAT_TA_102494.pep
QARQSYNSINNVCVCHKIPEGASNNYLTSSKPRS

SEQ ID NO: 208077 - protein, 120 aa, Triticum aestivum
  Clone ID: PAT_TA_102495.pep
DAGSVTGMTCLSGLGACVLQVKELGRPGSGWAVSQWAASHDCCRGAAWRPDCVASGGLGLHPLPCALAYRGTTPIIYGPLIEFTSLGNLHRGWARVTSGQISRIWPTSLLLGFSLENGAV

SEQ ID NO: 208078 - protein, 93 aa, Triticum aestivum
  Clone ID: PAT_TA_102496.pep
YTHRCEECSVCSLRTSQIRPHSILDDNMLGQRRHQCIMEKRQHEKRLHRMIHLNPVQANAKSNRYAGITESNKQNSTMLQYTGSTMRDISTSR

SEQ ID NO: 208079 - protein, 139 aa, Triticum aestivum
  Clone ID: PAT_TA_102497.pep
FTLTYYTIAPSSPLITVNVLIPEISNSFQPDPLYLEHSASWFERSLKLLQVTRCKIDHAFKSRPNYHTNTAILSIEVTSLVRPHRPPFIRYRFERRIASLYRARWSSSRSQEYIIIKHVPALNASMNFIQSSAEYLYWI

SEQ ID NO: 208080 - protein, 68 aa, Triticum aestivum
  Clone ID: PAT_TA_102498.pep
TSPWTLGYRGFCSTMCKKRWKSSKLEDNYYCLKLEGCLLVFFSNIYYKVIHQYSNKYVPCLSLYIYLT

SEQ ID NO: 208081 - protein, 89 aa, Triticum aestivum
  Clone ID: PAT_TA_102499.pep
WPAQPLGEGHTVTLPCSSSSQGEFRRHVWWVSATRSSSLAESCTRSFWAQWRRVDGDADTTGNRSGYLASSVGVGPKLYALNEVGFSYS

SEQ ID NO: 208082 - protein, 99 aa, Triticum aestivum
  Clone ID: PAT_TA_102500.pep
NTPWGLAVRQGYDGATWKMLKRLNSQYPGSSIRRVNDSDWKNVYGIHIMLCHIGCYTKQGRCLCIHKTDEVLNIIMAVKVDVETWGTTEDLFLVITLGE

SEQ ID NO: 208083 - protein, 73 aa, Triticum aestivum
  Clone ID: PAT_TA_102501.pep
GLLPTRPRAAVTARLSKARNGPKRPPPRRAQIATTRRGHRPPGFTAPILSWETGVLRFMASADLRQRWHSGVI

SEQ ID NO: 208084 - protein, 85 aa, Triticum aestivum
  unsure (1)..(85): unsure at all Xaa locations
  Clone ID: PAT_TA_102502.pep
ACPSAPRASHNDALPAFPGVPCPLPCSDARPAPWPXPLIPAMVPPSPTPPKRPPARTLPRPAXTQPPPTRPTPRTSLRPGITPYT

SEQ ID NO: 208085 - protein, 149 aa, Triticum aestivum
  Clone ID: PAT_TA_102503.pep
RRPLKSRADFCTTLGFRHRHGTGEQWPGCGLMCITGSRDVTASESENNTCYSWFLFVARCLSVWSAPTGQRFDPRFVSCPSRVTMSVPMVRPGAMITGGNLTGVTYRKGGGIRKLLSWVCLFGGMVLSTRTRFPRCEVGTVPGAVDRVC

SEQ ID NO: 208086 - protein, 44 aa, Triticum aestivum
  Clone ID: PAT_TA_102504.pep
LKPINFSDVHIDHKTGNARSKTRLHASIRDPLKIGQKTVHHQHS

SEQ ID NO: 208087 - protein, 46 aa, Triticum aestivum
  Clone ID: PAT_TA_102505.pep
LRFEYPPSPITMETLDSNEKAIQIYTFTSFQRLGDLFASSLLSTVS

SEQ ID NO: 208088 - protein, 97 aa, Triticum aestivum
  Clone ID: PAT_TA_102506.pep
WQSALMSPATRGERRVLLMGRWCAILDQFRRSPRADWGGGRGYQAERKAVVSVATDSSVHPIVKIKLSHCGRELYSNPETGGGEGLFTLSTTGAQPH

SEQ ID NO: 208089 - protein, 88 aa, Triticum aestivum
  Clone ID: PAT_TA_102507.pep
QCQDRTRKRPRSIKVMGFVLKAEDARGMQAPRASVQGASDQCRGLVDRVDRRTALVSVLTGNAEGMIWSLETLHPINTGVEITRSRMR

SEQ ID NO: 208090 - protein, 62 aa, Triticum aestivum
  Clone ID: PAT_TA_102508.pep
MNELTHINFVALTARFPVGKPVVPTALMNRTTRGERPFAYWALLRILRSLSLCTTTFGYGVP

SEQ ID NO: 208091 - protein, 92 aa, Triticum aestivum
  Clone ID: PAT_TA_102509.pep
KPLQPKPTLTGGENSLRFMVSARRSPCFQLWDASCFPPLLEHGFYKKKQSSSHNTVFELIIRMELSDVKMNYLRRLVLYAVFLFIVLHPKKK

SEQ ID NO: 208092 - protein, 110 aa, Triticum aestivum
  Clone ID: PAT_TA_102510.pep
LFLCEIVIAHNFTQQYEPEALMCNLRAALLSSQPTVTCVRPHHAFQVGNPVIQRQLMSGHRAGTRRVCGIGRVFRFVASIHRCARVVRPRRAEIGSSKRRVIRVVTEIRG

SEQ ID NO: 208093 - protein, 131 aa, Triticum aestivum
  Clone ID: PAT_TA_102511.pep
FFDPARRHGKHYQSFKGLTRKPTTGPCSHRSSRKPVYGKPEGPGLWPPIDTRKPGYSPFWAVPEGPPPEKTGRKNFPWEPLDSSKTYLFPPGPFGKEFLQTKNCPHPVLWGLYLVPFPFRFLLIGGGAPFR

SEQ ID NO: 208094 - protein, 121 aa, Triticum aestivum
  Clone ID: PAT_TA_102512.pep
GSGKSPRGRGKETFIFLGNPTFGPGPKGGAGPQSRPKGPKIPGGGKAKVLAPAQGGRMGAIGSAGGPRREESNGHPQPNPARTGQLPRATRPSRAGHPKRKGPKGKSEGPGTLKAFSPFSG

SEQ ID NO: 208095 - protein, 125 aa, Triticum aestivum
  Clone ID: PAT_TA_102513.pep
WGGGVFPAPRGFPKGPLKGKGQKAGGKGPHFILRPPKFPGGPQRPAPPKGTQMAKRPRGRTGTNFCPREGGRGRWILGIKVGHRGTSKVEPLGNPSSGVAPFALLHGQASRPPKTEGPRGRLKGS

SEQ ID NO: 208096 - protein, 78 aa, Triticum aestivum
  Clone ID: PAT_TA_102514.pep
FSEVKGVDEARAELEEIAHYLRDPKRFTLSGGRTCIMMCCLRDLKAHGITVISEGYSLEQPLILSLNEAEESESGGDS

SEQ ID NO: 208097 - protein, 165 aa, Triticum aestivum
  Clone ID: PAT_TA_102515.pep
MTQKLKKLARNGPTRARHPPQIAWSRHLYMAVVHLAPTYLAIAHRKHALMTVPVLHLRSPETRRLFTPTLKIHIPPHTPWILPQLCDPVAQRGVPRQTPLIFIICNPNVHNPRTLPPTNALHNLSILPTIRGRREHLKRPTLQHVNLELLHRFAHRPQLCMCKRG

SEQ ID NO: 208098 - protein, 100 aa, Triticum aestivum
  Clone ID: PAT_TA_102516.pep
THPGIRHHVIAVSCVKLIIRSQFHTTYEPEAKSRKAWECLMSELTHINCVALTARFPVGETCRASCINESANARGIGGFASWALFRFLRALHFAALGTVG

SEQ ID NO: 208099 - protein, 57 aa, Triticum aestivum
  Clone ID: PAT_TA_102517.pep
QLGCLRDKSRAFSAARAWSSDRTRTLVLGRSWLRFRLGVTYYTFPFGSNDPSSTKPL

SEQ ID NO: 208100 - protein, 115 aa, Triticum aestivum
  Clone ID: PAT_TA_102518.pep
HWNPPDFCECRYSAFGVRSFRMPTRSPEVTDVVVEDPREAPKTQTRPIPAALLESVTQLGTTWFPDVKAGSRAQRNLLCVASRQFGTPGFTLVCSVLVLLCEFVSGEQVSHRKQL

SEQ ID NO: 208101 - protein, 91 aa, Triticum aestivum
  Clone ID: PAT_TA_102519.pep
LTPRPITRRSNLINIWLKSIFGPSLHSLKGGFKEEFARISLTCRSDVTFTKSMNTRFIYSYLSPLSNLLISMPCISLYHTNLYTIARKLNQ

SEQ ID NO: 208102 - protein, 98 aa, Triticum aestivum
  Clone ID: PAT_TA_102520.pep
GDYTGPTLTAGPLFMSGFDLAPSFCLGPFYGLRPLFSLLPWPFLPLPWNLLVGIKTDTVTRGCWKALAGFPTSSHAVPATRRVSVYGSANGIEAKSGK

SEQ ID NO: 208103 - protein, 103 aa, Triticum aestivum
  unsure (1)..(103): unsure at all Xaa locations
  Clone ID: PAT_TA_102521.pep
CFLCDIVIRSQFHTTYEPEAXSVXLGCLMSELTHINCVXAHCPLSSRETCRASCINRIGQRAGERRFAYWALFRLPRLTDSAAARSIRAAAEAGNPASLHRGG

SEQ ID NO: 208104 - protein, 51 aa, Triticum aestivum
  Clone ID: PAT_TA_102522.pep
SSNTSYILLVSNSDAHIPVRKLVSQSDERTSHEPRHEPSRKPAMSRALAEH

SEQ ID NO: 208105 - protein, 249 aa, Triticum aestivum
  unsure (1)..(249): unsure at all Xaa locations
  Clone ID: PAT_TA_102523.pep
DSSHQAPTQGPAAPCPPISFPPSPRTTLALRGSRLGPPLAPPSNPRPQPTTLPFNLTPPSKFLSSXLNSPALAHGGPASGRRTTPVPPQATHPIPSHPQRLTFPRPTRLFPKTTLYADRYQPFPPSCNPPFPLHESGFRPILSHGPTALSRAARAFRLAAQLPVLATSPRPSPPSPSSLIYFSGQRTLSTLTLPTFAPANQVLAGLCHRAPRRPPGPHHGPFPLTPRXPTSPPHSPPHPALSVTPPPPP

SEQ ID NO: 208106 - protein, 95 aa, Triticum aestivum
  unsure (1)..(95): unsure at all Xaa locations
  Clone ID: PAT_TA_102524.pep
GEIVGTFVLVYTVFSATDPKRXRDSHVPVLAPLPIGFXVFMVHLATIPITGTGINPARSLGAAVIYNKKAAWGQPLGSSGVGPVSLGSGWRAAGR

SEQ ID NO: 208107 - protein, 94 aa, Triticum aestivum
  Clone ID: PAT_TA_102525.pep
GEIGQRVMVGERLDGPRRRGLSRYRSLDGGHGLGAMGRQETHSGVFEGGVLWEGTTSREGGRGRVDEGGQAAKNGSLNGEGLETRKGLQGKMPL

SEQ ID NO: 208108 - protein, 87 aa, Triticum aestivum
  Clone ID: PAT_TA_102526.pep
YTYIASACIPSFSYYHTVNIFHSFWLVSLMYPFCCLPLSTSVRRGTFSRHLYFGFLGICCLNCALVITNVFSCTICSYGLNCKKPPH

SEQ ID NO: 208109 - protein, 132 aa, Triticum aestivum
  Clone ID: PAT_TA_102527.pep
PVAVGGRAPPGLRAHRRRLAVHLPRRLTTLADGHEGMKRHGRRRADADAHHSSSRRSNEFRDHNGPPPAFAAFVRETEGMVFRTGATLLSVIIATHWAYLTRSMGWSCQDDPADQWARRTTVWCSSAKRTTG

SEQ ID NO: 208110 - protein, 70 aa, Triticum aestivum
  Clone ID: PAT_TA_102528.pep
LCNCIQTFTELCDRIPICDDLQGIKYQNPDIHESKKTIPKNYLLAAKSTRPNDIHHMYGQKYTNLLPTPK

SEQ ID NO: 208111 - protein, 61 aa, Triticum aestivum
  Clone ID: PAT_TA_102529.pep
VGLNVKNVAVKDLKRGFVASNSKDDTAKEAANFTSQVIIMNHPVQIGNGYAPVPDCHTSHI

SEQ ID NO: 208112 - protein, 112 aa, Triticum aestivum
  Clone ID: PAT_TA_102530.pep
LHHHLDEDAGIICSPGSTPPPPSTAAGPLDTQTERSPWSESTWGTSEPYTMVRSSCLYRSHQVMRQTLLGMLTGLTSKRTCLLIDSSGPVPMGFAWFPSRPLIGLRMTSSRG

SEQ ID NO: 208113 - protein, 66 aa, Triticum aestivum
  Clone ID: PAT_TA_102531.pep
IKYLSKCGKNSVYRFQSMRLFFIDHIANCCMVVRTCIKCCLIYLCHWTFGGRKYFIILDIANYLGR

SEQ ID NO: 208114 - protein, 87 aa, Triticum aestivum
  unsure (1)..(87): unsure at all Xaa locations
  Clone ID: PAT_TA_102532.pep
GIARTPDRLTPKPPLRVPPPRPLAPQILHPSPFHKWPWPAHHPLAXCPACSPPVTSLNVPHSAVPSLASASPPSPPPPTRLLAYRTV

SEQ ID NO: 208115 - protein, 132 aa, Triticum aestivum
  Clone ID: PAT_TA_102533.pep
VPVGRRSHGGLAAHCVRALSWTLIDKVSHGPESSRNIIVANADHFFARRLPDLLASRCHVARLKVCRTCPERGWVEELPRSLGEVSSQRLLQTSTQNARPAVLPTSPRPFAEHYEWSDPFDSRPPRNSCICV

SEQ ID NO: 208116 - protein, 124 aa, Triticum aestivum
  Clone ID: PAT_TA_102534.pep
HTSLADIQLCPFSVSSSSVGTGPSPAAALSIKAGKDGEFIRLNEERLASDRPGVEICSFSPGKFPPCFTTIQSPYRSPEERPRNPVLLRPPGPKRPRPIRSKNEMGLFKPWTCRVMKGKNRGRE

SEQ ID NO: 208117 - protein, 141 aa, Triticum aestivum
  Clone ID: PAT_TA_102535.pep
GRSGCLFWWCGQINHPLLPAVPLRRYMCCLPMPSIRSLPRRHGSLLSFSRHSALPPTPGRGLFPLVHRQFPSSWPIEPRPMPFHTLLLVNRAMWSVRARLNRSVGSNGQRLCPRPFLMVIGKAAMWCAQSGFKAAIALIRG

SEQ ID NO: 208118 - protein, 172 aa, Triticum aestivum
  Clone ID: PAT_TA_102536.pep
ALTPLNGRASLNRPTCCPATPRIASISSPARADLESAHFPVPSAHRGQTPLASRHGAYGTRVFALNVTAFIRAAPDSGPPRLSQNGCPLPWPLSGSRPTRAPPLKQPGLHGRDSPPAWQQRAVSNATASSPPTPRSPHLVPADSSATALVIADALLLCNALLDRHRPCYRDV

SEQ ID NO: 208119 - protein, 69 aa, Triticum aestivum
  Clone ID: PAT_TA_102537.pep
PNFVNAGFDIRHRFPEIRPWPVTTILWHSRASLLSVMRICRTRSIQYSHPVIPCLLTIELLKFRLNVGA

SEQ ID NO: 208120 - protein, 203 aa, Triticum aestivum
  unsure (1)..(203): unsure at all Xaa locations
  Clone ID: PAT_TA_102538.pep
MHDRPPTAALLDPRDPLPTARMPRPWPATRDPSRDSRPRRSPPAPSVTLKPPPSRRARGRSGPPSRIPAQGQSATLSHPPTRPPESPPPAPPHYHSPFTIRPCHPCPPHLPHHGSAPRRPRACQRPPPKRPPRPGXSHSPSPQPXTPTPSPPISPARPFRHPVPAPPVPPPPPLPAPMPPPHPNPPPHRHSPLFGSPLLTAPL

SEQ ID NO: 208121 - protein, 60 aa, Triticum aestivum
  Clone ID: PAT_TA_102539.pep
FSSRNVNWRKQKIRKICDAVTITHDMEIGLTSMPTHSKILNETELEKIRNQKGKTQNVQK

SEQ ID NO: 208122 - protein, 57 aa, Triticum aestivum
  Clone ID: PAT_TA_102540.pep
NTPRCLRSLVRLPFRALVAIQSFPQAKGDCYVWSRLEQVQYYPNYEFDFFLKKKKKK

SEQ ID NO: 208123 - protein, 82 aa, Triticum aestivum
  Clone ID: PAT_TA_102541.pep
QSPPIWPSRGTMLPTRGAIPDSALPLTRPAPVPPPRRSKNGHQTIGRFGTFTRDNSLRRGLHHLRSKQRGTFGNVCTVTPHL

SEQ ID NO: 208124 - protein, 75 aa, Triticum aestivum
  Clone ID: PAT_TA_102542.pep
TRKFRGPRYSCSQLLVIAHHTGGLRPVNCLHAVKHQHFWKPIWMVTGGAGAREEPVAMSDANCRPCAMITFPPTV

SEQ ID NO: 208125 - protein, 68 aa, Triticum aestivum
  Clone ID: PAT_TA_102543.pep
QGSPVATLQAKIPGDRGCNITAQGRLMSLQAVVHCVPMPNKETSRRTQWSRGQTKPPKLLVSNLSPPN

SEQ ID NO: 208126 - protein, 81 aa, Triticum aestivum
  Clone ID: PAT_TA_102544.pep
AAYRRCASTCPPGSVHHRRTPRSPLLSLECAQASNFGSVGRTPNPRTKNSLAPPIGERFIVLSLTRLASRRANRTRLAAFP

SEQ ID NO: 208127 - protein, 124 aa, Triticum aestivum
  Clone ID: PAT_TA_102545.pep
QFHPVLTGDPEPQVPSYSGPKSVVTGHGSGHKDVKAVDESQSTPFSALLYCITYKVTPFSYMTYLNKVSEHYALRYRAYDYQVRLQMLQKENNTDKKYGAKRASEVRHLRRLWGACHYFEEAKN

SEQ ID NO: 208128 - protein, 76 aa, Triticum aestivum
  Clone ID: PAT_TA_102546.pep
TRWSSVEYAKVSALFGANRPGCFASLSTNAGVKPIVMSRYPYPIYFWSGADFSQWYNYAGLESGLAYLPSLFLCAV

SEQ ID NO: 208129 - protein, 331 aa, Triticum aestivum
  unsure (1)..(331): unsure at all Xaa locations
  Clone ID: PAT_TA_102547.pep
QVPGLSPTRHDPSQTQDGSIRASLTTGLPPGNSDLILWRPSPPLPGKHNYLPARVCSAPDAPHTVAIPTPPRPFCRGPDTAAPATTPPSPPTPSXDLPPHPPRGSKPPTHLGSSDTASTPLPHAPHLPGADSSHPIPSVAALSPPPLPTTPTPYASPAPHFAARPSRRPTPSQTRLAASAPAPPACCPLTLSLDLPXYLPPAPTHPLRSQLTPSPLSYPXAPSLPPPPLATAPPLLPTYPXPDPXHAHPPPCPAQALCSNAPSSAHSTPLPVALPATPAPSAAPLIPTPSALRIPLPSEPXTSPPPPSANLHTQPPTPPKLEPCAHSPRPT

SEQ ID NO: 208130 - protein, 161 aa, Triticum aestivum
  Clone ID: PAT_TA_102548.pep
PCLSCRQGVSAMCLVCLVPLPSGAGAYVKLFSCRYAWLGGNFSFSFWGLAGPLRYYCFRSGRCCCSAMITPYFMLGIYVTFRISRLVCIAQARAIVSDYPVLCLSRTVIYALLTIRYSVLKSVAPLTFNLLVLLPIMVDTILNDARCACIFVFSVMGLAWT

SEQ ID NO: 208131 - protein, 73 aa, Triticum aestivum
  Clone ID: PAT_TA_102549.pep
RHNGFFFFFFVQMRLLTGSHYSNSLLVSRFQKSGPAGNRALSYLLTETLLLSYEPYRVASYACTTTDYQHLQT

SEQ ID NO: 208132 - protein, 104 aa, Triticum aestivum
  Clone ID: PAT_TA_102550.pep
LAVVMQHNATVLKAYLMTSLEPESISTPTSNCAQMCRSTPKKHRVTQWTILIRSPRYPETPFRCRLIPWPDGYELERRNLIRTCLNAPYYQEILLAQSEHFTES

SEQ ID NO: 208133 - protein, 69 aa, Triticum aestivum
  Clone ID: PAT_TA_102551.pep
CWPTYENIHTFLSHWKLQTCIQPSTRPYAPTSSVVGPDVRIGPSSVITPYASIMHYHPSDTIIIIVVIV

SEQ ID NO: 208134 - protein, 60 aa, Triticum aestivum
  Clone ID: PAT_TA_102552.pep
VDRIWSLIKSCSPGLEKGSGQVEDANATRCYADWASSSFTDIRHVFYSSLLTFTDPRSFF

SEQ ID NO: 208135 - protein, 38 aa, Triticum aestivum
  Clone ID: PAT_TA_102553.pep
AYNYLDIVTTLNMISLGSKNYIILSLDVTVLIGFQSCI

SEQ ID NO: 208136 - protein, 126 aa, Triticum aestivum
  Clone ID: PAT_TA_102554.pep
ATVLCIVHSYLRPLEFVVLTDKSELRPLATAYPLRTMLRRLESGEGTLKFYILYKCYLYESRSPHMCIRHRRSPVTGDIIRCDQRSIYNSCLYSKSRGERKLAFAASSPVEILSRCRCEPRCLHHT

SEQ ID NO: 208137 - protein, 82 aa, Triticum aestivum
  Clone ID: PAT_TA_102555.pep
CRRKLNVYPPVLDVLTLGSLPGYNDTSDSTNNLRFPDLVSHWTMPLLETFTVCGHPLLKPLPVIHIEEMSSLQYFIPNGSNP

SEQ ID NO: 208138 - protein, 83 aa, Triticum aestivum
  Clone ID: PAT_TA_102556.pep
ARRHLRGRIRTHSSRWTCAGSSLVWPRTADTAVPDRTSDGRYPVYLAPTSQARGRRSLPRRQTVVDKDGPNRQSVVKSHERTP

SEQ ID NO: 208139 - protein, 71 aa, Triticum aestivum
  Clone ID: PAT_TA_102557.pep
FRRIGRHAPSARGMMESSYPPVSGPAKLTITSARAVMPAGQPCPVCQSAGQHLLADVMYLGNVPDSTVISG

SEQ ID NO: 208140 - protein, 168 aa, Triticum aestivum
  Clone ID: PAT_TA_102558.pep
LTHVPFRRCPPSRFQLSHFPRLPVEEIAIRSNCAPQCTLCLVVRPASAKAFGSRQANPRPTLRIPRHNLLNQGDPIVNTQQLLKLSPFWYARRSNLHATLGATLSLAANAHCQETERVIWDYVRSPIKADLERFCDASVGPVDSGDEGRGCGSIVGHRHVRPDQGRIG

SEQ ID NO: 208141 - protein, 85 aa, Triticum aestivum
  Clone ID: PAT_TA_102559.pep
HPNPTPLALLEFLPFGSKGGSVPQGQLHGRTWGRPAAFPAPILPPRHSRPPPPNPAPASPPQPPFPTNIGPQMPLPSPHPPFLPT

SEQ ID NO: 208142 - protein, 72 aa, Triticum aestivum
  Clone ID: PAT_TA_102560.pep
YPFLAPFRSQNLTDKSVLWTLLPNHSIPSSPVRRHDLVDMTLLCYARHGVLSSVQCPVWNDYFMDSVWLIGY

SEQ ID NO: 208143 - protein, 66 aa, Triticum aestivum
  Clone ID: PAT_TA_102561.pep
PEGVLLTQTKAMGQFRPPMHPPVSYRVLIDIAQSPRPPSDYHQLKTNRLSRYFPYNPLAMPQYFVR

SEQ ID NO: 208144 - protein, 214 aa, Triticum aestivum
  unsure (1)..(214): unsure at all Xaa locations
  Clone ID: PAT_TA_102562.pep
APLAPHRRRISPVFPAGEHPPGPLPPSPGGGPPVPPLLSGGSFTFLGGGRDYFGPPDFGRFPQGSFXPVPLGRAIPPTPRAPRGGPTGFAPPPLPKPPPGSPPTSPPTPLFFGPPFFVPPLLPAAPAPTSXGLIAVGAPPPRGPGPRGPVSGPRPPAQVAGLGPGPQGMASAFAPAVRPPLPRTPPWTELEPGHGVGLPLSTKRPFGQACSRSI

SEQ ID NO: 208145 - protein, 87 aa, Triticum aestivum
  Clone ID: PAT_TA_102563.pep
VKPGCCQPVPNGLPPMPWNPRGPFVGKPWALPTPGPGGNSLGQLLRRNPSSGFLTSGLGDKQRAGLGRTRKRAPSSRPRHLARPSIG

SEQ ID NO: 208146 - protein, 72 aa, Triticum aestivum
  Clone ID: PAT_TA_102564.pep
SMSIIFFRSAPIYSHSLGGLLSMAHVRCMSVGGDGVFYVLLVGLYSSLLVLVMTCSCTACTACTSPRSLCNL

SEQ ID NO: 208147 - protein, 158 aa, Triticum aestivum
  Clone ID: PAT_TA_102565.pep
LGNETVQAVGYSFKQRRTLAAPVLPFSPPGSGGRPFGLFHSHPGPPGFGAVRQTLLFDPSPSSAFPSIVGSAIQARRQALRGLAARLSIADGEQAGRNLVMVHCCRSMNSRSGSGHAAVESFTHRVSIPSCGAARCVRCPHLGATGLRFMGSGIRLGV

SEQ ID NO: 208148 - protein, 152 aa, Triticum aestivum
  Clone ID: PAT_TA_102566.pep
TPSGDQVLNGYRPDQVKLTCAMGSSADFSQPSSLIHSRWDAYPHLIRRPRAPLLAFVLSRLPRLLTFEKYHTVLQSSSGLSPSSQPSSHRHCLCANHHPKPCQHLEWTKWLDRTLPVVRRLAQSIHDCLHVTSSSSTPMAETRKEGDRSGEE

SEQ ID NO: 208149 - protein, 148 aa, Triticum aestivum
  unsure (1)..(148): unsure at all Xaa locations
  Clone ID: PAT_TA_102567.pep
MGKEKTHINIVVIGHVDSGKSTTTGHLIXKLGGIXDKRVIXERFEKEAAEMNNEVFASTPWVAWTSWTGPSVEKGYAALDYCPCWEVCDEHLSTKLAPVCRLPRRFSRSTPIHGTIAPGGRARLISLFGRWEVQSWSSRYPARLRSVR

SEQ ID NO: 208150 - protein, 426 aa, Triticum aestivum
  unsure (1)..(426): unsure at all Xaa locations
  Clone ID: PAT_TA_102568.pep
MGQRPPTLHITSPAQLSARCRPLRAFRPPPRDPDHIRPTPHNRRDLAHFFATHTSNASPYSRVPPAKTLCPTPALGPPLATRXLPPALKPLHSPPCLQPQPWCPLNGTGLPAAHPWASPPKPAPVPPWPTPVDHTLESVPRPSPLPPAPPHQHRRRQATTTTPTSLPLRPPAXPPVCRHTPPTXRTLLPPPAVLCILLEPTRVPTPYALSPPASPLTLHRLPRPLSRCTLPSAASQASPAPHTGVPPSNTNLLRLQTSTPSTLSPKXTRPRTRDTTPKTRPXTKPPSPPSIPARSRAPGTSSPLTSLHPESHPIVDFPPPVVRHSHPCAEAPDSPTSRXPAAPPTPYSPSSFRSATPRPASTSLTGRPPATPPLRARSSPLYRLPYHPDRAPAIPTRTHISPPHNTSPRPPARRGFPQGPKVAPCT

SEQ ID NO: 208151 - protein, 73 aa, Triticum aestivum
  Clone ID: PAT_TA_102569.pep
HTHNIPRPETKTKTKTNIQGMLLATWTRAGREAQRFRFVRAYCTYLLILETTKQTCKKEKEWATTDTQCGNRK

SEQ ID NO: 208152 - protein, 120 aa, Triticum aestivum
  Clone ID: PAT_TA_102570.pep
PQGDPLTGSNSILLCPPGITGDSWALPRLSYARAGPFFLPLGEGRDYCDSPPSLTKTYLGMQASQFPTVTSPCALPLKASTYQHTCTMDGIPARSLGRGPDTVCSFSLRYPLLCIRAIAA

SEQ ID NO: 208153 - protein, 63 aa, Triticum aestivum
  Clone ID: PAT_TA_102571.pep
VRFTRALIVQTRHGTLALLCGDTVSFYHVGASSCFPVDGRIAKWSGRCVQAVAVVVFCSWVFG

SEQ ID NO: 208154 - protein, 96 aa, Triticum aestivum
  Clone ID: PAT_TA_102572.pep
SQSRKHGLDHGWLRSMVNSLTDRAAHLADDSTRTASTSPPGTFGRRCSDLRDGYNSMGSIRYLNMGLIACCGLGRVNRRLEWFRRDGESALTRVHW

SEQ ID NO: 208155 - protein, 110 aa, Triticum aestivum
  Clone ID: PAT_TA_102573.pep
RKYCRDQLIGPKEGYLSKGLLFGTINARAQSPLSLGGYPFPLGWVGNRNHGPSVLKEYPVHGSKLGRGCNCLGAFGPKVFELKVSGFRGNSFLNKQIVRGRRVKLRWNSV

SEQ ID NO: 208156 - protein, 128 aa, Triticum aestivum
  Clone ID: PAT_TA_102574.pep
HDVPSLLASVPDNTFAAPRLLSLVVAQCSSRTFVGLTLAGCSWFFVTVPTRIVPNHGANPPNLVPRDSSLPISFSPFPHPLNIPKNKNTKTIQHNITAKTYQKTKKSLQPTNTRICPRARTNTPIQQC

SEQ ID NO: 208157 - protein, 137 aa, Triticum aestivum
  Clone ID: PAT_TA_102575.pep
SYRAGRHSTLLSVLTLTTLSKSVSRHLAWLCFSTWPLLVAPTTYWGVRGPPLGPCPHSLPKSHVHPVLQSSPVPPALTQRNTQPLCCCCPHAHHRLPRNIENPSEPTPPTRRDTSPAAPLAPLPPPGPGGPPPPRQA

SEQ ID NO: 208158 - protein, 113 aa, Triticum aestivum
  Clone ID: PAT_TA_102576.pep
LASSRRRRQWRGGGRQSGAWWSSLWRTMLLGGVHASQLQAEAWGGPGEEMAPRMPPGQRFEDRLTFRAREQPSCKLSTSGLTTRPTRRAPPLAVRPPLPPKDHARQTKLAFCL

SEQ ID NO: 208159 - protein, 99 aa, Triticum aestivum
  Clone ID: PAT_TA_102577.pep
EQVAMHNTREITDRIAPIGYDVSPVHPCLSHSHTISRTLASPRGRFRVPPGAHTLTGCTRHSSVLHGLSHRIHSRTIAHPAPQVHCNRYTADPNLYSLS

SEQ ID NO: 208160 - protein, 67 aa, Triticum aestivum
  Clone ID: PAT_TA_102578.pep
NLLSYATHAVDDSPGMYPSYGSARDMIQELHAELCSCRKTPTGRQDDGEDHLQDCCRAHGLLTSLEA

SEQ ID NO: 208161 - protein, 62 aa, Triticum aestivum
  Clone ID: PAT_TA_102579.pep
QRATSIVYCTQSHQYWGNREKELANFSSLLGNSLQRTALELSWVLGFDPGNGSFGYHLSYSP

SEQ ID NO: 208162 - protein, 166 aa, Triticum aestivum
  Clone ID: PAT_TA_102580.pep
NKNLIVYVYKKTIDKYKVKKDTIKLQKSPQKFKEDFSQLSTHSLDRKGFLDSSSQSLVNHPLKLFPKAFEDHLGEFFVDARVLKDFLEIVMAIARKAVVQDCQHSKSKMALRHAILTSCLGWGGVGDSGRGGVQYVRGPVTQRKGRVLPRSARTHREQGNAKFSTP

SEQ ID NO: 208163 - protein, 219 aa, Triticum aestivum
  unsure (1)..(219): unsure at all Xaa locations
  Clone ID: PAT_TA_102581.pep
RRTLPAQLAATETPPPTQRSAGSLLSDSTVTPPTPLRLRPSQTLHCPPGLYATRPSKPSTPNYPATGSAIHAPRPLAPIAPHATRSYQPRPACPTTRHAPPAPPTTPADTYSXRPPPSHXPLAASYQHYELHRPLRRPIPTSAPSPNPPXYHSELPLPPPPAANPLAPPPFTSTYLPPPYRPSHPPAPHSRPLPAPASGTPPSDSHPYLPRSHRPLPLT

SEQ ID NO: 208164 - protein, 81 aa, Triticum aestivum
  Clone ID: PAT_TA_102582.pep
RCGRAGTMRSNYCKADRHPSAQLGTTAFKCSMAQTRFTQTRKREAVELQLQINCEISAHQLGTPMAFTLYAFPARTVVWNL

SEQ ID NO: 208165 - protein, 117 aa, Triticum aestivum
  Clone ID: PAT_TA_102583.pep
NPRANITPLSLGHFLARPFSASPLLYPPCGYPPWHSSWETPYFPGLSELVLHYQHRTHAGTDPGRHRVHVSDGMRKRRPIPQTRLHPRCVWPTSLICRLARHGFPDLEMRASERNRN

SEQ ID NO: 208166 - protein, 124 aa, Triticum aestivum
  Clone ID: PAT_TA_102584.pep
VPVRYVYFSRCQRQPHAFLCCSSQNGSVGLHVCPTSSRYTASRLCGCRYDLYKAGMATSFCMLDSFLGLRPPSRLRTYALDSTLLMIFFLRLHCNITLSRRLVLTCAWTCRTCDGVDMLKKKKK

SEQ ID NO: 208167 - protein, 76 aa, Triticum aestivum
  Clone ID: PAT_TA_102585.pep
KTTKYTSKSTGNHRSHQTHPPRKPKDPPVPAPEIGESTLECHAATEVKMSRPAPAARTKRNEPRKIAIVRHPRLVS

SEQ ID NO: 208168 - protein, 139 aa, Triticum aestivum
  Clone ID: PAT_TA_102586.pep
LASKKADRHARAVRRLRPRAGHAGALAAPYAGRRSDTTLQTRPRLSRRPGTATAGQCTRRVFIACLLCVFARWRMRCIGVAGSLIPGGSVSEVKVEDGDCGGGRLWWGVVFWVGWGVGGSCGGGVGIVGVLVFCGCGWW

SEQ ID NO: 208169 - protein, 51 aa, Triticum aestivum
  Clone ID: PAT_TA_102587.pep
VDDQSTVQSPLTCKGCQHTIYYVATTCTNQCHELFRHHHVARSHLVVDSNG

SEQ ID NO: 208170 - protein, 124 aa, Triticum aestivum
  Clone ID: PAT_TA_102588.pep
GTPRRHGPPSIQPDRASPRPRAARPWALVPSCATIGTRGRTRQSSCGRRGTRARLSKRSRWSASLPAKARPPPKTLARALQRGPPLPRAPPAGTSSPPLPGQTTSTGPRPTHPKPPRRPPGQRP

SEQ ID NO: 208171 - protein, 139 aa, Triticum aestivum
  Clone ID: PAT_TA_102589.pep
LQAWLTTPPSSRPTPRTTPMATRWAWRAALTTAPWQATKPLTDRYTPRVSGTARSHNGGGGVGVAGRTGAHASSIQTLDPGWIQRTQEPPRNHAFTPGPGHGGVRFHRGVPVPGTRTCPPGGAMEASARFQGLTPPAAP

SEQ ID NO: 208172 - protein, 159 aa, Triticum aestivum
  Clone ID: PAT_TA_102590.pep
LERCTDARHTGDAHLALVYAMSLGYFGPQTGTVYGLNQLRAVYRLTSSARDSAKCYLGTRFDPPEIRGYVPSPHATALVSTNGSLDFGDLAVWIRDGYTQSGAPALPLYPVDGLYFLWLRELLPLAFVVPNPMVKVLQNSRLNLQKFWGLKQSVISGCR

SEQ ID NO: 208173 - protein, 62 aa, Triticum aestivum
  Clone ID: PAT_TA_102591.pep
TAYTFTVQCLERLSLRYHWSRWAVGRATMRTLLDFLLQRRMISQDLVDLVTEGSATLALRSA

SEQ ID NO: 208174 - protein, 93 aa, Triticum aestivum
  unsure (1)..(93): unsure at all Xaa locations
  Clone ID: PAT_TA_102592.pep
RGQNGTQRNRGCQEPGGNEPGPKMGGKETGNRTDRGRHGLGPNGGGRVAPGPKGGXNGSPKGPGARPNPPSGGGKKGPGVGRGPLRERKRGAA

SEQ ID NO: 208175 - protein, 105 aa, Triticum aestivum
  Clone ID: PAT_TA_102593.pep
LGEKKPPKSKNGRLPFFYTRFSLWALFFAWAPFFCLEQIVSFFPCQLIPHLNFHDWIKPRYLPRPYLKLRNGLTRFGQQGRKRTRKRLGGGQVEAEGSRERGASK

SEQ ID NO: 208176 - protein, 132 aa, Triticum aestivum
  Clone ID: PAT_TA_102594.pep
KTSEQDKVNVRIHLFFHFVWARAGLWVLLIVSTISLPPVRFGSVLFIPVKSGPVASGPVHLQLSPFQFRITVSYMPKSVQVRFCLARLAFWRTGVYAPWFFVPVDGGFPRRFRGGVASGCWSRPFSFGLAGW

SEQ ID NO: 208177 - protein, 204 aa, Triticum aestivum
  unsure (1)..(204): unsure at all Xaa locations
  Clone ID: PAT_TA_102595.pep
HHASVLPQSLSRYTPPLPNSHRVPAPPTSPPETPLRCCNAHTTASHRLNSQTHSLPPTSPGRTTRHLGPHKRPPPAXPSQRSPTATGQRLRPVFGPFGRTPTKLPVNQPPCRPLLPTRRIAAHKAPPPCVGVPXPRPPSAKPPSATVRHTRAPLSPPGRVAPSPIQLPSVAVLPVPAQRSGHPTPRPPARECAANTNGPPSGPI

SEQ ID NO: 208178 - protein, 87 aa, Triticum aestivum
  Clone ID: PAT_TA_102596.pep
GSIPDGLFRSDLPLSSFSTHSTLRLPILSAIHPCTRCYLYPSIISTLTRQVAYPIRKALSLSASGFERGLLASMTSCFRRRWVRTRP

SEQ ID NO: 208179 - protein, 326 aa, Triticum aestivum
  unsure (1)..(326): unsure at all Xaa locations
  Clone ID: PAT_TA_102597.pep
PPTDLIRPTSTPPRILLHLVSPPNQHPAPATTPAPSGLSATSSTSPSPPPLTKPWQPHPPATTPPTAHALPGPHHIAHPPHSPPIXRATSVSAIAPPPVERPPTRAFPRPQKSRGRPTXSAPPPPLPGPPVYHTTSAHPISLRPRLLPPAAANCPPLATPSLPTPHNLTPGDAPHSNRPPHRRPPLPRSLSSPRTPPLAHTPPTXPAPTPPPQTPFVRLDSPHPDRTPPRRAAHAPTPLRTVAAPPRTLTPRPPPAVPPPALTRTPPSYNPPPPTPAPQHTLPPDAPPPGSPYRPAIFRPHPAVQMDPTEAAPAPRKAEAEPHPRP

SEQ ID NO: 208180 - protein, 129 aa, Triticum aestivum
  Clone ID: PAT_TA_102598.pep
LDCPGSRGLFIPFLHPLQSLLRPIPFSVGSWVNVFPFNSASGFRGWFALLVHPFVVRFPYWVWQPFWISTVALSFRIVATVQFPSCAWSFTWAPILSSLLGLGCKPSLLRLPSCNQLSYRTESNLCKVE

SEQ ID NO: 208181 - protein, 85 aa, Triticum aestivum
  Clone ID: PAT_TA_102599.pep
IWSRQLKTVSLGGQLGTVSPYRWIEVVKMVIRLGGKGNGWAMEPLSVWKGFPWFRFCAQNPAFKQSNRFYSRCIFFPPPLGFLRD

SEQ ID NO: 208182 - protein, 87 aa, Triticum aestivum
  Clone ID: PAT_TA_102600.pep
GRSVQKFYTKLSLRNRHPGVTGSVGVGHPPRRNHFKQDIKEIGPRWFRGGLSGGWSTKPGPGPFLPLFWEKGRCLRVPNRRILRSGP

SEQ ID NO: 208183 - protein, 115 aa, Triticum aestivum
  Clone ID: PAT_TA_102601.pep
VPFQTLWPSFHVDRHPHNGHSVRCSERQELGPNYSLNITLLRTPSRGHSFAPSSYNCEFETAKVNCTIPQTSRMGNFDFPTSQTHGSRGKNRSKAPGGFFPKPSAMQRTKSFRLF

SEQ ID NO: 208184 - protein, 70 aa, Triticum aestivum
  Clone ID: PAT_TA_102602.pep
GIVQTRPKCAMQGSCKKNSGSRCHGPIQVQAPPRLGVRPQTPPWGFRPPFLRKSPGPLANPPGKCQAPAP

SEQ ID NO: 208185 - protein, 71 aa, Triticum aestivum
  Clone ID: PAT_TA_102603.pep
EWSHDIAMRCRLGLAKTFMIAANESLNYASERPSTKSANSLGLVLTAYYLVDRALHTFSKSTALLPGNLVK

SEQ ID NO: 208186 - protein, 140 aa, Triticum aestivum
  Clone ID: PAT_TA_102604.pep
NQRLNSQALEFVIVRSFFRPPPYYPPRFKDRQPGFLPTGPRLFRLFGRPSLPKKVFLFFVVGPRLKWPLGSTPFVIWSPRTNGDSLPNFRYPVLTRNDPEVRPQPVGAPVEGHPCSVMLSFAHSQVFQNRVDIARIVRHP

SEQ ID NO: 208187 - protein, 68 aa, Triticum aestivum
  Clone ID: PAT_TA_102605.pep
KALYTPIRMLFLSVECKYFQLRAKEMHNTCQTQRPSEYPHDGSLRHSDSLTHYIERRITPLLHKSKKT

SEQ ID NO: 208188 - protein, 82 aa, Triticum aestivum
  Clone ID: PAT_TA_102606.pep
NTFVQTHDHSRLFNSQFGIARSWRCKYSHVVSLTKAQNGATSICPGPSRHLRNRMPFREDSLQSFSYCLRVSYRRGNIAGSN

SEQ ID NO: 208189 - protein, 178 aa, Triticum aestivum
  Clone ID: PAT_TA_102607.pep
QIKPLGAGVMGIACSIALANSTRTAGLLDTQVALRSSGHSSLVRNYSRPDLLSLAPFCQGQAKHSLHGAAQEEPLPPPSHGSLQFQRYRSWEAKWASASGRNQLKGSEALVGFNWPGEQCTLRNGRPALGKFDKMQLEAAGALLGKLWVLGFSGAGGEARPWDWGLSKFSFKQCVVEA

SEQ ID NO: 208190 - protein, 505 aa, Triticum aestivum
  unsure (1)..(505): unsure at all Xaa locations
  Clone ID: PAT_TA_102608.pep
PPRPRRLVASSPSSTPAPPGDPPXPPATLPPPPTPPSPRLALPPRLPALPRAHCHPSTSSSPRPRATAYPHAPPSPPPPPQSTPPPCHPPPPSARPPPPPSXPPDPPRTTPPPAVPPNGRPPIAPLPNPAPPTLAVPIRRPPAPXLPPRPLLPSPPDIPHLQRPPPLSPTTRPLPGPPPQLPEPSLPGQPLPPRTXPPPLPSPPDPAASPRLSSNSPPPPSNPPXPPPTRAFPTPCASPHSSPXSPQQHSSPALKPRSRCPEPSPLTHSPPPSPLPPSRPXPPRPQPRPLLSPPAPRCRPPTALHSPHEPALPPPTIPPRSXPSPRPPPPLPPRKTHPAPPLPHHTPPLPPTPCILQPPRLAAAPPPPPSRAPRPPTHPHPLASPNPPXPPLPPRCGLPTLILPPASPTLPQSHPSLRXPPLKQRPPHTQPPRIPRPYPPAHTLTTPPRPRPDYSXPTFSPPPTSSLRPNARSRSSPPTPPTFPPLPTTIPSRQPVIRSPPSPTT

SEQ ID NO: 208191 - protein, 111 aa, Triticum aestivum
  Clone ID: PAT_TA_102609.pep
DGSPVPGGGPETPLWGKKTAQAQPAGPFFYTGFPLGPFLAWAPFLAPTLLCSSHGRYFPPWHFLLGIQPTSLTPTLSNVDACITRLRPSSPGTEPRAASRSPGRSEGKAGQ

SEQ ID NO: 208192 - protein, 142 aa, Triticum aestivum
  Clone ID: PAT_TA_102610.pep
NSHPRRAPFLHRASILSSTCARRSLPTCPGFQPLLVRHFTCLLTTLRIRYALHGFPFVSPRTLPPDIQSNSRALSMAKVLAVRQSLLLPWARFPRGRTSRQCRTIEDNFRSFSSPRDLLIGLLIPEYVLLVGPRCLLVFPPP

SEQ ID NO: 208193 - protein, 88 aa, Triticum aestivum
  Clone ID: PAT_TA_102611.pep
RILSFGRRFRSLTRIHPTQVYASSCKAMRMIWRYIPAGLPRLDFPSKYVRPSQWFRPIVILAHHRCKCPFAIPSNLGELRYPQHWGVV

SEQ ID NO: 208194 - protein, 37 aa, Triticum aestivum
  Clone ID: PAT_TA_102612.pep
IILNLFFVKTADEKETVSRTVYYTNIVIMGPCHLFLF

SEQ ID NO: 208195 - protein, 82 aa, Triticum aestivum
  Clone ID: PAT_TA_102613.pep
PKLSEERGTDGYRASDGREQTSANVERAETPRDSQHHESTRLLDKLVSARVVSDIVRNVDVATCTCDTGHPRDKISFRGSEC

SEQ ID NO: 208196 - protein, 78 aa, Triticum aestivum
  Clone ID: PAT_TA_102614.pep
MPRGWPNRCAAETQQLKLTLAHQLATLFTGRGTPSSVAMADTYVEIRSQSRPVVRGVGSLAVNFWWGSWPFLFSPGPI

SEQ ID NO: 208197 - protein, 75 aa, Triticum aestivum
  Clone ID: PAT_TA_102615.pep
MKSTKLAAILILQAVLVMGILSHVNADYFPKCCNNCRSFSGVDVCDDAHPQCPKGHAKSTDPFRASGSDEVCRLK

SEQ ID NO: 208198 - protein, 102 aa, Triticum aestivum
  unsure (1)..(102): unsure at all Xaa locations
  Clone ID: PAT_TA_102616.pep
RPNLKDNVTVSRTVTNVGPVEATYRVVVEAPAGVAVLMEPSIISFTQGGSTRATFRVTLTAKQRVQGGYXFGSITWSDGSAHSVRIPVAVRTVIQDFVSDTS

SEQ ID NO: 208199 - protein, 111 aa, Triticum aestivum
  Clone ID: PAT_TA_102617.pep
SGEGEGGGTSPRMAMVCSSKGSTDSCEGRDLKGLQSLTDGIVIFLLLALSDSDCCCLDRALHCCRASPILRSSSGSFSFFPTSGGSEMIFSLLALRMRKMWSSTSLWGSSP

SEQ ID NO: 208200 - protein, 143 aa, Triticum aestivum
  Clone ID: PAT_TA_102618.pep
GIKHLPRLVHFEALRVLEFQDCQNLHEYDMNGIDKLFQLKYLSFRGTDMSKLPSGIVRLYDLETLDLRNTHIEELPTGIIQLVKLQYLLIARYCPSGDPYGETKIPYGIGDMRNLQVISGINIFKSSLCAVEELGSLTGLKEL

SEQ ID NO: 208201 - protein, 172 aa, Triticum aestivum
  Clone ID: PAT_TA_102619.pep
YSTSNELLPPRVQGQWLLGPHDGQRRRAQLPDRGSHHGTRRGAQESREQRGGERPGDHLRAGTFCAGLDYDHHAESEEQAEHLAGRVAEVIRLLLELPVPTVAAVRGNATSLGLALALAHDHCFVWDHAVLGLPEARRGRRLPDYVATLLRDKLSFARLRKLLMLRSQTCTG

SEQ ID NO: 208202 - protein, 128 aa, Triticum aestivum
  unsure (1)..(128): unsure at all Xaa locations
  Clone ID: PAT_TA_102620.pep
VHDTKPPFLDGRVXYTKQAEPVMPLKDPTSDMAIIARKGSVLVREIREKQSQNKSRQRFWELAGSNLGNILGVEKTSEQVDADTAVVGDQGEIDFKEEAKFSQHLKEKAEAVSDFAKSKSLSQQRQFL

SEQ ID NO: 208203 - protein, 88 aa, Triticum aestivum
  Clone ID: PAT_TA_102621.pep
MGVAGHNDPLLGETTCGSLLQELQLIWDEVGESDDDRDKMLLQLEQECLDVYRRKVDQASSSRARLLQQLANSKFELTRLLSSLGELS

SEQ ID NO: 208204 - protein, 124 aa, Triticum aestivum
  Clone ID: PAT_TA_102622.pep
LLAPQLLRRPQPCGRSCPSHRGRVASSGLQWASRTASPRSTGRDSHPREHDGQQNAELPKQAAVLKKKEATAERVGKARSAAEDLVKQLMKRLQDLEAAAMHKLLFLPRSFPLLWPWLDGMFLL

SEQ ID NO: 208205 - protein, 115 aa, Triticum aestivum
  Clone ID: PAT_TA_102623.pep
MHLEMDISVAQYVALCGVTLVIGWLVHWVYKWINPVCNGVLPPGSMGFPIIGETLDFLKASSSLDIPDFYKQRMKRYGPVFKTSLLGQPAVISTDAEVNRFVFQHEETLFSIGYP

SEQ ID NO: 208206 - protein, 122 aa, Triticum aestivum
  Clone ID: PAT_TA_102624.pep
REDAATSNPAPPNTVINLPDDDEDEEPLKRRRSQKASASKVPQDVTAPEILTVEEENTTRHTVSFANPLTSAQQPSLFTTHHVPEDQAGAAKEAIRQAGIMMEQLKTIRDASQAAYDASSAL

SEQ ID NO: 208207 - protein, 97 aa, Triticum aestivum
  unsure (1)..(97): unsure at all Xaa locations
  Clone ID: PAT_TA_102625.pep
GYSPTILCTQQGLRCQLDYLQQCLPGYEQFGISRKGSQDTTDEYCTIFYEKEKVELTEGGXFWLSESPSVPGSISWGATAPCIATWATFQLKRVEPP

SEQ ID NO: 208208 - protein, 107 aa, Triticum aestivum
  unsure (1)..(107): unsure at all Xaa locations
  Clone ID: PAT_TA_102626.pep
MEQGADSAAARRMAILKGSNCRAKGAAPGFKVAVLXASGGIGQPLSLLMKMNPLVSVLHLYDVVNTPGVTADISHMNTGAVVRGFLGQPQLESALTGMDLVIIPAGI

SEQ ID NO: 208209 - protein, 141 aa, Triticum aestivum
  unsure (1)..(141): unsure at all Xaa locations
  Clone ID: PAT_TA_102627.pep
ADFDAMSLGSTFSGMGKPSPVDSPAGYYLXGGGGGAVPGLEQWRVXQMQGFPFFQAMADQQHTLTPAAAPAMAMPGMFHYLXLGNGGDGRGVHEDDGGDQQFHHAMPSKRECYPRSGSIAMYGXDHHLTAGAGYTSSYSNA

SEQ ID NO: 208210 - protein, 136 aa, Triticum aestivum
  Clone ID: PAT_TA_102628.pep
MNYYGNSDDQSRLSRINYYGNSDVSLGRYLQDILQNKKPSCSSCEAHVYSYTHQNGNLTVRTKHLVSQHSLPGESEGKIWMWTRCLRCEHELGVSKSTPRVVISSEARNLSFGKFLELSFSSHSAARRLSICGHLV

SEQ ID NO: 208211 - protein, 87 aa, Triticum aestivum
  Clone ID: PAT_TA_102629.pep
RAQFAYIIMSPMCRRTWTGFTIKAFSGLPEFLKLSAASAVMLCLETWYYQVMVLIAGLLPNPELSLDSLSVCLTISAWVFMISIGFN

SEQ ID NO: 208212 - protein, 152 aa, Triticum aestivum
  Clone ID: PAT_TA_102630.pep
RWYVCLFRPDRVTALVNTSLAFIRNIIARNGPGFVKPTDYFNRAYGPDYYMCRFQEPGVAEARQFAPAHARRLLRQIMCHCFSHGVACEEEMHDNKYPTSTLPPWLTEEDVDYFGAEFERTGFTGGINYYRNLDRNCELAAAWADAKVQVPT

SEQ ID NO: 208213 - protein, 120 aa, Triticum aestivum
  unsure (1)..(120): unsure at all Xaa locations
  Clone ID: PAT_TA_102631.pep
GDLLGADGVTTAAAAIGAAIRALDGDGVLAGAEGWFQKILSLVPRRPMSVGGSPRYGVYDTDFGLXRPSKVELVSIDKTPGTVSLAEGTDGQRGIEVGVALPEADMARFASCFSDGLHQL

SEQ ID NO: 208214 - protein, 109 aa, Triticum aestivum
  Clone ID: PAT_TA_102632.pep
MGSLRSSTSAAVESVDAEAACGLLASEQYGYVDVRMWEDFEKGHVAGARNVPYYLSVTPHGKERNPDFVDQVAALHSKEDRFLVGCRSGVRSRLATADLAAAVSPLVNG

SEQ ID NO: 208215 - protein, 173 aa, Triticum aestivum
  Clone ID: PAT_TA_102633.pep
GDAFLRALDRSMQLAAGFNPADLWPSSRLAARLSSAVRRAQECRDTVYGILDGVVREHLERMGGGGGHDEDLLYVLLRIQKEGALQFPLDMDAIKSVIFDIFGAGSETAATTLEWAMAELIKNPRVMQKATTEVRQAFHARGTVAEHALSELTYLHLVIRETLRLHTPLPLLL

SEQ ID NO: 208216 - protein, 167 aa, Triticum aestivum
  unsure (1)..(167): unsure at all Xaa locations
  Clone ID: PAT_TA_102634.pep
VSTFVALTMDVASXSPRRYFFEIMSHFATAEHEKEXLQYFASPEGRDDLYQYNQKESRTVLEVSYVLTGDFLYVFLAIQKISVCKLYHLYDNRPLSLEFFSWLNSEIXVLCYFXYWRDFPSVHMPFEWLVQLTPPLKKRAFSISSSPLVHPNQIHLTVSIVSWLTPF

SEQ ID NO: 208217 - protein, 157 aa, Triticum aestivum
  unsure (1)..(157): unsure at all Xaa locations
  Clone ID: PAT_TA_102635.pep
MATETETFAFQAEINQLLSLIINTFYSNKEIFLRELISNSSDALDKIRFESLTDKSKLDAQPELFIHIIPDKATNTLTIVDSGIGMTKSDLVNNLGTIARSGTKEFMEALAAGADVSMIGQFGXVGFYSAYLVAERXVVVTTKHNDDEQYVWGSPRP

SEQ ID NO: 208218 - protein, 90 aa, Triticum aestivum
  Clone ID: PAT_TA_102636.pep
NKAEPTEAGQTRQIPQITPSKDRPHLPDTDGVMIEIEQPRSTRTKQTEHDHGNRKIRSRIGRPNRRSDQRRCRIERGEGRRGEERDPSNL

SEQ ID NO: 208219 - protein, 162 aa, Triticum aestivum
  unsure (1)..(162): unsure at all Xaa locations
  Clone ID: PAT_TA_102637.pep
RDVANARFALLSESCIPILGFPALYAYLTGSNTSFVDSFDRRDGRARHREFFAERNISLAQWRKGAQWFEMDRAFALEVVSDETYYGAGXSGTASNGVRNLEEHYPMTLASVLGWGARNSNRTVTYSDWRHPVGQHPKSHNGSEITEELFEEMRRGYGDCYY

SEQ ID NO: 208220 - protein, 123 aa, Triticum aestivum
  Clone ID: PAT_TA_102638.pep
ARLRKLLMLRSQTCTGKELAGTWWSTHGADGNRQVVLDKAVDLLYDVQVGDGANFAKTRQMLCGETCAAVGITITMEKHKPQPTPAELDSHKAAGPSQTSVMTEKTPKWHNHDPFVDMYKDGS

SEQ ID NO: 208221 - protein, 169 aa, Triticum aestivum
  Clone ID: PAT_TA_102639.pep
MRSRTKSHANRTSVDAKISELEDAEDEDAGLRDERDFKRSQVFSLTQILVLAYQSTGVIYGDIGTSPLYVYSSTFTEAPSRINLLGALSLILWSVTLMVTVKYVLIILRADNDGEGGTFSTYSLLSKYANIANRDPREATLIRMERHNTDTLGRSTRNIRSTIEKSKFF

SEQ ID NO: 208222 - protein, 72 aa, Triticum aestivum
  Clone ID: PAT_TA_102640.pep
RYDQATHREPPIDSTAIDPITRSPNYHHETGNIENLSRANLCLAHGPLELDDDDLDSLKLDHLSWLRWLDED

SEQ ID NO: 208223 - protein, 155 aa, Triticum aestivum
  Clone ID: PAT_TA_102641.pep
MGRPPSSDENGLKKGPWTTEEDEKLMSYIQKHGHGSWRSLPQLAGLNRCGKSCRLRWTNYLKPDIKRGKFSQEEEQTILQLHTVLGNKWSAIAKHLPGRTDNEIKNFWNTHLRKKLIKMGIDPMTHRPRTDFFAALPQLIALANLRQFINQQPMG

SEQ ID NO: 208224 - protein, 70 aa, Triticum aestivum
  Clone ID: PAT_TA_102642.pep
FSSSTSTGITSDARRRAAMAMVAQAGFGLTRVVMLVGAGVAGSVVLRNGRLSEILTEIQEFLEKGEMGKG

SEQ ID NO: 208225 - protein, 183 aa, Triticum aestivum
  Clone ID: PAT_TA_102643.pep
NPAQRVSHVGQWLDIVSEAHADPDLLRHLGLKDTVERIRQAWTVGAKFYGIPESFVRVCVAACPVCKAAPAGQPDSAISSPGRGKRRRRFEYTETLDVPARDVPRRLQQLAAKHKVVLCIRQKYIRYKPFMAEVKDYACHRAGVPTSSSGNTVSSSASASEAKKPRGLKREPYQSKRCGCGFR

SEQ ID NO: 208226 - protein, 80 aa, Triticum aestivum
  Clone ID: PAT_TA_102644.pep
WIPEWIYQQAVQYGFLPSNIHNSGVPESTSLTTCDLPSGAFGFTRLTNLSPIEASFLATSSLFERLLFSTTRCKMEYVDE

SEQ ID NO: 208227 - protein, 102 aa, Triticum aestivum
  Clone ID: PAT_TA_102645.pep
FGSPLKRHKPNVDVMYDRRPSMASFNFDCESKDARPVTKADQNIGSANVDFEFHPTRNNLSPIVPVRLSRHFIDEVDQVQCSQYVSERLLNSHVSPFEQDCV

SEQ ID NO: 208228 - protein, 223 aa, Triticum aestivum
  unsure (1)..(223): unsure at all Xaa locations
  Clone ID: PAT_TA_102646.pep
RGPSIWDAFIKIPGTIASNGTADVAVDEYHRYKEDADIMKNIGFEAYRFSISWSRIFPDGTGKVNWEGVDYYNRLIDYMLQQGITPYANLYHYDLPLALHQQYLGWLSPNIVGAFADYADFCFKVFGDRVKNWFTFNEPRCVAALGYDIGLHAPGRCSQCSAGGDSTTEPYLAAHHLILSHAAAVRRYRDKYQHHQKGRIXGILLDFVWYEPLSNSNADQAAA

SEQ ID NO: 208229 - protein, 169 aa, Triticum aestivum
  Clone ID: PAT_TA_102647.pep
AANHLQHVAPEHPDLQYNLAKLRFKPSRPAGRLLSARDRQQSDLMMYKPDEEEMAKVFDKIAGEPGRISRSDLQVLLQRFEKADAAGEARRMVCAADSNKDGYMDLEEFMEVHRNGVQLGDIRRAFFVFDRDRDGRITAEEVMDVLRRLGDSCSLEDCRRMVKEIDRNH

SEQ ID NO: 208230 - protein, 78 aa, Triticum aestivum
  Clone ID: PAT_TA_102648.pep
GPSSGGSRSPARAAAARSRRPPPPSATRTAPAPARTPPPPPPPPAPRPRSRRCGAGRGGATRRRRSRREGQGDAALRT

SEQ ID NO: 208231 - protein, 239 aa, Triticum aestivum
  Clone ID: PAT_TA_102649.pep
GATAFLYILLSLWVQGAAAILGFTRSDFPQDFVFGSGTSAYQYEGAVAEDGRRPSYWDTFTHAGKMPDQSIGDVTADGYHKYKEDIKLISETGLEAYRFSISWSRLIPNGRGAVNPKGLQFYNNIIDELVKHGIQIHITLHHLDLPQILEDEYGGWLSPRIIEDFTAYADVCFREFGGRVTYWTTVNEPNIGAVAAYGSGQLPPGRCSDPFGITKCTAGNSSTEPYIAVHTYLLAHASV

SEQ ID NO: 208232 - protein, 125 aa, Triticum aestivum
  Clone ID: PAT_TA_102650.pep
MVSVLRAELLQLIKLTQSMELYKEQGRPYVLGTETSHSAQRAAAHGDTVAVSLYDTPRMITYLQQAKQIENAPKALVPSADEDVKHEIAANPLAAFAGPLDIYLENAMKALQAIQNIVHSHTNNT

SEQ ID NO: 208233 - protein, 68 aa, Triticum aestivum
  Clone ID: PAT_TA_102651.pep
FCYVADMVNGLMKLMNGDNTGPINIGNPGEFTMLELAENVKELINPEVTVTMTENTPDDPRQRKPDIT

SEQ ID NO: 208234 - protein, 73 aa, Triticum aestivum
  Clone ID: PAT_TA_102652.pep
SNMWGDAFLHWVSVKSFLTPQPSFRSVERREEYAMLNVNQHERIVFLITYFPCGNCVIEMPCLMRISMSELFS

SEQ ID NO: 208235 - protein, 146 aa, Triticum aestivum
  unsure (1)..(146): unsure at all Xaa locations
  Clone ID: PAT_TA_102653.pep
MMTSRRASSGSTSSSCALCEGSNLPSCCAACVGGGVFEYHATLRLRRNLRDTLQSRIAARLEAKRKAEEQRMWKLSKAHDIKELRDRLXELKSRTALEKMKIKQASSDLKVKSGTLNVAFITLKTKQTDSSTMHTNAMKAAQMGLM

SEQ ID NO: 208236 - protein, 127 aa, Triticum aestivum
  unsure (1)..(127): unsure at all Xaa locations
  Clone ID: PAT_TA_102654.pep
EEVGDVEGAADVAFPPSPPPSSRPGTSCRPAAPGAPSPPSARPPSSPPRPVPPPFARPXSSPPRPVPPSSARPPSSPPRPVSPPFAGPPSSPPRPVLPPAPTPTCSSRSRGRRSHRALDSRAAQSSG

SEQ ID NO: 208237 - protein, 154 aa, Triticum aestivum
  unsure (1)..(154): unsure at all Xaa locations
  Clone ID: PAT_TA_102655.pep
IATVIAVYCNLPFAHIRGIGWGWAGVIWLYSIITFIPLDLFKFAIGYALSGKAWDTLFENKIAFTNKKDYGKEKRELQWATAQRTLHGLPTADPASTPQERSNYGELSEMAEQAKRRAEMARLRELSTLKGXVEXAVRLKGLDMETVDNHHYTV

SEQ ID NO: 208238 - protein, 105 aa, Triticum aestivum
  unsure (1)..(105): unsure at all Xaa locations
  Clone ID: PAT_TA_102656.pep
ADIWLPWDSVXNGEVDEEMMRSGKVPEFIYEEDDEQDDDEFIVDWDTNELDDVIDDIVTSRTKVLGGTTMSAFAEEDIVDGILGLRHKEDDMLWSSDDEDEDGYL

SEQ ID NO: 208239 - protein, 192 aa, Triticum aestivum
  Clone ID: PAT_TA_102657.pep
WCYRKNFMHLKTVVFQEMPELVEWVGEPNSQLFSRLESISFGDCPLLCSFPFLECSGRFSNLCALVIHSCPELSQLPPMPHTSALTHMSVRNAGSFLSYDGNKFTIEGCNGALAFHNMDKVQVMQIGNVSHISLSDLRNLNSLRNLDVKKCESMFSSELDDSVSLHSVQFLDLKELCITGDVFSKLLKCFPS

SEQ ID NO: 208240 - protein, 124 aa, Triticum aestivum
  unsure (1)..(124): unsure at all Xaa locations
  Clone ID: PAT_TA_102658.pep
MEGDKFQEEIECLMEVKHKNVARFLGYCADTQGESFVMADVRRQFLCFKYRHKDTHSGVEWREHYEIXQGNCKGLWYLHRNHIIHLDLKPDNILLDDNMVPKIADFGLSKYFRAGLSFQNLDEH

SEQ ID NO: 208241 - protein, 55 aa, Triticum aestivum
  Clone ID: PAT_TA_102659.pep
FFFFCFFFFFFFFFFGGEGKPLFFLTKKPCPKKTNFPIQIIFLPQMGLPQTTKIK

SEQ ID NO: 208242 - protein, 146 aa, Triticum aestivum
  Clone ID: PAT_TA_102660.pep
HLGPGDSLHLMDKVDAVDSPCLMLGEKCMHDSLNNRANGFPKTNLAVVNANVDYQYPSVTTQDSDTDSAASSVGSCNPYGSPYRQAHPQEYDSGDICSRTDDDDEASVSGTESPLPIKGGLGEETHLLELHAYRATMMALYAYGSI

SEQ ID NO: 208243 - protein, 166 aa, Triticum aestivum
  Clone ID: PAT_TA_102661.pep
DFEQRIKEVELKLEDSTKRGRYLEELLESRIKTWERKEIMLNQFVGVQMQNIQDLRLSSVSIRHEIQNCQKRWSEELSGLGKSLKILANASEKYHATLEENRKLFNEVQELKGNIRVFCRIRPFLPNEDHKSSTTEITGDNGELILANPTKIGKEGNKLFKFNKVL

SEQ ID NO: 208244 - protein, 83 aa, Triticum aestivum
  Clone ID: PAT_TA_102662.pep
FFFFFFFFFFFFFFFFFFLPGTPCLAHILLTLTSCNCVAIHNEDLYIKGRSHFAMERLRSRSIQKLWCHLVSGVSSHQSSRAV

SEQ ID NO: 208245 - protein, 155 aa, Triticum aestivum
  Clone ID: PAT_TA_102663.pep
MAPAPARAIAVVLLTFVCCGCAMAADQAPVKWLRAHATFYGGADASDAMGGACGYGNLYSAGYGTRTAALSRVLFNDGAACEQCYKITCDRKLADPMWCRPGVSVTVTVTNFCPPNNALPSDNGGWCNPPRPHFDMAQPAWEKIGVYKGGIIPVM

SEQ ID NO: 208246 - protein, 213 aa, Triticum aestivum
  Clone ID: PAT_TA_102664.pep
YDTTDLFFGENWLYDDLLFHREPEISGKSGDGDGDEEDKFIVDPDVGEIGDDSSRRHERSKSNAEAYTSPPCSCCHGEMEHKNGREFARDSWSAVYGRYQIMDDLTEVLDECGADAHQFRRNVNDDATLKGGPLVDSRSGDDQEFDLSALEKELQVLSPYLSEDANAANNHRFNHDFRVNDELNIDLITDDKIVDDKEFLKDSYSVHPFPEIS

SEQ ID NO: 208247 - protein, 129 aa, Triticum aestivum
  Clone ID: PAT_TA_102665.pep
VHAETINNMNRASRRNKEMQSMQAAGRRRNTKENIIHQGTSISSNSRESRKRDANFSHLNAKGKIDEGLPRARNNTTPQPSVTEINTELNWRACRCRRSRCRAEARRRQRRRPEAGPERSVRNTTSSQA

SEQ ID NO: 208248 - protein, 94 aa, Triticum aestivum
  Clone ID: PAT_TA_102666.pep
PTVPGPAPRRHGTCGFDPATRDFVCICDGGRNSTTDCADGRVTGHGASAGVVAATVVFSISAAIGIGGLVMYIRKLRSSKVVTCGVQSNENRFF

SEQ ID NO: 208249 - protein, 95 aa, Triticum aestivum
  Clone ID: PAT_TA_102667.pep
YHLIEHGASIQKYLCNIPIIGPTITRVMHHLYNTLSTDDPIHNILLNHTDPTMFIFESAQSLNIWRFRGVRLVTAKWKMLHKDCPRLHQDWGQRS

SEQ ID NO: 208250 - protein, 97 aa, Triticum aestivum
  Clone ID: PAT_TA_102668.pep
AFCYGLLLVSRLHGGHVAFFDREKKSPWEATKQQQSSKRFDYMHGPSLYERVLLVLIVHGSAFSQNCFCAYSLDRVEIMFGKSMYCCDIVCQEFFDI

SEQ ID NO: 208251 - protein, 114 aa, Triticum aestivum
  Clone ID: PAT_TA_102669.pep
IAGPSPRATASLTRTPRHGSQLAPRRPWPPHPPMLQIQPSLTSSTSVIRQGRGRGSIYLPACTVSVYPRARVLVRSGDDQKEEEEIHGWGYIQRPRHHPDVVLEARIHCLLNLC

SEQ ID NO: 208252 - protein, 203 aa, Triticum aestivum
  Clone ID: PAT_TA_102670.pep
MVEIHFWMMGVLFEPHYSYPRIVLTKLFTLVSVFDDFYDNYSTTEESNMFTKAINRWDEHAVEQAPAYMRSFYKGTIASINQIEEELKLQKNKHAELVKKLFIDAANCYHAEVKWRDQKYVPANLEEHLKISAPSTICMQIPNIAFILMGDVTSSETIQWAWAYPPIIKAVCIIARVMNDIVSHEREQASQHMVSTVQTCMNE

SEQ ID NO: 208253 - protein, 214 aa, Triticum aestivum
  Clone ID: PAT_TA_102671.pep
SYLRNEFDPAAYKTLKEKLDETNSEISSMQKKIEDARALDLETVAAITTELDDAKEMLQKVAEEESTLQNLVESLKLELAAAKQDHSQLKEKDTDTESIVADLHVKLQKCKSELEVAVCAESEAATASDDLMLALQQLSCESKTALQEAEMMQKSAAELRIEAEAARVALTEAEERLQSALKEAEEAKAAEAKALDQIKQLSDRASAVQASTSE

SEQ ID NO: 208254 - protein, 138 aa, Triticum aestivum
  Clone ID: PAT_TA_102672.pep
IGVEGIQIRTEDKGGSATKTQGLTYYEYGLNAIFNGLDQLCTRLDQMGHLSYNSQLFSELFKESVNMTKIRLRARIKLDEVDETPPIISNDTLEAANGKSEVSPKISTSTEIKLEIEETKEMGVKAKEKLKKAMMHNK

SEQ ID NO: 208255 - protein, 118 aa, Triticum aestivum
  Clone ID: PAT_TA_102673.pep
EKKQKEIKKTEKEAEGVRSDGSACCFSSSVDAEIWLWIGLSSFQSPGEPPRNRKTKQQKSGGKWGEESQVRSDGSACCFSSSVDAEIWLWMDLSSFQPRRNESNRRQRRSNKHTEGKW

SEQ ID NO: 208256 - protein, 172 aa, Triticum aestivum
  Clone ID: PAT_TA_102674.pep
ENLRSAMSHPQALAQCEQTLTQLGIEHREAVDDTAGAAKQIAEENLQDTAAVASSLAAQLYGLDILAENIQDDADNVTRFMMLAREPIIPRTDKPFKTSIVFSLEEGPGQLFKALAVFALRKINLTKMESRPHKKKPLRVADDNSTPLKHFDYLFYVDFEASMADPNAQNAL

SEQ ID NO: 208257 - protein, 140 aa, Triticum aestivum
  Clone ID: PAT_TA_102675.pep
VDLRAPGAQPFRGLIVPVLEEWSKSNVSDAFPFLAPIDHLLGSRRRISIHLAKLFNFFDQEIVQRRLARTSTNTGSEKNNDMLDILLARQAMSKLTRQEIITFLTDMFIAASDTSTVTVQWAMAQLLRHPEKMEKVRHEL

SEQ ID NO: 208258 - protein, 43 aa, Triticum aestivum
  Clone ID: PAT_TA_102676.pep
MAMAASRSLWASRAASYLKISAFPRALSTVLKDLTYAETHEWV

SEQ ID NO: 208259 - protein, 197 aa, Triticum aestivum
  Clone ID: PAT_TA_102677.pep
VAGVSYDPVKASSDVARTIAVLNGLGIIAFAFRGHNLVLEIQGTMPSTLKHPSHVPMWKGVKFAYLVVALCLYPVAIGGFWAYGNQIPPNGILSALYKFHGRDVSRLVIGLATLLVIVNCLTTFQIYAMPVFDNMEAGYVHKKNRPCPWWLRAGFRAFFGAINLLIAVALPFLSELAGLLGGISLPVTLAYPCFMWL

SEQ ID NO: 208260 - protein, 100 aa, Triticum aestivum
  Clone ID: PAT_TA_102678.pep
HRCMRVTLRDWAPGGTSLWGRQPYMSRPARLITCMPCPGRTGTRTGQNTTRRRAPLASTAGHADAYVHVCTAAWSSSLAGHSHIRTYEGHAPDRPLHVTS

SEQ ID NO: 208261 - protein, 175 aa, Triticum aestivum
  Clone ID: PAT_TA_102679.pep
FAVPPGLSPTALLGPPSLFSPTANFEMSHQQALAQVTAQAVHSQYTVGSQADYSLPFSSATTSALTSQFINSSANVTSMKETATLPLHTVNDNLKSNEVSQGFQTSALTVDKPADDGYNWRKYGQKAVKGGEYPRSYYKCTQASCPVKKKVEHSAYGQITQIIYRGQHNHQRPPK

SEQ ID NO: 208262 - protein, 76 aa, Triticum aestivum
  Clone ID: PAT_TA_102680.pep
MSCCGGSCGSACKCGNGCGGCNMYPEVEAAGATLLVAATATHKASSGGMEMAAENGGCGCTQCKCGTSCGCSCCSC

SEQ ID NO: 208263 - protein, 102 aa, Triticum aestivum
  unsure (1)..(102): unsure at all Xaa locations
  Clone ID: PAT_TA_102681.pep
MTEVALAIAGLRLAALPVLKKLHANASTYLGVDMARELHELETTILPQFXLLIEAADKGKHRPKLDKWLQKLKEAFYLAEDLLNEHEYNLLKLQAKGKYSLS

SEQ ID NO: 208264 - protein, 135 aa, Triticum aestivum
  Clone ID: PAT_TA_102682.pep
MPGPGSQNGRASPPKSENIHGLVRAGDVAAVQRKLQENPALLNDKNPVMCQTPLHVAAGYNNTEIVKFLLDWQGQSANRVEVEAKNMYGETPLHMAVKNSSYESTKLLLERGVHTGAKANNGMSPLHLTVWHALQ

SEQ ID NO: 208265 - protein, 192 aa, Triticum aestivum
  Clone ID: PAT_TA_102683.pep
ILRKEPQQESFIKLLTAPHEIPSPDEIEVYKILQKCLELRDCYLFREEVAPWEKEVINDPCTPKPNPNPFTFVPEPKSEHVFQMVDGVVQVYADKDRSERIYPVADATTFFTDLHYVLRMTAAGNTRTVCHNRLNLLEHKFKFHLMLNADREFLAQKTAPHRDFYNVRKVDTHVHHSACMNQKHLLRFIKSK

SEQ ID NO: 208266 - protein, 97 aa, Triticum aestivum
  Clone ID: PAT_TA_102684.pep
AQREQKSRVEQKGKSSFDSDFQCAPVSAAAATLRTSPAASSVAQFSRLRTKCRFAAPGVREDYSSTPIDVVADVKTEKIVVLGGSGFVGSAICRAAV

SEQ ID NO: 208267 - protein, 182 aa, Triticum aestivum
  Clone ID: PAT_TA_102685.pep
SDRQGRPDGGDGGTGGNVILECSRSVWDFSNLQHHTKAVRGGNGLSKKQIGTRGPDKVAQVPVGTVIHLVRGERPSFTLNKPTRSLDPWDIPDAVDDSADSSNQKNKDGINGNEAERESSNQREKQTYPSTCSKTGFSNAEDGDANSIQHQVEFDENDQFDDDDEEFWEDEDETEEEALDAD

SEQ ID NO: 208268 - protein, 89 aa, Triticum aestivum
  Clone ID: PAT_TA_102686.pep
LNPLIKKNIVARLISKKTGENRRDLLISHPQDTTHTPPLENLVEEAHFVILTTSPQASDYDFIVGSPGHLRPGPVGPPRTGPKIQGLGP

SEQ ID NO: 208269 - protein, 161 aa, Triticum aestivum; identical to SEQ ID NO: 129051
  Clone ID: PAT_TA_102687.pep

SEQ ID NO: 208270 - protein, 120 aa, Triticum aestivum
  Clone ID: PAT_TA_102688.pep
KIAWSVSPLLAYIKQEHQPHQAAVQTYCPWKMLQLSKIGLGFLLCLLLPPVVRLIAVAGFHALNSRTDQQRPNLSTTIPHNLNSTPASTDTSSATSYRYESVIKHTALRRHHDLQNMYND

SEQ ID NO: 208271 - protein, 143 aa, Triticum aestivum
  Clone ID: PAT_TA_102689.pep
PAHWARVCLRNMANIAKEATTVRRILDPLFRLFDSHNYWSPENGVALSVLQEMQTLMDKSGQNGHLLLSFTIKHIDHKSVAKMPAKQISIVKVASHLAKQAKSHASVTIASAISDLVKHLRKCMYRAVEASNAQADIDKWNSE

SEQ ID NO: 208272 - protein, 155 aa, Triticum aestivum
  Clone ID: PAT_TA_102690.pep
WDAQLQQRGRDGSSGSGGGAPTGSRGRGRGGGRAQSGGGNRGCKPSQAGRGDGNGGKCRYCNMSGHWIRDCRRRKADEAAAATTNLVQADVDGGPAMMLARVEPVQESTASLATTAPTTTHSVQEAWNPSMGTITPVTGHTSTTTFSGPVDWEAM

SEQ ID NO: 208273 - protein, 61 aa, Triticum aestivum
  Clone ID: PAT_TA_102691.pep
MSIPHELPAEWLTKSFMVALHLVHVIALPYAMALTNDPIPSSNNIVVCLNAETKFQPGTTC

SEQ ID NO: 208274 - protein, 67 aa, Triticum aestivum
  Clone ID: PAT_TA_102692.pep
KPFNGNNQKVQTLTVPKKNWDQVHLGKKFFILCFIHRNQRQKYYSWNKTNEKPGCEIKYLHPINYAI

SEQ ID NO: 208275 - protein, 48 aa, Triticum aestivum
  Clone ID: PAT_TA_102693.pep
GNINFIFVAYIIHYVCCLMFPVISFILIPSFSFSSYKCFHFMQKLRKR

SEQ ID NO: 208276 - protein, 147 aa, Triticum aestivum
  Clone ID: PAT_TA_102694.pep
STEYTGDGSLCTSGHPASREHTGNWKASSLTIVCSFCCYLAYSSIGKNLVSYLTKVLHETNLDAARHVATWQGTSYLAPLVGAFVADSYLGKYRTALISCTIFIMGMMLLLLSAALPIISAGPRAWTLWVDPISSRYNIFLVGLYMV

SEQ ID NO: 208277 - protein, 57 aa, Triticum aestivum
  Clone ID: PAT_TA_102695.pep
PFSFFFFFFFFFFYVSWADDDISSDTRQISIKNKRRNPELFSHNRRELKLKLKTINI

SEQ ID NO: 208278 - protein, 47 aa, Triticum aestivum
  Clone ID: PAT_TA_102696.pep
VLIQFGAFIVLCGATHLINLWTFATYSKTIAVVMTVAKAATAVVSCI

SEQ ID NO: 208279 - protein, 139 aa, Triticum aestivum
  Clone ID: PAT_TA_102697.pep
KSQNVQQFVHLHPEQWLSSGVSPELQIPSPVTRLTLTTRISPIISKLSPLQSSSKRKETDEIRTTSLENEHSHGQKGKEVFFREYAKALRIFALIERVKLQSYVEATITAMGSLQACAHGWHEWADVAQEEKMWVHLPP

SEQ ID NO: 208280 - protein, 119 aa, Triticum aestivum
  Clone ID: PAT_TA_102698.pep
MDNADIGYVECVPDEEAAAMMMPEEKARRLGRSGCLTFCAGEATSYSLEQLMRASAEVLGRGSVGTTYKAVLDGRLVVIVKRLDAAKIGPAASEAETFEQNMDVIGRLRHPNLVPLRSF

SEQ ID NO: 208281 - protein, 144 aa, Triticum aestivum
  Clone ID: PAT_TA_102699.pep
STSRTFKVRPGQVEPHAEAAGENDADDEESTQRSTEDSENASEAGEDASGSESGDGEHGSPEDHDEEEDMDHDQDPKAESEGEAEGTTETHDVEGGMSLLGISLPSSERFLYSAKPLAKHVPTSLHGREDRSSHVFYGNDSFYI

SEQ ID NO: 208282 - protein, 128 aa, Triticum aestivum
  Clone ID: PAT_TA_102700.pep
CPVVAVIQWAQEIERHTAKGSARVLLYHGARRGSQKYDFDTFDFVVTTYSTIEADYRKHIMPPKIRCEYCNKQFYPEKLKIHLRYYCGPDALRTEKQAKQKSKKWSDTKVKGKGKGKGKRKNGIEEEE

SEQ ID NO: 208283 - protein, 114 aa, Triticum aestivum
  unsure (1)..(114): unsure at all Xaa locations
  Clone ID: PAT_TA_102701.pep
MSTAEATREENVYMAKLAEQAERYEEMVEFMEKVAKTADVRELTVEERNLLSVAYKNVIGARRASWRIISSIEXKEESRGNDAYVASINEYRTRIETELSKICDGILKLLDSHL

SEQ ID NO: 208284 - protein, 80 aa, Triticum aestivum
  Clone ID: PAT_TA_102702.pep
DPTDNYSLCGVQQQISVSSVGQTGLCISNISSKQATCRFKVVNSQHNYTDLKAGTRCESENCKITAVNNLGCGYTSSMFF

SEQ ID NO: 208285 - protein, 143 aa, Triticum aestivum
  Clone ID: PAT_TA_102703.pep
GVLWEVDGHWVVQGAVDVDIGANPSAEGGGDDEGVDDQAVKVVDIVDTFRLQEQPAFDKKQFISHMKRYIKNLSAKLEGDDLDVFKKNVESATKYLLSKLKDLQFFVGESMHDDGGVVFAYYKEGAADPTFLYFAHGLKEVKC

SEQ ID NO: 208286 - protein, 98 aa, Triticum aestivum
  Clone ID: PAT_TA_102704.pep
EIIAAKPSQKLFVVDETRRKTYHEHEDQPSSDSDLIFDAFCAEPKELISVGLHAVHSYARSLARFAGSLGAQGWRIASERLQQTLPAEVRFGRGWVGE

SEQ ID NO: 208287 - protein, 166 aa, Triticum aestivum
  Clone ID: PAT_TA_102705.pep
MGGETKVVEETKVELKTAVYKVHVHCGQCARDIETQFTEFHGVQEVKLDAGSGKVTVRGVGFDEEKLRVKVSRGCRRHVEYIPPPPPPKEIITEVKSTKEEIKIITVKVPLHCPDCAVMVREILLEHKHIYAAKADLGKNTCVIEGVIEEKKLTEYIYQRTRKHCV

SEQ ID NO: 208288 - protein, 185 aa, Triticum aestivum
  Clone ID: PAT_TA_102706.pep
HSIQGLQPPAILFSETAKGIAKALSQHGKQLRLAVLQHMNKGIFSWATLISRIQSESPAVIIPHMGLENITVREILRAKGEAQSRAVYWCSTTHLVHEAVKHMTANNVGSLVVLKSGDDKQLAGIVTERDFARKILLPGRPSEETRVEDIMTEENKLITVSSNTNILRAMELMTDEHIRHVPVFD

SEQ ID NO: 208289 - protein, 189 aa, Triticum aestivum
  Clone ID: PAT_TA_102707.pep
MPAYYNSIIRGVSTIMVSYNSWNGKKMHANHHLITDFLKNKLKFRGFVISDWEGIDRITTPQHLNYSYSIEAGVGAGIDMIMVPFAYTEFIDGLTSQVKNNIIPMSRIDDAVYRILRVKFTMGLFENPYADPSLMGELGKQEHREIAREAVRKSLVLLKNGKSAYTPLLPLPKKAGKILVAGSHADNLG

SEQ ID NO: 208290 - protein, 209 aa, Triticum aestivum
  Clone ID: PAT_TA_102708.pep
PFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKP

SEQ ID NO: 208291 - protein, 85 aa, Triticum aestivum
  Clone ID: PAT_TA_102709.pep
KRKDGQSEGGMDPDNKPYYPFPWWQPSERRTVDVKSLWFQVLCRHLLHKSVLIMSVDVSLAAPHAASSFALQAPLIVTSSFRSPL

SEQ ID NO: 208292 - protein, 152 aa, Triticum aestivum
  Clone ID: PAT_TA_102710.pep
MAHRVDNEYDYLFKIVLIGDSGVGKSNILSRFTRNEFCLESKSTIGVEFATRTLQVEGKTIKAQIWDTAGQERWLSELRNHADSNIVIMMVGNKSDLNHLRSVQEEEGQALAEKEGLSFLETSALEALNVEKAFQTILSDIHQIISKKALAA

SEQ ID NO: 208293 - protein, 194 aa, Triticum aestivum
  Clone ID: PAT_TA_102711.pep
FLHWDLNKSTRSKNANALQVLMKVAFEALNLTEFFYCQVSSAQTPGSSLNLHAPLNGCGFRGCDDKNDGGNTDCIDNNGDISQEDTCGSSDTSTSGIAEDVATNNGSTTIKPPKLQKGVLRTNCIDCLDRTNVAQFAYGLASLGHQLHALGSVESPELDLDSPLAHHLMHFYERMGDTLALQYGGSAAHNKIFS

SEQ ID NO: 208294 - protein, 86 aa, Triticum aestivum
  Clone ID: PAT_TA_102712.pep
ETRKTSKQQLGSFHKLNRLRAYLDGLRLHTPPTPNTEPDQTSQLHKASSAFTPQNCGSRSSSKLQGHATNRKNNRFLSSPVSETEP

SEQ ID NO: 208295 - protein, 187 aa, Triticum aestivum
  Clone ID: PAT_TA_102713.pep
LTALMGVSGAGKTTLMDVLVGRKTSGYIEDNITISGYPKKQETFARVSGYCEQNDIHSPNVTVYESLAFSAFLRLPANVESSTRKMFIDEVMELVELNPLKHALVGLPGVSGLSTEQRKRLTIAVELVANPSIIFMDEPTSGLDARAAAIVMRAIRNTVDTGRTVVCTIHQPSINIFESFDELFLMK

SEQ ID NO: 208296 - protein, 123 aa, Triticum aestivum
  Clone ID: PAT_TA_102714.pep
AENIRRVGEVAKLFADAGLICIASLISPYRSERSACRKLLHNSTFIEVFLNVPLEVCEARDPKGLYKLARAGKIKGFTGIDDPYEAPSDCEIVIQCKAGDCATPKSMADQVVSYLEANEFLQE

SEQ ID NO: 208297 - protein, 133 aa, Triticum aestivum
  Clone ID: PAT_TA_102715.pep
FGELDLEALSRLDGRRWSSCKSQDGIAVPLSGADHAVSDQRSLSQKYRPRSYHEIVGQNFVVQSLSNAIIRERIAPAYLFHGPRGTGKTSAARIFSAALSCTANGENKPCGVCMECNDFFSGNGINLIEVDAS

SEQ ID NO: 208298 - protein, 97 aa, Triticum aestivum
  unsure (1)..(97): unsure at all Xaa locations
  Clone ID: PAT_TA_102716.pep
EVKWGHISMAEAKRRLLAHALLDXANARFILLSESHVPLFDFPTVYSYLINSTKVYMESYDELGGTGQGRYKRGMAPTIIPWQWHKGSHWFEMDRAL

SEQ ID NO: 208299 - protein, 191 aa, Triticum aestivum
  unsure (1)..(191): unsure at all Xaa locations
  Clone ID: PAT_TA_102717.pep
LAVQADVETQXDFVRTLVAEVRDATFASIEDVVAFVTWLDEELSFLVDEQAVLKHFDWPEKRADALRDAAARYQGLLQLEKQISSFVDDRALHRDAALGKMYSLFEKTEKSVHKFLQDRDAADTKNNLISRYKEQDIPVGWMADAGLIVKVKLACVNLAKQYMTRVVSEIDGLRGINKDHTRETAFFKRLK

SEQ ID NO: 208300 - protein, 136 aa, Triticum aestivum
  Clone ID: PAT_TA_102718.pep
VAVVASEGARGGVLLASLAELCEALSFCTEDAGGYFPVESAASCGWPAPRSPAPTRCCSPCAPSPAGGWILVMKVVPGFLLYRGLHELGQYAFSGNSMGASRKEGIPTVSCGILSQNLLLPSEGVLLDHVGCKVSR

SEQ ID NO: 208301 - protein, 203 aa, Triticum aestivum
  Clone ID: PAT_TA_102719.pep
LLLCDCRLRHFPLGLASNASSLKILFLKHVKQLSYIESFPSVVELTVNGCPDLERITDLPNLQKLTIDNCPKLKVLECIASLERLVLEDYIMENLPEYMRDIKARHLQLFCRLWLLSAVAMGQSVTEWDKFSQVEHVKAYAGDGDNQRKWYVLYTRGDNCKLDSNISSSTKFEETLSSSMVDAQGFDSLYKMRRSTFSYICSL

SEQ ID NO: 208302 - protein, 74 aa, Triticum aestivum
  Clone ID: PAT_TA_102720.pep
SCNCGSGCSCGSDCKCGKMYPDLTEQGSAAAQVAAVVVLGVAPENKAGQFEVAAGQSGEGCSCGDNCKCNPCNC

SEQ ID NO: 208303 - protein, 119 aa, Triticum aestivum
  Clone ID: PAT_TA_102721.pep
ISAGQHQISVTRTSPGRGLHASLHVLLFHMATLFRECCLWQKFSEQCLPESQDSCYPEEQYLRTPLDVADPAGCTWYTLTRIDYTDSVDGDPQTYGVPEVSLLLTAELHQSNNSTYEHM

SEQ ID NO: 208304 - protein, 100 aa, Triticum aestivum
  unsure (1)..(100): unsure at all Xaa locations
  Clone ID: PAT_TA_102722.pep
ISDFRVHVLDNIDGVDAETISXISLQSGLNNYLQNGFSDVGLFMPSPVPIKPAAKMTLRIQEKKNTGDPAESVQIQIIFVASPGFIWRRAGRECCCNLPL

SEQ ID NO: 208305 - protein, 176 aa, Triticum aestivum
  Clone ID: PAT_TA_102723.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLIKANDTIKLDLETNKIVDFIKFD

SEQ ID NO: 208306 - protein, 99 aa, Triticum aestivum
  unsure (1)..(99): unsure at all Xaa locations
  Clone ID: PAT_TA_102724.pep
TCFTMIGRADIEGSKSNVAMNAWLPQASYPCGNFSDTSSFKLRRSKGSXATLSRFVFVLEIRIKRAFTLLFHTRFLFSLSSXLGHLRYLLTDVPPQPNS

SEQ ID NO: 208307 - protein, 80 aa, Triticum aestivum
  Clone ID: PAT_TA_102725.pep
PSLRSLVVSARDRSFKFQSRFIPLPIRDLLSVTFFSRGRDEHDVEDDEGEEDGDSVQLTVPSQSLFVDLCVCLGNYAAFT

SEQ ID NO: 208308 - protein, 83 aa, Triticum aestivum
  unsure (1)..(83): unsure at all Xaa locations
  Clone ID: PAT_TA_102726.pep
YHLPNQKYQHLSLEGLGFRCEPIAEERLINCMQSFATQTLCMWRKTINCNQHQNTSTVVGRIAQSAKIKXASGYNKMLSRSHT

SEQ ID NO: 208309 - protein, 201 aa, Triticum aestivum
  Clone ID: PAT_TA_102727.pep
FSTSPPSVAAPDFLPLAPIKIGINGFGRIGRLVARVALQSPDVELVAVNDPFITTDYMTYMFKYDTVHGQWKHHEVKVKDSKTLLFGQKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTAT

SEQ ID NO: 208310 - protein, 101 aa, Triticum aestivum
  Clone ID: PAT_TA_102728.pep
KKVLTPFLCWHSAERADCHLLLPISEQNASVIVVYVYYAYTLIIFELPGFHYLSMWILLSGIISFLHTNNYIGHVFSIGVEEGSHEGFPNDDTWIHGRTRT

SEQ ID NO: 208311 - protein, 82 aa, Triticum aestivum
  Clone ID: PAT_TA_102729.pep
LCNFQHTLAKGIRHREVPLILAYMVSINRMENCGSNITTKTVYVLLSCEYGKIACPNPAVGPDEFDPLRSNLDNNQAEYLSL

SEQ ID NO: 208312 - protein, 218 aa, Triticum aestivum
  Clone ID: PAT_TA_102730.pep
VSQAGGKSGVQKTPHEYGNAMQQTVEQTVQKSERAICLDSIHENHDTDVYSEDNLLGEERTTNNNNTHVEEVNNKECNQQSHSTSQSTIKLKLVRSRGIPDAKGSPDKSKTTAVGSDVNSECDKVPMEHDEDPTTNQHISSDFPSASRDFQECTDKSTGFHDSRKFHSESGKTIAVYQRSKLSKHKKKLDSDSGNGDSTSVSNDDGGYQPSEYSPVAP

SEQ ID NO: 208313 - protein, 217 aa, Triticum aestivum
  Clone ID: PAT_TA_102731.pep
ARAGSARELADAYCNIRRDLLDEYLSVLGVERLSIDEVQRVEWKQLNDKMKKWVQGVKTVVRVLLAGERRLCDQVLAVSDELREECFVESTKGCIMQILNFGDAVAVCPRSPEKLSRILDMYEALAEVVPEMKDLCLGSSGDGVISDVQAILDRLGEAVRGTLFEFGKVLQQESSRRAMTAGEIHPMTRYVMNYLRLLVVYSETLDGLLDDDGDESN

SEQ ID NO: 208314 - protein, 216 aa, Triticum aestivum
  Clone ID: PAT_TA_102732.pep
NLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKIDRRSGKELEALPKFLKNGDAGIVKMIPTKPMVVETFATYPPLGRFAVRDMRQTVA

SEQ ID NO: 208315 - protein, 184 aa, Triticum aestivum
  Clone ID: PAT_TA_102733.pep
EYINKGSLDKYLADELRGLKWHTRYQIIKGICSGLEYLHKEKGIIHRDLKPANILLDDLMVPKITDFGISKLLDGVTHIVTSNSAISLGYCAPEFIKHGQVSIKSDIFSLGVIITELVTGCKGTLDIQNVKIMKMYLTKKDYEDVDECDYLYKKNVNKCVYLKKSVVHITCNRWLNSTALFFSK

SEQ ID NO: 208316 - protein, 163 aa, Triticum aestivum
  Clone ID: PAT_TA_102734.pep
PQKPWIWRRDNPRIDNKKGNADDIQVEPQNQVNESSVGLPLLIMKDMEDLGRKWKGSLENFVSENMKLHDQVQELKRDKKEAEERAKKAEKEMGNAMADNMKLNGQLQESERNKKEAEDRILQLDFFSGSVAAVNMDLHNKIEVLENEHKKAEDRAKEAESEM

SEQ ID NO: 208317 - protein, 193 aa, Triticum aestivum
  Clone ID: PAT_TA_102735.pep
NLCVAADVTTAKELLELANKVGPEICMLKTHVDILSDFTPDFGAKLRSIAEEHNFLILEDRKFADMGNTVTMQYEGGIFRISDWADIVTAHVVPGPGIIDGLKLKGLPKGKGLLLVAEMSAPSNLAHGDYTTAAVKFAEQHSDFVIGFLSVNPASWPAPAPSPAFVHVVDTGVDVVAGGDSPGQQYETPHLVV

SEQ ID NO: 208318 - protein, 91 aa, Triticum aestivum
  Clone ID: PAT_TA_102736.pep
WRHHQVYFCQVDDIFCLYIVLDRIYSFHDYVTILFGIHVSFAILDQIYILVFPGMLFLYMQTQIFVHISLSFSHHPTHPRLCHNLKIVLNF

SEQ ID NO: 208319 - protein, 182 aa, Triticum aestivum
  Clone ID: PAT_TA_102737.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALRQISERLGVQVSDVKN

SEQ ID NO: 208320 - protein, 145 aa, Triticum aestivum
  unsure (1)..(145): unsure at all Xaa locations
  Clone ID: PAT_TA_102738.pep
QFRHIILDNNENKPVTNSMDXTQEVKFLQRADMLNIFKNFSCKTWILDDFDFYDNRHKVVQDTRGKPLTTSLDHLTPKDEKPSXSEKQAQSACNVKHHNAKRNHEQSNDVTTDVDTAKTSHKQINVDPADVDTAKTGHKHSNVDA

SEQ ID NO: 208321 - protein, 54 aa, Triticum aestivum
  unsure (1)..(54): unsure at all Xaa locations
  Clone ID: PAT_TA_102739.pep
AENSEQGHMLSGACRKLQFNAXSVPDLNAPMPMDMDSSPEKSYDLNNRLLRSND

SEQ ID NO: 208322 - protein, 191 aa, Triticum aestivum
  unsure (1)..(191): unsure at all Xaa locations
  Clone ID: PAT_TA_102740.pep
CCLHSCNGXGAGKTTLAAKVYTASQVKQHFEQLVWVIVSQKFKVIDLLKEILKQISSDEGQSRKFDDMNEYEVGKKIHDILIQKXYLVVLDDVWETDTWEQINRTIKAFPDAANFSRVLLTTRKEDVANHVDMPTHPHALKGLDEEQSWELFSSRALPSYRISIIRDLDKYKEMGRKLXRKCDGLPLALAV

SEQ ID NO: 208323 - protein, 165 aa, Triticum aestivum
  Clone ID: PAT_TA_102741.pep
MVAFLLLSAASHGGRRGPSFNSNNRTFVFNYTLAKTIVEYASAVYMTDLTALYTWTCSRCNDLTKGFEIRCIIVDIQNCLQAFIGVDHNLNAVIVAIRGTQENSVQNWIKDLVWKQVDLNYPNMPDAKVFGTNLRYILCLYRSSCYLFSDEVYVLVKGPHWILLC

SEQ ID NO: 208324 - protein, 153 aa, Triticum aestivum; identical to SEQ ID NO: 135118
  Clone ID: PAT_TA_102742.pep

SEQ ID NO: 208325 - protein, 77 aa, Triticum aestivum
  Clone ID: PAT_TA_102743.pep
VTADRYHKYNEDIKLISETGLEAYKCSISWSMLIPNGRGAVNPKRLQFYNNIIDELVKHGIQIHITLHHLDLPQILE

SEQ ID NO: 208326 - protein, 86 aa, Triticum aestivum
  Clone ID: PAT_TA_102744.pep
RWSTSYVACGTGREGSQHTLFMLRLGGVFELLHCFAAVTIFPSSTPINFVASYGSEEYILPPFLNISFCRDFTMDYIRNKMSESTL

SEQ ID NO: 208327 - protein, 171 aa, Triticum aestivum
  unsure (1)..(171): unsure at all Xaa locations
  Clone ID: PAT_TA_102745.pep
MEGKEEDVRLGANRYSEHQPIGTAAQGGGADEKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTXAVFYIIYNKKQAWDDHWIFWVGPFIGAALAAIYH

SEQ ID NO: 208328 - protein, 168 aa, Triticum aestivum
  Clone ID: PAT_TA_102746.pep
DTPLPDSSEQIYIAPVALLKMLKHARAGVPMEVMGLMLGEFVDEYTVTVVDVFAMPQSGTGVSVESVDHAFQTNMMDMLRQTGRPEMVVGWYHSHPGFGCWLSGTDVQTQLSFEQLNPRAVAVVLDPIQSVRGKVVMDAFRLINPAAMLTGHEPRQTTSNVGGTVRPS

SEQ ID NO: 208329 - protein, 89 aa, Triticum aestivum; identical to SEQ ID NO: 130083
  Clone ID: PAT_TA_102747.pep

SEQ ID NO: 208330 - protein, 126 aa, Triticum aestivum
  Clone ID: PAT_TA_102748.pep
LFSRGKIGVSPIGSSPSWTRAFVCMLLTSRPRSSRSRLPSAHRLPRFLQSNDAGNTTRPIKARSAMPAEGSSRSVLAVRRTGRPGPRSNYELFNCNNLNIRYWSWNYRGCLLVGLGFLSSGTVGVG

SEQ ID NO: 208331 - protein, 181 aa, Triticum aestivum
  unsure (1)..(181): unsure at all Xaa locations
  Clone ID: PAT_TA_102749.pep
THDGDSAQLDSSVPSLAEAAKPGFRKAEKCSKNALRSVSELHIGDEKQAGSSKFDMDKVMKGFGARGASGASSGTNIQAGDVPLKSSEACPSKSQYXGKRAPLDLTLKTTLQFVSSSSVKWCHNLSTSCRGSVAGGRSQSSGHMRQESNKEFLFSKALQSWVYPQSMLPAPIVSAMLSSTA

SEQ ID NO: 208332 - protein, 66 aa, Triticum aestivum
  Clone ID: PAT_TA_102750.pep
ICSSFCAQQYFSHCSILAAFIGMHILNQLVCTFLFCYHIYYRCSCHKSDVIRLNNSIIIAMNLFNT

SEQ ID NO: 208333 - protein, 69 aa, Triticum aestivum
  Clone ID: PAT_TA_102751.pep
VFFFFFFFFFKATWNIIGAQNIFTCIHSGSTYLYVQGTSKCQTKLFYNKEKKIDDKTSQKFLLSSSFNI

SEQ ID NO: 208334 - protein, 142 aa, Triticum aestivum
  unsure (1)..(142): unsure at all Xaa locations
  Clone ID: PAT_TA_102752.pep
ATPVTEVEMTLGTPQSTMHFYDVSLVDGFNAPVSMTPVGGGRGCGVAACGADLXVCCPSALEVRDREGRVAGCRSACLAMGSDKYCCTGEYGTAAACKPTMFSHLFKAICPRAYSYAFDDASSLNRCKANRYLITFCPPQPE

SEQ ID NO: 208335 - protein, 192 aa, Triticum aestivum
  unsure (1)..(192): unsure at all Xaa locations
  Clone ID: PAT_TA_102753.pep
RTLYPTSHLYFHEHWKIHLILQRETKHKDIVIKSMVEAMQXKFMKYWKLSFLTICLPVILDPRYKFKFLEFCLKSGLESDATRYLAKVKRTFKDLFVEYSMHEGESNMGNDQGTNNVGTSIDNPWDQWNKQVKQNQENRAKLSELDIYLKDDVCPQEDGFDILCWXSNNAHKYPIVSRIAKDVLAAPASSVA

SEQ ID NO: 208336 - protein, 133 aa, Triticum aestivum
  Clone ID: PAT_TA_102754.pep
CTRTSSCRHAGNLGRTTLLRAFLALASSDSPDASIAVRSSSIPVGCYARWLFTSAASTAPDAANPAKPSEPVRTRCSAPCPPRADGLRRTSTLSAEASIPADDFGKEKLDGLPLPSNVATNARKPNRRKLRSR

SEQ ID NO: 208337 - protein, 137 aa, Triticum aestivum
  Clone ID: PAT_TA_102755.pep
FQQRKIYGKPESENSRSCRCECPALIRLLRASDNSWYITEHRASHSHSMSLTMGEKVHWPSHKHIDVYTKDLIKQLRENNVNLGKVYNIIGSFFGSLEKVPFTKRTLRNICGKISREQAEDDVRKTLQAFADIQAND

SEQ ID NO: 208338 - protein, 156 aa, Triticum aestivum
  unsure (1)..(156): unsure at all Xaa locations
  Clone ID: PAT_TA_102756.pep
ARSLAADSMSPVHDGLVISKPPGMRFPLRRNMPASVEPAGHLHNANGFDAVSLSGSDGSSGRFTPKTSANMHSTFLQDATNVLSPFANNATSRNPLSSGDWSGSSAPDASTDGSTSNSGETGLRGAEDDVXKLRSEIGTLTRKLDVSDMELQTLRK

SEQ ID NO: 208339 - protein, 34 aa, Triticum aestivum
  Clone ID: PAT_TA_102757.pep
PHYAHYDLVGGRKAVHEVYPCIIEFLSQHDGVSS

SEQ ID NO: 208340 - protein, 125 aa, Triticum aestivum
  unsure (1)..(125): unsure at all Xaa locations
  Clone ID: PAT_TA_102758.pep
MEELERWVTDENSGGVLYIVGFGGVXKTTIATALYRKFGENFSHRATVSVSHSSDVEAVLMNIKSQVMPLQIDSHHQHGSLPENNQLKEELQKHFGEDSYLLLIDHVWSATTWDQITKSLPQRNK

SEQ ID NO: 208341 - protein, 100 aa, Triticum aestivum
  Clone ID: PAT_TA_102759.pep
EAGREGEPHQVPALPPPGHRQAAGVAPAAAPLSSPAQVGDGRCTTHVTITYTYTHRQTRRQEHCKTSAGKGDDQIGLLVGFVILILVGYIVRLHARGMLI

SEQ ID NO: 208342 - protein, 45 aa, Triticum aestivum
  Clone ID: PAT_TA_102760.pep
EQLWASRNYRMFLGSFMYLFVIFFSTPSHNYNHNTHIYHIIKQNN

SEQ ID NO: 208343 - protein, 119 aa, Triticum aestivum
  Clone ID: PAT_TA_102761.pep
AAEFFAMPAEDKLPYCSYDMSKRFRLATSTSYDRGETLYWRDYIKFRCYPASNENARHWPSKPANFTPSLIEYSAAVHELAQTILCLIAEGLGLDGGFFAGDLSGGDTHMSVHYYPPCP

SEQ ID NO: 208344 - protein, 69 aa, Triticum aestivum
  Clone ID: PAT_TA_102762.pep
AHSKAGNINQTTYRYFSILHHQNDHNRQIKGMMRKYSQASNTKHCTCNLVAATSNNSNHNLPVNTPSHF

SEQ ID NO: 208345 - protein, 105 aa, Triticum aestivum
  Clone ID: PAT_TA_102763.pep
IRLHASCCWSYTMNLQSVSNKMDLRGFSIMIYLVQMTIDRCTDGGRSVSLTGPYGVPKEMCSIVDVGSNLIDFVLLCFLVEANVSGGDRACRDYGEGKGEAWGFE

SEQ ID NO: 208346 - protein, 107 aa, Triticum aestivum
  Clone ID: PAT_TA_102764.pep
DQTPCHACLTGRVGLSAAGPRRAEKARAGAKWGEGTPRRRCAAMAAPLASRLHAIVGPLPWSRPGSSGPGSGSLASEDEEENSGDGGARTGSRVTVSARWIEARAHL

SEQ ID NO: 208347 - protein, 33 aa, Triticum aestivum
  Clone ID: PAT_TA_102765.pep
MAAKLTRLHSLRERLGATFSSHPNELIALFSRY

SEQ ID NO: 208348 - protein, 45 aa, Triticum aestivum
  Clone ID: PAT_TA_102766.pep
RSYCNVAFLDTHNTTIVSMLPRYKYNFLIFKHQLHYIHTKRMWQE

SEQ ID NO: 208349 - protein, 107 aa, Triticum aestivum
  Clone ID: PAT_TA_102767.pep
VPQRHSGPVIKFQSHVIWTKLNGFWTRCAGRQSPNTGIKDTPYLLVRPGAKTPSQSTIEDNKGEHEHRKVYIGSGRHRGVKSYVLLVFHISLEVQVLVCTKEVVRVR

SEQ ID NO: 208350 - protein, 122 aa, Triticum aestivum
  unsure (1)..(122): unsure at all Xaa locations
  Clone ID: PAT_TA_102768.pep
GDEHVGAAHAQCYRTMINDVLPRILDDTIQLEIGMKINQIFPNIPDQQPRPLRRLNCVAQKQDRENLFVRMENWNNITKATREARHSIFSMMVNAVLNQIGASSSDAGISSQNRSEGDDVKX

SEQ ID NO: 208351 - protein, 60 aa, Triticum aestivum
  Clone ID: PAT_TA_102769.pep
MGCVASKKAVVSITPAVDSSGVFRDRALEPAAVSASSLRSSAAAAAAARLVEKKDDAEET

SEQ ID NO: 208352 - protein, 74 aa, Triticum aestivum
  Clone ID: PAT_TA_102770.pep
EVDKELSPDATLWLSFCCRSSNSVLRTAQTILKIGGIDGDAARTDGSCDDGKEASRPATCHDVPSNKSALPRAL

SEQ ID NO: 208353 - protein, 72 aa, Triticum aestivum
  unsure (1)..(72): unsure at all Xaa locations
  Clone ID: PAT_TA_102771.pep
GIRHEPTPTPPHGEEEEEGLARYISVKAYFLXHQHGSDVVNPSTWSLNYITLCYSEFAPEIIESCFWDGNRR

SEQ ID NO: 208354 - protein, 39 aa, Triticum aestivum
  Clone ID: PAT_TA_102772.pep
KRRICSFLILSTVMLLFSLYYSCISMQYYIIACVWQRGT

SEQ ID NO: 208355 - protein, 61 aa, Triticum aestivum
  Clone ID: PAT_TA_102773.pep
NARKGSSKEHDKSTTMKCYGDAIDAQQDHLEVAYEILCSRCLCAEMDPRKREANKFSLHLS

SEQ ID NO: 208356 - protein, 62 aa, Triticum aestivum
  Clone ID: PAT_TA_102774.pep
LCSCLHVIVASFYHEISKDLLHSYCVSILRLSCSLFLRQTAFIRKQREHIIYLYYQVAILTT

SEQ ID NO: 208357 - protein, 120 aa, Triticum aestivum
  Clone ID: PAT_TA_102775.pep
MASEQTFIMIKPDGVQRGLIGEVISRFEKKGFYLKGLKLQNVEKSFAEQHYADLSSKPFFAGLVEYIFSGPVVAMVWEGKSVVSTGRKIIGATNPLASEPGTIRGDFAVDIGRNVIHGSD

SEQ ID NO: 208358 - protein, 94 aa, Triticum aestivum
  Clone ID: PAT_TA_102776.pep
AILGCCCFWRKKRQAKTAPSSHSDVLPLRHRKHPSASPARNQRLEENRMGSEKDLDLPFFDLEAILTATDDFDPVFKIGQGGFGSVYMGKLEDG

SEQ ID NO: 208359 - protein, 118 aa, Triticum aestivum
  Clone ID: PAT_TA_102777.pep
SPNLVRLMGCCLETEVPMLVYEFIPRGSLQDVLHGNNHPLPLETRLDIAISSAEGLDYMHSQSQMVLHGDVKSGNILIDDSFTPKVSDFGTSRLMCIDKDHTNWVVGDSSYLDPVYMK

SEQ ID NO: 208360 - protein, 68 aa, Triticum aestivum
  Clone ID: PAT_TA_102778.pep
LLPGVAIGVILPRARILLPSSTAPSASIGAELLAGRTTAGAGAGGGIGGLLLGLVHGLGARLGLEARA

SEQ ID NO: 208361 - protein, 130 aa, Triticum aestivum
  Clone ID: PAT_TA_102779.pep
ARTGRRRQREDLEATPPARGHGGEAPSLVGRCGRSLTAPPTPARGPDDADPRWRPRLRLAVVVYQRSKVSLPLPPYLPSVPPSLLLVLPAADQLLVAAPSHIYIQLGLSSEHTSFRYSSTEIGGGQTLTS

SEQ ID NO: 208362 - protein, 107 aa, Triticum aestivum
  Clone ID: PAT_TA_102780.pep
VFPSSGSHVLMYLRHRRRRRSHVLMYLLRHHRSHVLMYFRRRCCRRRRHHNPVSMSSFLSTESLLIFPLMTAPFLGILVCCSSAAATSGVVAQREPLCTTNASATLP

SEQ ID NO: 208363 - protein, 107 aa, Triticum aestivum
  Clone ID: PAT_TA_102781.pep
RDLRSKSDLLLRCNPVHRAVPVLIHDGRPVCESQVILQYIDEAFGPPALLPADPHERAVARFWAAYFDGELGAPWDRALRAGTEEERAAWMQTVVAAADGLDRGLGE

SEQ ID NO: 208364 - protein, 131 aa, Triticum aestivum
  Clone ID: PAT_TA_102782.pep
SSAKKFCDRRRYVYLLPVLALDPSAHPDREAVKASAGSENQLAKCVECSERGRKVPDIMGREGKLPDSEEEKVLDTPGEETVAVHGELGDAKSVPASSVTEACDSETGLGGDGIAIPSSGNGTKAQNAELG

SEQ ID NO: 208365 - protein, 117 aa, Triticum aestivum
  Clone ID: PAT_TA_102783.pep
SCGDRPILHRDVKSSNILLDEAFKPRIADFGLAKILDANAGGKGKGEPWSSSGGAVAGTVGYMAPEYAYTRKVTEKSDVYSFGVVLMELATGRAAVADGEDVVEWASRRLDGAGSGR

SEQ ID NO: 208366 - protein, 53 aa, Triticum aestivum
  Clone ID: PAT_TA_102784.pep
RRDLPAHSHTCYDLGVDDILPPRYHKLKQMVVEAKAGYVADKNALKLAGSHAF

SEQ ID NO: 208367 - protein, 105 aa, Triticum aestivum
  Clone ID: PAT_TA_102785.pep
PELVASDPVLAFKAALWFWMTPQEPKPSCHDVMLGRYVPTDADRQANRTAGFGLTTNIINGGLECNLPADSRVKDRIGYYRRYCEILKVDDLGDNLDCAQQLPYS

SEQ ID NO: 208368 - protein, 91 aa, Triticum aestivum
  Clone ID: PAT_TA_102786.pep
MSTEKKQLNPMRDIKVQKLVLNISVGESGDRLTRASKVLEQLSGQSPVFSKARYTVRSFGIRRNEKIACYVTIRGEKAMQLLESGLKVKEY

SEQ ID NO: 208369 - protein, 96 aa, Triticum aestivum
  Clone ID: PAT_TA_102787.pep
SGTVEGLLGSLESDSPRVVEAALGALCTLVDDRVDVERSVAVLAELDAPRRVLGALRQHRENVLWQKCFCMVDKFLAHGDDRCVREVTGDRVLPAA

SEQ ID NO: 208370 - protein, 53 aa, Triticum aestivum
  unsure (1)..(53): unsure at all Xaa locations
  Clone ID: PAT_TA_102788.pep
SNAKLSDFGLARNGPTGGDSHITTRVMGTYGYAAPEYIATGHLYVXKSDVYGF

SEQ ID NO: 208371 - protein, 105 aa, Triticum aestivum
  Clone ID: PAT_TA_102789.pep
RSRPRRGSPAKPASSEQPSQPPTGGHEGHRDVDRRGGGCRRDDALHGLGGRPGRGQRGRPRRGRRRELPPRRRPPRLRLRQPRQRPLHLVMYDASGVRFHTGRQA

SEQ ID NO: 208372 - protein, 97 aa, Triticum aestivum
  Clone ID: PAT_TA_102790.pep
SREECTAAYAAGVRAQYAGRWLCGLCGDAVGEELAAAGAGGGGSATAEVEAAIARHAAFCRSSPAAAERLIAAVRRLLRSQSGRKPKAVVVLEFQEA

SEQ ID NO: 208373 - protein, 95 aa, Triticum aestivum
  Clone ID: PAT_TA_102791.pep
MAAAAAGVAGESSGTKTKKLKIAVIHPDLGIGGAERLIVDAACQLAAHGHDVHVFTSHHDRNRCFEETVSGTFPVTVYGDFLPRHVSYRFHAVCA

SEQ ID NO: 208374 - protein, 70 aa, Triticum aestivum
  Clone ID: PAT_TA_102792.pep
MSRDPVDLSPGQLHKLAELIHRQEVQKLQELKFESYAFQQKYLKDAKDARDKVYHVLESAQDMIAQTKDP

SEQ ID NO: 208375 - protein, 112 aa, Triticum aestivum
  Clone ID: PAT_TA_102793.pep
RLQLEAATWAVPWILVQRKQDGGRSGRSSRRSEGKEGGGEGSAHRRARSAATNSEPHVLVTEGWNRSMGRPIGARRRRFGTAAKLQLGRRHGFLCRENEMRGRLGRSRKKAA

SEQ ID NO: 208376 - protein, 60 aa, Triticum aestivum
  Clone ID: PAT_TA_102794.pep
SEEDRGGGMDDASLEHTPTWVVAAVCFVIVSVSLAAERFLHYLGKALKHKQQKTLYSSLQ

SEQ ID NO: 208377 - protein, 98 aa, Triticum aestivum
  Clone ID: PAT_TA_102795.pep
RRPFCFILFPKWRGSKERRRRVSSVARPIGSSPWITSRRSSAACEGGRLHGGSHGVQQTQEGGTIRAWITSMGSSNGMRGRRHHLSVICWEIFGTKCG

SEQ ID NO: 208378 - protein, 118 aa, Triticum aestivum
  Clone ID: PAT_TA_102796.pep
GGLNRPWRLCTVTQVEELKTLLRLIPIWLTSAVYFVANTQAQTTFVQQGTKTDSHIAGGAASVPAASLTSIETVLVAAYVTLYNRAVVPSVAFTPLQLMGLGHATAAGAVAVAACTEA

SEQ ID NO: 208379 - protein, 35 aa, Triticum aestivum
  Clone ID: PAT_TA_102797.pep
RSRSYVCHNPTVQPPVVGVCSMPGTDPDSCTPFRV

SEQ ID NO: 208380 - protein, 60 aa, Triticum aestivum
  Clone ID: PAT_TA_102798.pep
RQRKRGDYRRQHARFQVNRQAEPRRLVDPAAKIRLVLTKSSFLLGRSRENIDSVNFIQTI

SEQ ID NO: 208381 - protein, 90 aa, Triticum aestivum
  Clone ID: PAT_TA_102799.pep
EKYSSCRIYFSDHFDIHMSYIKVYFISLFIVFLSCLIQKKKRNPSQHASQARRPRRQPAWPANRTAACLAPLPLGLDLPTAPSSLPLTDS

SEQ ID NO: 208382 - protein, 129 aa, Triticum aestivum
  Clone ID: PAT_TA_102800.pep
IKAFIIDIFTAGSDTTATTVEWMLADLLNHPDCLQKLRAELDAVVGRSRVVGEPDVAQMPYLQAVLKETLRLRPPAVFAQREAIEPIHVRGYTIPVKTSVFFNIFSIGRDAAYWEEPLEFRPERFMPGG

SEQ ID NO: 208383 - protein, 76 aa, Triticum aestivum
  Clone ID: PAT_TA_102801.pep
LIGNLSSVRVALTKMQGLTASCKIVLVMFLLGLGLAGATADSRRRHISSSPDEPCKKMTLYLHDILYNGVNNTANA

SEQ ID NO: 208384 - protein, 87 aa, Triticum aestivum
  Clone ID: PAT_TA_102802.pep
MWRLKVSEGGGPWLRSVNNFLGRAVWEFDPDHGTPEERAEVDRVRREFTQRRFQKRDLQDLLMRMQYANQKHLQADLPVVKLVDSGE

SEQ ID NO: 208385 - protein, 88 aa, Triticum aestivum
  Clone ID: PAT_TA_102803.pep
SKASHDKTIQGTFVVPNQIAPRIPPIPRDEPDHKGPSPHAPNLRPKKEKRPQNRANGRNPRRTRTDLRSGGGTTGEVTTIYLLVGDLL

SEQ ID NO: 208386 - protein, 68 aa, Triticum aestivum
  Clone ID: PAT_TA_102804.pep
TAAWSTERCSFPGRTASQMMTMMATTTSSANSVAAMHCAGVGRVRRVALSGPAIPAFVPELKTMHCLS

SEQ ID NO: 208387 - protein, 99 aa, Triticum aestivum
  unsure (1)..(99): unsure at all Xaa locations
  Clone ID: PAT_TA_102805.pep
DVLVFDNVEKKXYVIHWVSVDRHASTEEAYKDGRSRLKRLPSLVHNANVPKLSPGFVKLHTRQFGTPLNKSTMTSDEYKGAVMQAIEHILAGNIFQIVL

SEQ ID NO: 208388 - protein, 108 aa, Triticum aestivum
  unsure (1)..(108): unsure at all Xaa locations
  Clone ID: PAT_TA_102806.pep
HEEPKRPSDKPLRLPLQDVYKIGGIGTVPVGRVETGVIKPGMVVTFGPTGLTTEVKSVEMHHESLLEALPGDNVGFNVKNVAVXDLKRGYVAXNSKDDPAKEAANFTA

SEQ ID NO: 208389 - protein, 64 aa, Triticum aestivum
  Clone ID: PAT_TA_102807.pep
LLLVAFVIKHGHDDGSPSMFMLAQNDGPTGCSVSLDLFVINFLHTVLLLLFLATGCFHYKAGPS

SEQ ID NO: 208390 - protein, 105 aa, Triticum aestivum
  Clone ID: PAT_TA_102808.pep
RIIQVMLKPPSDMPMYGNIEKSPLDFSEVDTRLPMLVYMSREKRPGYDHNKKAGAMNALVRASAIMSNGPFILNLDCDHYVYNSKALREGMCFMMDRGGDRLCYV

SEQ ID NO: 208391 - protein, 36 aa, Triticum aestivum
  Clone ID: PAT_TA_102809.pep
NANSSYWRSEDDVGMAAGLGGETESHPYVSFTINLV

SEQ ID NO: 208392 - protein, 97 aa, Triticum aestivum
  Clone ID: PAT_TA_102810.pep
MANASSGAGIHDDCKLRFVELKSKRMHRFITYRLENQKEVIVDQTGEREATYEDFTKTLPENDCRFAVFDFDFTTPEDVPKSRIFYIFWSPDTAKVR

SEQ ID NO: 208393 - protein, 64 aa, Triticum aestivum
  Clone ID: PAT_TA_102811.pep
RSFLERRAAASMKDMDPLVEGWMKQVRDLTYDLEDCIDDFVCSDAPGNTNSVAQLIKVVTWRRQ

SEQ ID NO: 208394 - protein, 60 aa, Triticum aestivum
  Clone ID: PAT_TA_102812.pep
MMWGIAAAVASAAAVAVASGAELLACDRAPTPPTAAAVVVGRCDGFLFRQRESSSSSGRD

SEQ ID NO: 208395 - protein, 95 aa, Triticum aestivum
  Clone ID: PAT_TA_102813.pep
VTAPLIVALAALMVRGAAAMGMVIAPVGVAADAAAVVAMTPAGAETTAAAGIHSSSSRRPGPGTSPCSAWPCHRRGRAGFPRTLQGSSVRDQASL

SEQ ID NO: 208396 - protein, 103 aa, Triticum aestivum
  Clone ID: PAT_TA_102814.pep
RGPYRIGACRPSPLLPSQHRAAAALTGVTARSSSLPDHDPLAFYCLSGLVDPLPPVPGPPCRRSPSSPKLRPDQHLLLLLLPAALLRRRASTARSGSPVAGAS

SEQ ID NO: 208397 - protein, 104 aa, Triticum aestivum
  Clone ID: PAT_TA_102815.pep
ATSSPLAARDGTFLLGGPSWAVPLGRRDSTTASLAEANADLPGPTLNLDQLIRAFDKKQLTPRDLTALSGAHTIGFSQCQFFRDHIYNGTNIDPAFAALRRQTC

SEQ ID NO: 208398 - protein, 105 aa, Triticum aestivum
  Clone ID: PAT_TA_102816.pep
HVLYSESLEALPGSLLPAASQMTCPSNSWRPTVNVACRLIRHPRGSRGTPGAPVRVEANGRLAPIGAEAGDDGPSIRFGERGWVYFWKRIRTQETAGGSENEGVS

SEQ ID NO: 208399 - protein, 121 aa, Triticum aestivum
  Clone ID: PAT_TA_102817.pep
GAYYLLRCHTPRWFSDLTETEIGLDVIRMVDPSTSRTLRIYPLFTLTKWEVLDSTVIVICAKFLVYIEAKLTRMKSNSYTSNALLDTVTVAIVQNDIICASTSLIAGSIEEGMSGQSATLP

SEQ ID NO: 208400 - protein, 130 aa, Triticum aestivum
  Clone ID: PAT_TA_102818.pep
RSSLTPYTYIRMESGGVIAEAGWDSLGLTSQAEESEMMEQLLGTFPSNGEEEHQELPWSVQATHAYYAHCNGSSNAYSSASSNSVGSLVLDVPSDYGGFYLGDSNGIGSCTAALDLNMVQEQGAAQFMDA

SEQ ID NO: 208401 - protein, 47 aa, Triticum aestivum
  Clone ID: PAT_TA_102819.pep
YIHSYMYIILLQHLFCFVLQRAEAKETTRHSSTTLLTNNADIKKIPT

SEQ ID NO: 208402 - protein, 71 aa, Triticum aestivum
  Clone ID: PAT_TA_102820.pep
SNPSKPRVTVVDKSDIHVVANYFLKHSRVQLSRMYMQQTQIISVLFPYKASHPQPMQKLQEEKRSNQNDVQ

SEQ ID NO: 208403 - protein, 66 aa, Triticum aestivum
  Clone ID: PAT_TA_102821.pep
PAAARALASPSLGPGGGLGALCRGGGWSYAAIWRSDRRDPRLLTIGECHCEDEARKVVENMLNQVH

SEQ ID NO: 208404 - protein, 82 aa, Triticum aestivum
  unsure (1)..(82): unsure at all Xaa locations
  Clone ID: PAT_TA_102822.pep
VHDAVEEAIKEDIGVVAGLLRVMFHDCFPQGCDASLLLXDKFWSELNMPQNNGIRRNAVYLIESIRIKVQDACGPTVSCTDI

SEQ ID NO: 208405 - protein, 111 aa, Triticum aestivum
  Clone ID: PAT_TA_102823.pep
ESNVLEHTLLDESVELTNLPLGLLQHITEDFADARQIGRGGFGIVYKGDLQNGSVAVKRLLNSHTIEEESFYREATFLISVKHKNIVRLLGYCANTESKAMINPEPGETPK

SEQ ID NO: 208406 - protein, 134 aa, Triticum aestivum
  Clone ID: PAT_TA_102824.pep
VLGKKRKGEERRTSRSRSDAIHKRENTLLKEFEQSAKSSVFHDRRIGERDETLPEYDKAILRQQREHMAKLKRASKFNLSDEEDDEDSHTLLGNDDFNEEVPIGDDSDEERNTLSKKRLSLQSSDLPSETDLPG

SEQ ID NO: 208407 - protein, 134 aa, Triticum aestivum
  Clone ID: PAT_TA_102825.pep
SAYWNSLVARLPTLPNSLLLVAASDLLRRLLAVRRRRRRRRRPALPLPIYDDAASSARVSGEMPKAFAILEDIVQHTLSDLHSIQKSLLYWKSKAEGTNSHKMYFMMFERGPRAFLEATCQTLTRLRSNGSPSE

SEQ ID NO: 208408 - protein, 61 aa, Triticum aestivum
  Clone ID: PAT_TA_102826.pep
NLSSFSGKEKVLDFLYGLCKSYEGQHMVASSAAGDTLSSIKDKVYSLAAETACPVDDYKAW

SEQ ID NO: 208409 - protein, 136 aa, Triticum aestivum
  unsure (1)..(136): unsure at all Xaa locations
  Clone ID: PAT_TA_102827.pep
GYCAEGPKRMLVYEFVENGNLEQWLHGDVGPVSPLTWEIRLKIAIGTAKGIAYLHEGLEPKVVHRDIKSSNILLDKKWNPKVSDFGMAKVLGSGSSYVTTRVMGTXGYVAPEYASTGMLNESSDIYSFGVLLMELI

SEQ ID NO: 208410 - protein, 99 aa, Triticum aestivum
  Clone ID: PAT_TA_102828.pep
SLACNCDELSASDGWSIFVDSKDASSKELAKNQSFDAVIMTAPLSNVQRMKFTKGGAPFVLDFLPKVDYLPLSLMVTAFKKEDVKRPLEGFGVLIPFKE

SEQ ID NO: 208411 - protein, 139 aa, Triticum aestivum
  Clone ID: PAT_TA_102829.pep
LLITGPVGCGKSAAVFACAREHGFNVIEVNTSDMRNGAYVKQKFEEATKSHGLEKWSQEEVTTPPRIDSLDPALETPDRTEYKHSVSCSTRKASNDDEHMLPVFCYSSSKLSDEAPKQVINKTLILFEDVDTVFDEDRG

SEQ ID NO: 208412 - protein, 142 aa, Triticum aestivum
  unsure (1)..(142): unsure at all Xaa locations
  Clone ID: PAT_TA_102830.pep
GRAGAPSATKQKVEAAKQCIENHYKAQMRSLQERKERRWMLEKKLADADVSEEEQNNILKDLEKKETEYMRLRRHKMGVDDFELLTIIGRGAFGEVRLCREKATSNVYAMNXLKKSEMLRRGQVEHVRAERNLLAEVDSAYI

SEQ ID NO: 208413 - protein, 145 aa, Triticum aestivum
  Clone ID: PAT_TA_102831.pep
KKDYLKKRQEANQFDSNGNTVVNGQHASKKTKLLHQAPDISLEALTPVGPLASPAASQMSNMVNPTKIIKIITNRDRGRKSKALKMTTGHSGPGSPWSIFEDQALVVLVHDMGQNWELVSDALNSIVQLKCIYRRPDECKDRHKL

SEQ ID NO: 208414 - protein, 90 aa, Triticum aestivum
  Clone ID: PAT_TA_102832.pep
LRFCPLYQGTPVLFNLVLRWMSDGVPSNTVHWIERNVRSIFISGYCKRSLFERWLNGVEPNYAGHIRIGVCALLWAIWNCRNEIIFKVKL

SEQ ID NO: 208415 - protein, 105 aa, Triticum aestivum
  Clone ID: PAT_TA_102833.pep
AIPPLSFSSAADWLSDTGGAQGTSPRRLFLGHRRRSGYFSSPAGSWGTGGAQGTSPRRLVLGAQAALRTREHPSTSGIQPQISQFSLLISTIWLLIYKHGLLPYV

SEQ ID NO: 208416 - protein, 63 aa, Triticum aestivum
  unsure (1)..(63): unsure at all Xaa locations
  Clone ID: PAT_TA_102834.pep
RGKALRFLDGALPDAKYDEIXPYDDECAICRGPMARAKKLPCNHLFHLPCLRSWLDQGLMEGY

SEQ ID NO: 208417 - protein, 122 aa, Triticum aestivum
  Clone ID: PAT_TA_102835.pep
LLSGCGGQEAAIRRASTNCGPMISHYQLLYELALSLSQREPKDLHTLPRSSRLRDKKKKDEGDTMVKEKFVGSVIENNNLLSILLDKSSCIIVPETPFPPTSFPTMMEPELTVKQSLTGGHC

SEQ ID NO: 208418 - protein, 127 aa, Triticum aestivum
  Clone ID: PAT_TA_102836.pep
RERISERMRYLQELVPGCDKVTGKAGMLDEIINYVQSLQKQVEFLSMKIAASNPVVNFNIVDDLFGGRRMNQACGPAAALPAMTLPMHQGQLDPSCLQMSSATMQHMQQPAAGFGLDMLVSNSYPAA

SEQ ID NO: 208419 - protein, 193 aa, Triticum aestivum
  unsure (1)..(193): unsure at all Xaa locations
  Clone ID: PAT_TA_102837.pep
DDKSHTNGTVPHTQQIGDMKITVTKDKADASSKSDVKLDGSQAPGVSFDELAKRNLLKGITADESATVHDTATLGVVVVKHCGYTAVVQVPLDAQLTTVVPAQQDIHIEDQPEGGSNALNVNSLRMLLQKSCVQSPGAVKRLPXDPEENEAPXNFVRKIITDSMQNLEXEASRETRPIRWELGACWVQHYRIN

SEQ ID NO: 208420 - protein, 221 aa, Triticum aestivum
  unsure (1)..(221): unsure at all Xaa locations
  Clone ID: PAT_TA_102838.pep
PTNGTNKSPSRSRLRSTPAPPPPVLPHRPKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAXKIQDKEGIPPDQQRXIFXGKQLEDXRTLAATTSXRSPPSPCLRXGRMQXFVRPYWQTLEGSLGTTTGENQDRRPPDRLILEEFGRR

SEQ ID NO: 208421 - protein, 136 aa, Triticum aestivum
  unsure (1)..(136): unsure at all Xaa locations
  Clone ID: PAT_TA_102839.pep
XYXXLXNLXXXXXXRIQCIGIXXYIVTKGXKKIPSKEXSRASSRHPCSVLLTVSTKLISLFPHLPGSEIQIVRSPPEEQRIACSSLGLPSSRRSTNLRHAPVLLPLMAKQRTAAAVGGRSPLPPLPVAPPQPEGRW

SEQ ID NO: 208422 - protein, 157 aa, Triticum aestivum
  unsure (1)..(157): unsure at all Xaa locations
  Clone ID: PAT_TA_102840.pep
SPEVIVAAGLPCCRLVQHPGEFVVTFPRAYHVGFSHGFNCGEAANFATPQWLKFAKEAAVRRAVMNYLPMLSHQQLLYLLAXSFISRTPRELLYGIRTSRLRDRRKEERELLVKRXVLQDMXSENELLCAFLKKKIIENAVYSLPGIYLHCSSGQTL

SEQ ID NO: 208423 - protein, 146 aa, Triticum aestivum
  unsure (1)..(146): unsure at all Xaa locations
  Clone ID: PAT_TA_102841.pep
SPPAEAGGSRRGVRKRDPRLVCPNYLAGIVPCACPELDEMAAAAEVEESKLVVLVVASGVAGRGGAAEMRCQVPGCEADIRELKGYHKRHRVCLXRCAHSFAVMITAXRSALQQCGKXHILLXFDEXKRSCXXNWRGIQKRRRKPD

SEQ ID NO: 208424 - protein, 187 aa, Triticum aestivum
  unsure (1)..(187): unsure at all Xaa locations
  Clone ID: PAT_TA_102842.pep
MRSGRVPGRGGGGGGGGETAALLCGLLLLLGAADAQGIRRPSSYKTLRGDAPLVIAKGGFSGVFPDSSYGAFSFALVASAPDTSLWCDVQLTKDXVGICLRDINMSNCTNAAQVYPAKNKKEAKYVIDGRAKNWILLXGLTLLRLNDFFLTQGIYSRTERVEPILSFRDFVRFRWVNVTGIFITTLT

SEQ ID NO: 208425 - protein, 92 aa, Triticum aestivum
  unsure (1)..(92): unsure at all Xaa locations
  Clone ID: PAT_TA_102843.pep
HXKPVSVTKSKILIARQSLTTKLVKMNVTXKMMCNSTTKIMHVSTTQGTSYVSLDQSKHSSSKNYYRSCTSHISEECTEQMGCEKHGSQKFR

SEQ ID NO: 208426 - protein, 183 aa, Triticum aestivum
  unsure (1)..(183): unsure at all Xaa locations
  Clone ID: PAT_TA_102844.pep
PASTPTNFLGKKLKKQVTSAVNYHGKSSKANRFTVMAAENIDEKRNTDKWKGLAYDISDDQQDITRGKGIVDSLFXAPTGDGTHEAVLSSYEYRQPGTKKVDFDNTMGGFYIAPAFMDKLGCPSLQELMTLAKSKIPLILGXWGGXGQGKXFQCELGFARWASTNMINAXXXKSGNAGXPASS

SEQ ID NO: 208427 - protein, 181 aa, Triticum aestivum
  unsure (1)..(181): unsure at all Xaa locations
  Clone ID: PAT_TA_102845.pep
MASVYIPVQGTEEEVRVALDHLPADASDILDILKAEQAPLHLWLIIAREYFKQGKLEQFRQILEEGSGPEIDDYYADVKYERIAILNALGAFHTFLGKAEKAPQKEVHFKDXTQYYNRASRIDETEPXSWMEEATFRAKGELQMGSDSLXXLDXDGDNXPXXLAGLXLFLXXDTDTPKKGM

SEQ ID NO: 208428 - protein, 122 aa, Triticum aestivum
  unsure (1)..(122): unsure at all Xaa locations
  Clone ID: PAT_TA_102846.pep
LQXAXXHXPGVFPLSKGWPXXXWSFRXGSIFXAGXGXYHPDRHHXGECLTXPXMDLXPQFGSCSXYXQXVTWQQSGFTVLHXXVXSDQLNLNKDPIVKTRSKXGGKEIMCRGYQVVXMFSPK

SEQ ID NO: 208429 - protein, 169 aa, Triticum aestivum
  unsure (1)..(169): unsure at all Xaa locations
  Clone ID: PAT_TA_102847.pep
AFSSTVGAPASTPTNFLGKKLKKQVTSAVNYHGKSSKANRFTVMAAENIDEKRNTDKWKGLAYDISDDQQDITRGKGIVDSLFXAPTGDGTHEAVLSSYEYVSQGLKKVDFDTPWGGXYIXLVFMDKLVXHXXKNXMTLPKLXIPXFGXWXXRXXEXFQXELVSQMAPI

SEQ ID NO: 208430 - protein, 72 aa, Triticum aestivum
  unsure (1)..(72): unsure at all Xaa locations
  Clone ID: PAT_TA_102848.pep
FXXQXXFVSEKPFKXFLTKXTFPKAVKSXYQSMQXRLFXNNKFWKLXPSXKSINQCKXAFPXTINLGNCCLV

SEQ ID NO: 208431 - protein, 136 aa, Triticum aestivum
  Clone ID: PAT_TA_102849.pep
FISTFAKLGTGRTTIQGFCRRVESTANTDSIPVLRLNGAELLRHEERELRSLVLVILLTISASSGSGRSSIHYLSCTTWAVSRPGRRSEEPTNQEGRRQPEGGKLGGNDGDQGGRIGRRGRRQNPRGESVGWLREL

SEQ ID NO: 208432 - protein, 172 aa, Triticum aestivum
  unsure (1)..(172): unsure at all Xaa locations
  Clone ID: PAT_TA_102850.pep
KVVLSVGSQHGLKNQLPLRHYLCCSDRGLFHLAKLLPARYLSDHFLVASHSRSSLLSYDHSEKHVYHLEHLLEEFRLQRVLFLKLDPLKPSFLQLNPWLLPRPSSLHEMKACYLGSFANVLSPDPQLPLELPPHLPLLALRLPSPLLQIRMGRRKEREKKERKEEXKKEWEG

SEQ ID NO: 208433 - protein, 114 aa, Triticum aestivum
  unsure (1)..(114): unsure at all Xaa locations
  Clone ID: PAT_TA_102851.pep
HMDKASRTAAVXEPQEDEEVPETYTDSPVGMEALEEELTELISETPQGQPERLRXSPXWLRWYRKVSTCKRVYTHLQEPIPHXLGSAAXKGPXNVSKIWKTWNPPHYGSEQLRT

SEQ ID NO: 208434 - protein, 219 aa, Triticum aestivum
  unsure (1)..(219): unsure at all Xaa locations
  Clone ID: PAT_TA_102852.pep
RIMIYYPNSAGGGMKELFRKVGNRSSEFHPDVRRVRREGSYIYEEFMPTGGTDVKVYTVGPGYAHAEARKSPVVDGVVMRNPDGKEVRYPVLLTPMEKQMARDVCNAFRQMVXXVFDLLRCDGRXYXVWDVNGWSFVKNFTKYYDDAACIXRKIFLDAKAPHXSXPFLHPSWKSKAPEGLTQGEXGIIGHSVIKLLLSLGDRQTDKRGKLSFDVSRKQN

SEQ ID NO: 208435 - protein, 176 aa, Triticum aestivum
  unsure (1)..(176): unsure at all Xaa locations
  Clone ID: PAT_TA_102853.pep
GKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDXTMGGFYIAPXFMDKLVVHLSKXFMTLPXIKIPLIXGIWGGRGQGKSSRVSLAXQDGXTHLISXGXXESGTPKPAKLISPG

SEQ ID NO: 208436 - protein, 81 aa, Triticum aestivum
  Clone ID: PAT_TA_102854.pep
SDERNQQIPQPISSPVDSSSPSSGPPPPPQGTAIPFPSPRTVRIHVSVVVGGLLPSNFARLCSDLGLRERSLLSRSIAHVR

SEQ ID NO: 208437 - protein, 198 aa, Triticum aestivum
  unsure (1)..(198): unsure at all Xaa locations
  Clone ID: PAT_TA_102855.pep
LMQPHIQQQQSFLQPTQMQSTQQSMMQMSSGLHPVQSTVPQTQPMSRQSVTQSGIQQNQLNSVQQSVPSLLQQPQQSVGRQQQQAQPSMHQQPSLQRQQPNIPLQQQQQQQQQLMGQQPNLERNQLIGQQNXXAVEMQQQQRXPAQSNNLXXVQQTQXQMLXXQSMPLHQXQQLAXSQLXRLQQQQQINSSSGCICCR

SEQ ID NO: 208438 - protein, 160 aa, Triticum aestivum
  Clone ID: PAT_TA_102856.pep
PTRPILLNNMSEVFNSWILPARELPIYSMVENINSKITARIYSKQMEVAEDRKWSMRLCPKIQKKLDKYTDWAANCMVFGAGQKVFKVVSMNHSYIVDLEMETCNCKRWDLSGIPCHHAIACARNERIDPASLVHDWYSVGTYKRAYAFNVKPVRTRNID

SEQ ID NO: 208439 - protein, 175 aa, Triticum aestivum
  Clone ID: PAT_TA_102857.pep
PCRLLKGRQYTGSDDGALNIVKYDDGREFIVDLVTDPGTVIPSEGAVLSTEFEDSSYSDNHQLSKADTANHLGSSHSGVSNSACDSFEYELLDRRSTSSNVGPSDTDGAATSQTRNQQNTISSFENLSVSTFPSENKPASMKVEAQKKPVAQRQRKPGANNCKSPFKSGNTGFRR

SEQ ID NO: 208440 - protein, 89 aa, Triticum aestivum
  unsure (1)..(89): unsure at all Xaa locations
  Clone ID: PAT_TA_102858.pep
MDSDDKKFGKGPRELXGAVDLISQYKLELHHDFFCKRPLPLAISDXHYLHNVVGDTEIRKGEGMELDNSLECILKGQVCIKPFWKHWSI

SEQ ID NO: 208441 - protein, 162 aa, Triticum aestivum
  unsure (1)..(162): unsure at all Xaa locations
  Clone ID: PAT_TA_102859.pep
EAVFEHTLSGNEAAPMSTGSPFGAMASLFAPKLPGGLAASLTGERSPATDKLKPIKRERQAVRPPVEHKWSLPEVDQVAKPPVIFQHELIQSFSINMFCKIPXNQVRTYKDLRXCLMKRIFLSALXFRINTRYKSSNPPLHXVXLDHXDSGREGCTVLYSNS

SEQ ID NO: 208442 - protein, 106 aa, Triticum aestivum
  unsure (1)..(106): unsure at all Xaa locations
  Clone ID: PAT_TA_102860.pep
MKVYPIVRRRSALCSLPSARSACGQLFLACSTAICIYIYGLLAVEATAERSARVLPCALCNGGRRTTCRGPLSSVGRARCXHQYCTHGVPPEINCXRPANSGXRFP

SEQ ID NO: 208443 - protein, 144 aa, Triticum aestivum
  unsure (1)..(144): unsure at all Xaa locations
  Clone ID: PAT_TA_102861.pep
MGTHTIGMSKLQATVQQIQGIFDQCLAVHDKLETSLHDLSRTGGAKSCKAAHKAADAQFKELVKELKRLLLSVXSSPQSYQIWPKLEGLVAKEREMQEKLMARHATXVDSFEKNNRYLLEAMTPCQVFAPYGGSHVKIPVWKKG

SEQ ID NO: 208444 - protein, 148 aa, Triticum aestivum
  unsure (1)..(148): unsure at all Xaa locations
  Clone ID: PAT_TA_102862.pep
MDPFHGILIAAAILVLFLIFVVFPLSFLRYYYFSTGAAEVPAPRGVGPELLGSLPVTVYRTADHVGVVECAVCLAGLQDGEQARFLPCCXHGFHAGCISVWLASXSPAVCRVTVIGKIPDALRPTKSPPHCRSRRITPGTCRRSVLNC

SEQ ID NO: 208445 - protein, 50 aa, Triticum aestivum
  Clone ID: PAT_TA_102863.pep
MAPAVMASSATTVAPFQGLKSTAGLPVSRRSGSAGLSSVSNGGRIRCMQV

SEQ ID NO: 208446 - protein, 175 aa, Triticum aestivum
  unsure (1)..(175): unsure at all Xaa locations
  Clone ID: PAT_TA_102864.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDAPTRPSSLYEYVSQGLKKYDFDNTMGGFYIXPAFMDKLGVHXFKNFMTCPTSRSTHLGIWGXKGQGKXFQCDLFPAPNHNARN

SEQ ID NO: 208447 - protein, 182 aa, Triticum aestivum
  unsure (1)..(182): unsure at all Xaa locations
  Clone ID: PAT_TA_102865.pep
LSDXGLAKLAXWEXTHVSTRVMGTYGYCAPEYIKPXQLTIKIDVXSFGIFLLELIXRKKAVDSTKPASDQILVNWVCVFCSXYILLPHTECLVRNYFKKMLATXFFQTVELNSCSIXQAMPIIRDRRRYHELVDPLLRGEYPEKDLSQAVAVAAMCLHEEDSVRPYMSDAXVALGFLAEVPA

SEQ ID NO: 208448 - protein, 145 aa, Triticum aestivum
  unsure (1)..(145): unsure at all Xaa locations
  Clone ID: PAT_TA_102866.pep
HQPRQELARAYRRHWIILPAGRRHRLESRDPFMFFFFFNDSGPCSCYERSGRCLAGWNLDDHLGLEKRHGGNXQPMGQYSDLIYTSYIMLCFITWYFIYYYYIYLPDRRLXXXKIPYXXYRLDRRFVXRSCXDRXYRXXILXKVQ

SEQ ID NO: 208449 - protein, 148 aa, Triticum aestivum
  unsure (1)..(148): unsure at all Xaa locations
  Clone ID: PAT_TA_102867.pep
NRWPFLXKXLDALKHAKTSAIRLAISSGISKDHNHRKSPFFINYSSHDGLETGQGTQKSSSGGGRLVLWSGDKGKEQLYPLSDEELRGNMLARGEHHNVEGAXTGKAVAPHDNLKANTSAEYVDRRGVQIRKWVQIHGESATYNKLSL

SEQ ID NO: 208450 - protein, 146 aa, Triticum aestivum
  unsure (1)..(146): unsure at all Xaa locations
  Clone ID: PAT_TA_102868.pep
PRVRSPGRLXGNFSXDNRSGINHXLHRISAIRNRKANIIGLTXRVGRAISGSAEMIRDLVVGGGSILVIGPPGVGKTTLIREIARXLADEGKKRVIIVDTSNEIGGDGDVPHSGIGRSRRXQVXSYDAHNVMIEAVENHIRNYCDR

SEQ ID NO: 208451 - protein, 135 aa, Triticum aestivum
  unsure (1)..(135): unsure at all Xaa locations
  Clone ID: PAT_TA_102869.pep
RRLXRXAARPXGLXFNQGSRVVYLAPPDPFHIRSQCHFSGLPDPRSTRSSAVLPRSPGLNTPPPARLPNKPEPASVDFRCCSFFPEKKYQTTANLGYDHVRGSSCEQSHLGLSVHGWMPEYFVLRNLRQTKFXPP

SEQ ID NO: 208452 - protein, 205 aa, Triticum aestivum
  unsure (1)..(205): unsure at all Xaa locations
  Clone ID: PAT_TA_102870.pep
LSGPXANYVGTQGGTIPFSTNSGAFEFQGANGVIPNWRPRPSTRISITRTFSKKDIRSILIDKMKSDLMENLKEIRSKPLQVTVNGKASEKHVVNEHVEGNETLASDDSTANKDVCADPEEKGSANSADAENEDDNTFSYTXSDPDFHDFXKDRXEESFXXDQIWXSYDDEDGMPRXTHTSKGISLTHLRQNKFXXSRTNREFGH

SEQ ID NO: 208453 - protein, 112 aa, Triticum aestivum
  unsure (1)..(112): unsure at all Xaa locations
  Clone ID: PAT_TA_102871.pep
SHLTDITRTFCDLHKRALRSPTQAXKKFHDXPRSYQRHKXAWMKLCPLKELARPHHXSCRVKKKQDLPVSXKSQMTSWSDGKXIIAQNWITRRQQAQETGGAAALXKNXQTP

SEQ ID NO: 208454 - protein, 224 aa, Triticum aestivum
  unsure (1)..(224): unsure at all Xaa locations
  Clone ID: PAT_TA_102872.pep
TVIRSPGAGIHLAKVQAHRDAAAFSSTVGAPLXYPTNFLWKNSKTGDLAVNYHARLQANRFTVMAAENIDEKXNTDXWKGLXYXIFDDXQXITRGXGIVDFLFQAPRXTDHKGVLSSXQYLKQGXKKYXXXNXMEXFTLFXFYGNFXFIFQXFLTFPNKKXLFLXLXGXGKENFXGGFXXQKGXNPNNPKRPPKPPNYGLIKKKVFINLRGGGAPTKTNNPPFK

SEQ ID NO: 208455 - protein, 192 aa, Triticum aestivum
  unsure (1)..(192): unsure at all Xaa locations
  Clone ID: PAT_TA_102873.pep
MAAAFSSTVGAPASTPTNFLGKKLKKQVTSAVNYHGKXSSKANRFTVMAAENIDEKRNTDKWKGLAYDISDDQQDITRGKGIVDSXFQAPTGDGTHEAVLSXYKYVSQGXKKYHFDNTWEASTCSCFMDNLVSXXFXNXMTLXKXXTHYLGIWGXKGQXNLPXDLFXXXAXTNIXMPKTXMXPKPPYEGVEK

SEQ ID NO: 208456 - protein, 183 aa, Triticum aestivum
  unsure (1)..(183): unsure at all Xaa locations
  Clone ID: PAT_TA_102874.pep
MRTVLTTLCHAXFGGQFHLASXFSXGVRARNICPSVPSYEXRFTTSSYMTXNLGISVPMMSSSPLFANAPPEKKXVKNFAIDFLMXSVSAVSKLLHSYERVKLLIQNQDEMIKLAALXPYXGIGDCFGAHQGXSFAHVERNTVNVFVTSTQLXLSFRILQRMFTXKDKMLWNVNFFWGGLLFL

SEQ ID NO: 208457 - protein, 150 aa, Triticum aestivum
  unsure (1)..(150): unsure at all Xaa locations
  Clone ID: PAT_TA_102875.pep
ARRILLPRRLKMQIFVKTLTGKTITLEVESSDTIDNVKAKIQDKEGIPPDQQRLIFAGKQLEDGRTLADYNIQKESTLHLVXLRGGMQXXVKTLTGKTXLEXESSDTIDNVKAKIQDKEGILPDQQRLXLPEALEDXRTLVXYNIQKGSP

SEQ ID NO: 208458 - protein, 149 aa, Triticum aestivum
  unsure (1)..(149): unsure at all Xaa locations
  Clone ID: PAT_TA_102876.pep
IPLLYASRXGFPXXHNNQDRYFFQQHIXYIHLTQSPMLLSVANFLIKASHKQYQLVQTYRLTERPCYALGENHQVRLDDHVAGEPDDSYRTAKGYQTRGVRPARRDLPRNCSCNHQMPSTTLLRPPQGPNPETTVESGAAPRSACVQSP

SEQ ID NO: 208459 - protein, 156 aa, Triticum aestivum
  unsure (1)..(156): unsure at all Xaa locations
  Clone ID: PAT_TA_102877.pep
AAXNWCYATVVAPRARSSTIVASLGXPAPSNSSSFRPKLIRNTPVQAXPVAPALMDAAVERLKTGFEKFKTEVYDKKPDFFEPLKAGQAPKYMVFRVRRFPXCAPWVTLGLEXXEGFTXRNIATWSLYXKNKTPVFGSAFEPRSVFKVDGGLAQRG

SEQ ID NO: 208460 - protein, 156 aa, Triticum aestivum
  unsure (1)..(156): unsure at all Xaa locations
  Clone ID: PAT_TA_102878.pep
SLPAIFVLVLLVCSCNSDDRLTPTKPLSPGDELISSNGIFTLGFFSLQGSAANTYLGIWYHNISERTYVWVANRDSPITGSXAGKLVVSNTSDLVLSTSDGRVVWXTKTGNVATTGSGDARCGGGLLDTGNFVVQSLNGTEIWQXYXQPTDAFFRD

SEQ ID NO: 208461 - protein, 110 aa, Triticum aestivum
  Clone ID: PAT_TA_102879.pep
QSSHRYIPSAMKNLALPFQHSTFSHNDLEGKIPRWSPAKYISQILALRGIQSCVAIFFIAVVIQLKDLRASENTGARNPLWKLHSVCSLEELLFFLCLGVSLQHSSIPVS

SEQ ID NO: 208462 - protein, 156 aa, Triticum aestivum
  unsure (1)..(156): unsure at all Xaa locations
  Clone ID: PAT_TA_102880.pep
MRECISIHIGQAXGIQVGNACWELYWXEHXIQPDGQMPGDKNXGGGDDAFNTXXXETGAGKHXPRAVFVDLXPTVIDEXRTXLTAXFHPEQXIKXKGGCTNNFARXXYTIGXEMXXXLDXXRXXXTXXLFGXIXFLTFXXGXGXXXVFLGLSFFFG

SEQ ID NO: 208463 - protein, 123 aa, Triticum aestivum
  unsure (1)..(123): unsure at all Xaa locations
  Clone ID: PAT_TA_102881.pep
ASPELPQDILMGIFATLEIPDLLRAGSVCSSWRSAYSRLRSPGHYTRPQTPCLLYTSESAGESVACLYSLAEKRTYKLALPGPPIRNRHLIGXSSQGLLVTVDDRSEMHLVNPILVNRLISFR

SEQ ID NO: 208464 - protein, 180 aa, Triticum aestivum
  unsure (1)..(180): unsure at all Xaa locations
  Clone ID: PAT_TA_102882.pep
VHSAELSGTTWFNLSSLQLGLVASGSLYGALGGSILAYRIADFLGRRIELMTAAALYISGALTTGLAPNFVVLIIGRLLYGVGIGLAMHGAPLYIAETCPSQIRGTLISFKELFIVGGILFGSLVGSYEIDVVGGWRTMFGFXCSTAAIWLXVXGRLPPSXXWLLXGTARKSPGXXNKXR

SEQ ID NO: 208465 - protein, 122 aa, Triticum aestivum
  unsure (1)..(122): unsure at all Xaa locations
  Clone ID: PAT_TA_102883.pep
MWRLKVSEGGGPWLRSVNNXLGRAVWEFDPDYGTPEERXRWKGVRREVHGRRFEKKEXKDLLMPCQYAKQNXLXGDLPXINXRQCTSTRRALXTSLRRSLPAFXXTTHDGHWPGLKFGHYAI

SEQ ID NO: 208466 - protein, 168 aa, Triticum aestivum
  unsure (1)..(168): unsure at all Xaa locations
  Clone ID: PAT_TA_102884.pep
DAWVKGVLNYIGSVDVSPESCYLHHELLNLMLVLMSTQLCSGPSPEPKDVHPFIDAAMLQDSSIVASVVQKLLLNFVRRPQIPSNGSHPVFSDDGGLGVLQXRVGSAAANFVLLPYYTFNYFVSASAEGATSQLXADNXLTCLLILIHYXRKCISMNESIPTDRCSLK

SEQ ID NO: 208467 - protein, 111 aa, Triticum aestivum
  Clone ID: PAT_TA_102885.pep
RPPKRRKSASLPGVNVLPSVALGKTFLQNKKTPAVALMAGAGRACGRVGLKTTDGSTYCFLGAHRISTHAHISQRASNPKHVRTSCWPSHMHTSIHIKLACMHQHANITHA

SEQ ID NO: 208468 - protein, 93 aa, Triticum aestivum
  unsure (1)..(93): unsure at all Xaa locations
  Clone ID: PAT_TA_102886.pep
TSIWEEIREFGRKSDELNATLLKGXKSXLVLLXXMSKTVLXTYYRXCIGQNXHFLKGXXKGQKDPGLXLKFIKCAFGGXXLIXLCXXXXXXHL

SEQ ID NO: 208469 - protein, 155 aa, Triticum aestivum
  unsure (1)..(155): unsure at all Xaa locations
  Clone ID: PAT_TA_102887.pep
IRRWPYDWGLVSLDARRDKFRSRGYPLPVLEDDAKRLRYSFEEEFSEDIWNKLSERVASNMSRVVVALASFNGEARLFACTGVFIDCNGXTTRVLTSGSLVRSNDDESKVADNLKIEGTFQINDRVTGILQHSDLHYNXAASSSKTSVLGQQLST

SEQ ID NO: 208470 - protein, 89 aa, Triticum aestivum
  Clone ID: PAT_TA_102888.pep
HITRDTRPVPDLRKTKLDTGTSLGSVLNFAISYTWKISFRSELQSCHVCKVVFFFKFQSTHMYLFCTRCNARAFLLVIDKPSNLHSSPC

SEQ ID NO: 208471 - protein, 204 aa, Triticum aestivum
  unsure (1)..(204): unsure at all Xaa locations
  Clone ID: PAT_TA_102889.pep
MVRGGSMRRPSLAAVSEFTLSADDYRLMEEVGFGANAVVYRAIFXPRNRTIAVKCLHLDRISSNLTSQWSLQDDVRKEAQIMKLIDHPNVIKAYCXFVVDHNLWVIMPLWQXVHCLHLMXXAHPDGLXEPVIXXIXKETLKXXXTSGQGXXHRDVKGHILLPETWGLGDLLFVKKGQKQNPLGNPVDGGFWTGLKNMLKWARPL

SEQ ID NO: 208472 - protein, 148 aa, Triticum aestivum
  unsure (1)..(148): unsure at all Xaa locations
  Clone ID: PAT_TA_102890.pep
ALSLAPLATSSPHHSPALRTAAARVPSPXQASLCHPPXMPASPLPLFXTSRPLPPPPFPTTRCARXSRREKIDFFXLGMSFXTESVRALDLXRXXXCXXEGXNVNXGPXRXRXXLDNXAXGPFFSNKPAGWPRFXFRXRGDXXXTSSX

SEQ ID NO: 208473 - protein, 164 aa, Triticum aestivum
  unsure (1)..(164): unsure at all Xaa locations
  Clone ID: PAT_TA_102891.pep
KXDXXWXSGRXXXXPXXXXFIVSXXTFAAPFLGGFMVPVQCSIPLXQKTHLTXXXRLXTFYSSHTSVLMQVVSLSSVXHLGKIMRKGFQSSRSCSRALIYDVRGETSCFCRRHHLSLLSTTAIFAAISLCPAPPSQSLSAERPRARPSPSSPLPSSPRVSAATN

SEQ ID NO: 208474 - protein, 200 aa, Triticum aestivum
  unsure (1)..(200): unsure at all Xaa locations
  Clone ID: PAT_TA_102892.pep
KKGLXIFXXXXXXXXSXGIGPXXGXCLXDXXTXYPSXNXXEQCIXPGHXIPTSKLFAXKRNFFVXXRTXAQPQPFXTXDXEQCSPAMCXHPXNKPSXVCPFNSQXIFLGYVTEALPXXLQQVXDPAFPTSFSIRYSRRGRGCLQFVQSILELLQQAVQPLSLVVTSDSFFDNLISILCSMTSPSVNLSLGIVPDLISMKS

SEQ ID NO: 208475 - protein, 258 aa, Triticum aestivum
  unsure (1)..(258): unsure at all Xaa locations
  Clone ID: PAT_TA_102893.pep
XXXXXXXXXXXXAXXXPXXXXXXXXXXXPXXKXXIXKVXPXXXPHLGXTXPKYFPKXPXIYYVXXXXIPNFYIXPILPITGKXXQAYKFPASGVIEPDSESPAQKYRIXLXEXKPXRYKXRSPGCRRSRARAGTDPDSSSSWHGQFDRIDTTYARDSGDEPPIPSRTLLIERLMNSNWASDGLSRPGEHPDPVRAEGGREGGEERERRLPGRKAGVVVGYRWFCVGKGARGIWAWRREEGWEQRRXLXALLDRGIRGG

SEQ ID NO: 208476 - protein, 141 aa, Triticum aestivum
  unsure (1)..(141): unsure at all Xaa locations
  Clone ID: PAT_TA_102894.pep
MGKIKIGINGFGRIGRLVARVALQSDDVELVAVNDPFITTEYMTYMFKYDTVHXHWKHSDIKLKDDKTLLFGEKPVTVFGXVRNPEEIPXGEAGAHYLVXSPGVFIDKDKAXXTXGGCKKGGFPNKNPYVCGWNTTLNVNI

SEQ ID NO: 208477 - protein, 154 aa, Triticum aestivum
  unsure (1)..(154): unsure at all Xaa locations
  Clone ID: PAT_TA_102895.pep
DLLKTEFGQEIDAHDAVFRDNEAPVNKKYAKYVGLKRDFRLVVRGAARNMAPILKGSSDEALIIKSLTHKEINAVIKELPNPVYLFQGIVLRRGAKGLVEVRXKLALSLCDIVTLWFTGGSGYKEWPDLLALGKAXPLQGRLIPWSARIIGSFP

SEQ ID NO: 208478 - protein, 162 aa, Triticum aestivum
  unsure (1)..(162): unsure at all Xaa locations
  Clone ID: PAT_TA_102896.pep
MAYAASSPAVPDWLNKGDNAWQLTAATFVGIQSMPGLVVLYGSIVKKKWAVNSAFMALYAYASXLWCGCWXGFPWGFGERXLPXWARRXVALTQXYFVGRAKLSANKAREHPXVGALLPGGTLVMFQFXVRRHTXILXAASVLADEHKXWMAXPXWLSFTRA

SEQ ID NO: 208479 - protein, 162 aa, Triticum aestivum
  unsure (1)..(162): unsure at all Xaa locations
  Clone ID: PAT_TA_102897.pep
MAAAFSSTVGAPASTPTNFLGKKLKKQVTSAVNYHGKSSKANRFTVMAAENLDEKRNTDKWKGLRXDISDDQQDIPEGKGIXGLALQAPTGDGTHXGRPQLYQYXSXXLXKYDFXTHGXXXHXLFMGKLGXHLSKLYDLPLKIHYLGIGRKGKEIFQCFQMA

SEQ ID NO: 208480 - protein, 113 aa, Triticum aestivum
  unsure (1)..(113): unsure at all Xaa locations
  Clone ID: PAT_TA_102898.pep
FKLGNLSLQCSIVAQLNKLLXVFPRXKXTSTXDQVXTNAXGASHLVALTSLXXNLEARSNXVXXVXXNLNXTGXSXXTCYXXFXXIXFXXXXXGXXFXXXGGXXXXFXPXXXX

SEQ ID NO: 208481 - protein, 181 aa, Triticum aestivum
  unsure (1)..(181): unsure at all Xaa locations
  Clone ID: PAT_TA_102899.pep
RTRGRTRGFFLKIKRKNIIHNHSQHYRIRTIALRLHQTLTVSPMIQKKRLVYAPKFNTAGKSCEINPIYHPQHSTGRIIHGNKGRQFLFRQNYTAKRKKDLHFWDLFPIYCLXLPPYCFCNALFKCSIMSDLDKQNSPTWKCNPAVHTWSIYTGYLXXGKQTIPSIDSPAIQAVFXSAWXN

SEQ ID NO: 208482 - protein, 116 aa, Triticum aestivum
  unsure (1)..(116): unsure at all Xaa locations
  Clone ID: PAT_TA_102900.pep
LDLSLSQPPRTLAPFPTIPRSLPLLHPTSLVSRRRYGSSVLRLCLRNSSSIPFCSRCSSAQVVRKPREEEPRSRSRVRRRDLAREAVGGGPQPERSGCSHVVGSAXAVLGVGRGRP

SEQ ID NO: 208483 - protein, 122 aa, Triticum aestivum
  Clone ID: PAT_TA_102901.pep
SKPIPLLASIRPRFRFCFCSRCLEMSRFSAISPMIRRCSTSSPSLPLSRSLSLSLSPCVTFLLNGTLTPRYLQFKGGRGGRGRVRDPALSQNTDPCLNQLARRGKPKSARREETKVRETESQ

SEQ ID NO: 208484 - protein, 113 aa, Triticum aestivum
  unsure (1)..(113): unsure at all Xaa locations
  Clone ID: PAT_TA_102902.pep
KXXCAPVSXLXXGVVXRLWFLNLYLMKGWXSPSGLPLYMPYRQYLIXCPAKKIGTXRNCXKRKIXLYVGNPYLQPRNGTEIGNXACGNGRQGRGKGALTKASKPDHHESGGTA

SEQ ID NO: 208485 - protein, 80 aa, Triticum aestivum
  unsure (1)..(80): unsure at all Xaa locations
  Clone ID: PAT_TA_102903.pep
XXGXRLLXXNFXXXWAXHQIXQXWXLLFPQLNLXVKKELLPPRPXSYLGTXTFYLYRWXXXVKQSKSICMQVKSTYIFHV

SEQ ID NO: 208486 - protein, 106 aa, Triticum aestivum
  unsure (1)..(106): unsure at all Xaa locations
  Clone ID: PAT_TA_102904.pep
YLLTNKXSGTKYVTANTFLEDIADVHFMLGEWSDHVICGDDEIFKCMTTKMKTKYEKYWGDPEKMNKYIFIAAILDPRTKESHFFKDMIEDTYGSIIGNRILTSSQ

SEQ ID NO: 208487 - protein, 220 aa, Triticum aestivum
  unsure (1)..(220): unsure at all Xaa locations
  Clone ID: PAT_TA_102905.pep
DKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELEXVGNAGEPAKLIXKRXREAXDMIKKXRMCLLLXPXXAXGVGWADPQYTVNNXMXNATXMNIAMPHNGQFQHXHRRRPCPWNDSPIRRRWEGFF

SEQ ID NO: 208488 - protein, 161 aa, Triticum aestivum
  unsure (1)..(161): unsure at all Xaa locations
  Clone ID: PAT_TA_102906.pep
DKVVRDEQNKVKEELAELCFSDPMDLHKRLDREILETESDSFKLKLQKVVASRLVLPDICRSYIDIIERQLEISDLSMSSRVLLMHQVTVWELIRVLFSEREAGNQLEFCGDEXQEGMILDKKEGSVNIDPEALXLVRRADFSNWLQDSVXHRVQGEGFFK

SEQ ID NO: 208489 - protein, 130 aa, Triticum aestivum
  unsure (1)..(130): unsure at all Xaa locations
  Clone ID: PAT_TA_102907.pep
MAAAFSSTVGAPASTPTNFLGKKLKKQVTSAVNYHGKSSKANRFTVMAAENIDEKRNTDKWKGLAYDISDDQQDITRGKGXVXDSLFQAPTADGTHKARPQLYESSALSRFTHGRHLFMAWWFSLIDLPN

SEQ ID NO: 208490 - protein, 152 aa, Triticum aestivum
  unsure (1)..(152): unsure at all Xaa locations
  Clone ID: PAT_TA_102908.pep
QIQKEILQSGPGPSGSGNQKDKMLAMLVEDEPRRKKSLKLPGGPKKKSPTRRMKTVTYDDDDDFDAVLDGASAGFMETEREELIRKGXLLTPVYKLKGFEKRVESPGTSTGKMTFRTSRGNHGTSLVKVAKQCRTWKAATPNCCALLTSWSV

SEQ ID NO: 208491 - protein, 181 aa, Triticum aestivum
  unsure (1)..(181): unsure at all Xaa locations
  Clone ID: PAT_TA_102909.pep
MASATLLKSSFLPKKAEWGVARQVAAPRVSMVVRAGAYDDELVKTAKTXASPGRGILAMDXESNATCGKRLTSIGXENTEANXRRSHAAGLRPWXGNHISGAILXEETLXQSTVXGRXIVDILVDRAXSRDQXGQGLVPLPXHDFCARARLPGGRYYRRPPGDPNGPPLPKEWASLPKGPL

SEQ ID NO: 208492 - protein, 171 aa, Triticum aestivum
  unsure (1)..(171): unsure at all Xaa locations
  Clone ID: PAT_TA_102910.pep
LLSSWSQHTHTPXSPRGHATYLPLHPPPLPLSPSHRPAAAHPLATHQRPARLRRRRLDSGHRRPTPPLPAPPRSTQHLRRRPATDLLLYGDDRFERSNTFSPXXXPXFDXVASPTKHTXNLERLRTARSALGRRIXYCSXRHARRSKTPTDHRSMSXXARXRXRLYGRRFY

SEQ ID NO: 208493 - protein, 177 aa, Triticum aestivum
  unsure (1)..(177): unsure at all Xaa locations
  Clone ID: PAT_TA_102911.pep
MAPKAEKKPAAKKPAEEEPAAEKAEKAPAAKKPKAEKRLPAGKTASKEGGEKKGKKKSKKSVETYKIYIFKVLKQVHPDIGISSKAMSIMNSFINDIFEKASAGXGLPKLRPLTNKKAPPITSRGRIPRPPSRPSSFPRGEASPKAPGLLEGATQRARQPKVSTLPSLKIGGSPLVS

SEQ ID NO: 208494 - protein, 191 aa, Triticum aestivum
  unsure (1)..(191): unsure at all Xaa locations
  Clone ID: PAT_TA_102912.pep
MKTFLILALLAIVATTATNAVRVPVPQLQPQNPSQQQPQEQVPLVQQQQFLGQQQPFPPQQPYPQPQPFPSQQPYLQLQPFSQPXLPYSQPQPFRPQQPYPQPQPQYXSQPQQPISQQQQQQQQQQQQQQQXQQEQQILQQILQQQLIPCMDVVLQQHNITRGRSQVLQQSTYQLLQRIXLQHLWQIPEKL

SEQ ID NO: 208495 - protein, 57 aa, Triticum aestivum
  unsure (1)..(57): unsure at all Xaa locations
  Clone ID: PAT_TA_102913.pep
NLTLXRTNPTKGNKSWSSTAVAAALELVDPPGCRNSAPXXLLSLAFFFNNTMINHLF

SEQ ID NO: 208496 - protein, 249 aa, Triticum aestivum
  unsure (1)..(249): unsure at all Xaa locations
  Clone ID: PAT_TA_102914.pep
LRLLEINPTKGNKSWSSTAVAAALELVDPPGCRNSARAQQPYLQLQPFPQPQLSYPQPQPFRPQQPYPQPQPQYSQPQQPISQQQQQQQQQQQQQQQILQQILQQQLIPCRDVVLQQHNIAHGSSQVLQESTYQLVQQLCCQQLWQIPEQSRCQAIHNGGHAIILHQQHHHHQQQQQQQQQQPLSQVFXQQXQQQYPSGQGFXQPSQQNPXAXGXFQPQQLAQFXXIKXTLALQTLPXAMXNXYILPYW

SEQ ID NO: 208497 - protein, 115 aa, Triticum aestivum
  Clone ID: PAT_TA_102915.pep
PCSKTLLKGTKAGAPPAVAAALELVDPPGCRNSAPAGNTPRDRCCKELYDASQHCRCEAVRYFIGRRSDPNSSVLKDLPGCPREPQRDFAKVLVTPGHCNVMTVHNAPYCLGLDI

SEQ ID NO: 208498 - protein, 141 aa, Triticum aestivum
  unsure (1)..(141): unsure at all Xaa locations
  Clone ID: PAT_TA_102916.pep
XTXSXXXSXXRALXXMKLVSTXXPXXXXXSXXXXTXXXXXFYCXMXPHXLLXXKLXQXXXLXXLXHXXXYXXXRXXCXPXXXXTXLGXXXXIWKXXGXSXWSTNLLXXFELFXISXCTQGVFPTHXGGFDXXANVYXECXX

SEQ ID NO: 208499 - protein, 168 aa, Triticum aestivum
  Clone ID: PAT_TA_102917.pep
MDATATGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPNINPVLLPKKTAEKEGKAPKSPKKAAKVAQEGRHPRRLKEKMRSVSV

SEQ ID NO: 208500 - protein, 366 aa, Triticum aestivum
  unsure (1)..(366): unsure at all Xaa locations
  Clone ID: PAT_TA_102918.pep
LIXXXSHISDXLSXSXYPISXSXXXXPIXAXQSPIXXFXYHFXXXXXXXXIXSXXXSSXTLHITILIXXHFIXXXXXXXXSXTXXXPXXSXQXXHPXXPXIXXXHXXLXXXSXHPXXIXXFXPFXSFVHXXXLXXFXXSXIXXSIPFXHRXXXSIXXSFHSSFXPSXHPXXHSIPXIXXVSSHSNPSHXFXXXXPFHSQXXPFXIPFXFPXXFRXQIXFPXPXXXXXXXHIPXXQXPXPXIPIIPXXPXXPFPXXPSIXXFXXYXPPXSXIXPXFXXXXXYLHHFSTNXXPXPXXNXLXLXPXIXXXSXNPXYTXXXPIXXXXISPNFSLXKXPPXXSRXXLFFPKKXXFFSXKPFXXLLPFXGPX

SEQ ID NO: 208501 - protein, 174 aa, Triticum aestivum
  Clone ID: PAT_TA_102919.pep
MQQQSQQQWQERQQQAQHKSMRMLLENLSLMCNIYVPVQCQQQQQMGQQQQQQQLQEQLTPCATFLQHQCSPVTVPFPQIPVDQPTSCQNVQHQCCRQLSQIPEQFRCQAIHNVAEAIRQQQPQQQWQGMYQPQQPAQHESIRMSLQALRSMCNIYIPVNAPAPPTTFPWWLLH

SEQ ID NO: 208502 - protein, 241 aa, Triticum aestivum
  unsure (1)..(241): unsure at all Xaa locations
  Clone ID: PAT_TA_102920.pep
PPSLITPCSKLTLTKGNKSWSSTAVAAALELVDPPGCRNSAPXXFTXPXXXXPHXHXNRFPSLXXXXNHXXIXNKXXXXQXQXXFXXXXXXQXXXXHQPDQPFXQTXXPXQPFXHXPXQXXXQDSHLEQXFDXLXQXTXXPXXEXXQXLPXPRXPQXXXXXXXRTXXQPSLHQQLNPCKNILLQXCKPASLVSXXWSXXWXQSDCQVMRXQCCXQLXQIXSTXQCAFIHSVXHXSIXMQXX

SEQ ID NO: 208503 - protein, 131 aa, Triticum aestivum
  unsure (1)..(131): unsure at all Xaa locations
  Clone ID: PAT_TA_102921.pep
MAETEYRCFVGGLAWATDDNNLQXAFSQYGEILDAXIINDRETGRSRGFGFVTFXSEESMRQAIXEMNGKELDGRXITVXEAHSXRSXGGGGXXGXYSGQXXGXXMLLGVYPWGMSSSHLGVSCYGSLFSI

SEQ ID NO: 208504 - protein, 103 aa, Triticum aestivum
  unsure (1)..(103): unsure at all Xaa locations
  Clone ID: PAT_TA_102922.pep
MSGRGKGGKGLGKGGAKRHRKVLRDNIQGXTKPAIRXLARRGGVKRISGLIYEETRGVLKIFLENVIXDAVTYTEHARRKTVTAMDVVYALKRQGRTLYGFXG

SEQ ID NO: 208505 - protein, 176 aa, Triticum aestivum
  unsure (1)..(176): unsure at all Xaa locations
  Clone ID: PAT_TA_102923.pep
MATETETFAFQAEINQLLSLIINTFYSNKEIFLRELISNSSDALDKIRFESLTDKSKLDAQPELFIHIIPDKATSTLTIVDRRHWHDQSPTFVNNLRTIXQVGGPKEFMEALRLPAPDXSXIGQFGXWGSTSAYLVAERVVRPKAPTTKQFGGEVAGWFHPNVDVLGEAGGVPKDW

SEQ ID NO: 208506 - protein, 148 aa, Triticum aestivum
  Clone ID: PAT_TA_102924.pep
WIPRAAGIRHQQQMNPCKNFLLQQCNPVSLVSSLISMILPRSDCQVMQQQCCQQLAQIPQQLQCAAIHSVVHSIIMQQEQRQGVQIRRPLFQLVQGQGIIQPQQPAQLEVIRSLVLRTLPTMCNVYVSPDCSTINAPFANIVVGIGGQ

SEQ ID NO: 208507 - protein, 217 aa, Triticum aestivum
  unsure (1)..(217): unsure at all Xaa locations
  Clone ID: PAT_TA_102925.pep
CSIXCXXXXXTXXIXXXXXICYXYXSXXXRDXXXTRXPXLLLSLXXCXXXXYXSLXXXNIXIIVFXSICHXFXXYXFSFXSXXSXLFXTLYXGLXXXXSXIYARSIXXHXXIXXXSHXXXTXXXXFXYXXYXXYXXXSRSXTVTRXXHVXXYXXLXXXTXXXXXHIXXNXXXXSLSXSLGXSXXXYLXXSXXXXXVESXXXGXXXSXGXLXYXXXXY

SEQ ID NO: 208508 - protein, 211 aa, Triticum aestivum
  unsure (1)..(211): unsure at all Xaa locations
  Clone ID: PAT_TA_102926.pep
XRTXFXXEGDXXXXXNPFXXSPXLIXNRXXNFXXLLXXXXXXNSDYXXHEXXXPIXXGXGIRAXXXNXPKXRXIXXSXFXSXXXXSXCVKIXXFGXXPEKXPXXXXXXXXYLXKYXVFXXEXXHICXXXXRXPXGKLGXFGKXSXKYSPPWXVXXXDXGXSPXXRKXXHXRXFPXWGXXXXRXXXVXTXKFGXRKTPXWDXXXXKIXXSXG

SEQ ID NO: 208509 - protein, 184 aa, Triticum aestivum
  unsure (1)..(184): unsure at all Xaa locations
  Clone ID: PAT_TA_102927.pep
MKTLLILTILAMATTIATANMQVDPSSRVQWPQEQPPPQSQQPFSXQXQQIFXQPQQTFPHQPQQAFXQPXQTFPRXPQQQFXQPQQPQXPXPQPXQPQLPXXQQPQQPFPQXQQPQQPFXQSQQPQQPFPQPQQQFPQPQQPQQXHSPQQQQWXIQXFLQQQMNPCKNXLLXQCNXCXIGCNS

SEQ ID NO: 208510 - protein, 181 aa, Triticum aestivum
  unsure (1)..(181): unsure at all Xaa locations
  Clone ID: PAT_TA_102928.pep
PSLKNKSWSSTAAAALELVDPPGNSARAFXQQPQQPFPQPQQPQQPFPQSQQPQQPFPQPQQXFPXPQQPQQSFPQQQQPXIXSFVQQQMNPCMNXAFXQQCNHVSLVSXLXSIILXRSDCXVMQQQCCQQLXQIXXQXQXAXIHRVAPFHHXCNXEQQQGXXXILRPLFXLAXGLXIXQP

SEQ ID NO: 208511 - protein, 167 aa, Triticum aestivum
  unsure (1)..(167): unsure at all Xaa locations
  Clone ID: PAT_TA_102929.pep
XXXKKXXXXAXKGNPKNXIXXXGXXSXSXXXXXRIFWXSRRXXXFNAVXEGSFEHQGHYILLDFXXPFXSIRTFXKGSWEKLYGNXRXRAXPXCSDSDLKNSPSPXTDLEHSQRVLLSLFFLSSCGXXXXTXGXVGIXXLVPNSCSPGDPLVLERPPPRWSSSFCSL

SEQ ID NO: 208512 - protein, 212 aa, Triticum aestivum
  unsure (1)..(212): unsure at all Xaa locations
  Clone ID: PAT_TA_102930.pep
WIPRAAGIRHEVDPSGQVQWPQQQPFRQPQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLXLQQCNPVSLVSSLVSMILPRSDCQXVMQEQXCQQLAQIXXPASVCKPSIAXXHFIVMQXEQQPX

SEQ ID NO: 208513 - protein, 211 aa, Triticum aestivum
  unsure (1)..(211): unsure at all Xaa locations
  Clone ID: PAT_TA_102931.pep
RKNFLXTLPLFKGGXNQKKXLGEXPFPNPGRGWGPGAPAFXKKNLKXGGNSPPPXGPLXKGEKFFGXXPXKPPKQPQKTFFXPPXPWXLFFFFFXGRGXGPKTRKXKNPLKPPXPXGKTPQKESPKXPGRNELGPAVSVPRPKEGFGXXFAQRTXRGSRRKDPVAQEXMPPXSHKARXDXGGDDTSDQAAILRSSGDVEHQKKEDDCGRGQ

SEQ ID NO: 208514 - protein, 203 aa, Triticum aestivum
  unsure (1)..(203): unsure at all Xaa locations
  Clone ID: PAT_TA_102932.pep
MKTLLILTILAMATTIATANMQVDPSGQVQWPQQQPFPQPQQPFCQQPQRTIPQPHQTFHHQPQQTFPQPQQTYPHQPQQQFPQTQQPQQPFPQPQQTFPQQPQLPFSQQPQQPFPQPQQPQQPFPQSQQPQQPFPQPQQQFPQPQQPQQSFPQQQQPAIQSFLQQQMNPCKNFLLQQCNHVSLVSSLXSIIXPRSDWXVMQQ

SEQ ID NO: 208515 - protein, 116 aa, Triticum aestivum
  Clone ID: PAT_TA_102933.pep
GNKSWSSTAVAAALELVDPPGCRNSAPEQLQCAAIHNVAHSIIMQQEQQRGVQILRPLFQLAQGLGIIQPQQPAQLEGIRSLVLKTLPTMCNVYVPPDCSTINVPYASIDAVIGGQ

SEQ ID NO: 208516 - protein, 236 aa, Triticum aestivum
  unsure (1)..(236): unsure at all Xaa locations
  Clone ID: PAT_TA_102934.pep
XXLIXGXKFXINLPXXXXFAXNXFFILKIXXXXXLNGXKGXGFPFWFFXFGGXGKNFXGPXFXXXFFXEXGFPKKXAGGXSXFFFLGXXKIKXXXTGVKXFXXNXAFXGGKXXLSGPXCPPIGXIPXXWGVPKKGFRGPXKCPKGXFKPPXXAXXXLGGSRFXPRXNXXLXXGQMPKGIGXRPXVQIVXXAGGFPFPSCFRFPIWXPKVXXXPRPKMNSPRRTFLKAXXLGVTXQR

SEQ ID NO: 208517 - protein, 209 aa, Triticum aestivum
  unsure (1)..(209): unsure at all Xaa locations
  Clone ID: PAT_TA_102935.pep
WIPRAAGIRAREQPVTFFREVLALCDHPDLLKKEEIKTLFXSADSISRAKQILALIPGRATGAYSHSQGIKGLRDAIASGIASRDGFPANADDIFLTDGASPGVHLMMQLLIRNEKDGILVPIPQYPLYSASIALYXXSLXPYYLNESTGWGLEISDVKKQLEDARSRSIDVRAXLVGINPXNPTGXVLXEENQYDISEVCKNXGLSSG

SEQ ID NO: 208518 - protein, 201 aa, Triticum aestivum
  unsure (1)..(201): unsure at all Xaa locations
  Clone ID: PAT_TA_102936.pep
TETSFGNQSWSSTAVAAALELVDPPGCRNSAPDVILQQHNIAHASSQVLQQSTYQLLQQLCCQQLWQIPEQSRCQAIQNVVHAIILHQQQQRQQQQQQQQQQQQQQQQQQQQQQQQQQQQQQQPSSQVSFQQPQQQYPSGQGSFQPSQQNPQAQSXVQHQQLPQFEEIRNLALQTXPAVCNVYIPPYCSTTIAPFGIFGTN

SEQ ID NO: 208519 - protein, 205 aa, Triticum aestivum
  unsure (1)..(205): unsure at all Xaa locations
  Clone ID: PAT_TA_102937.pep
GKSXLXXXYAHXXXIXXXXXPXXHXLXLXXXKGXHFXXXXXXLTXSXXDTXXXXRPIXLXXXXDTXFTXWQXXGXXPXMXXXFRXXSXXXFYEXSSXAXXXXSLRIXEXXDNLXXXXWMDXXCXRGRXXXPXXKIXXXGLXXPIGSTHXHEXLFFSXXXLYXXGXYNXWXEXXMXXIXXXXRXXXXXRKXXXDXXXKSXTXXXTR

SEQ ID NO: 208520 - protein, 257 aa, Triticum aestivum
  unsure (1)..(257): unsure at all Xaa locations
  Clone ID: PAT_TA_102938.pep
GXGNGXXCFKGNXXPXRXXWXXXKPXFQWAVXSXWXEXXXVEXPXXGAXATMRXXGKNAGTXGTARSXTKERXNTGXMPGKXGSXLSXXEEXNCXSLXYXXXKXSRXSXKVXXLXXXVLLXXFRPLSSXDRLXXXDXHEARNLLITXNTERXXSDXXXRTXVTVRXXCSSTLKGXGKRSPLSXXEXVKXEXXHXXIPHGVXXXXXXXXXXEXGXXXGGEEEXXRGGGARAEFLQPGGSTSXRAAATAGGAPAFVPLK

SEQ ID NO: 208521 - protein, 265 aa, Triticum aestivum
  unsure (1)..(265): unsure at all Xaa locations
  Clone ID: PAT_TA_102939.pep
KKKLKPFVYCSKLTLTKGNKSWSSTAVAAALELVDPPGCRNSARGQVQWXQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPXPQQQWPQPQQPQQSFPQQQRPFIQPSLQQQLNPCKNILLQQCKPASLVSSLWSIIWPQSDWQVXCRXQCWQQLAQIXQQLQCATXHSVGAFIXMQQQ

SEQ ID NO: 208522 - protein, 82 aa, Triticum aestivum
  Clone ID: PAT_TA_102940.pep
KKSRFKTSGKKGVSFGARGKDRETPCLSLSLSLSLSLSLSLSLSLSLVPNSCSPGDPLVLERPPPRWSSSFGSLKDSRHFFF

SEQ ID NO: 208523 - protein, 126 aa, Triticum aestivum
  unsure (1)..(126): unsure at all Xaa locations
  Clone ID: PAT_TA_102941.pep
MYTARKKIQKDKGVEPSEFEDTVAQAFFDLENGNQELKSDLKDLYINTAIQMDVVGNRKAVVIHVPYRLRKPFRKIHVRLVRELEKKFSGKDVVFVATRKIVKATPRKGSXLFQRPRTKNPLTAGH

SEQ ID NO: 208524 - protein, 313 aa, Triticum aestivum
  unsure (1)..(313): unsure at all Xaa locations
  Clone ID: PAT_TA_102942.pep
XXXXXXPXGXXXFPXXPXXXXXXXXXXGAXSXXXPFXPXXXXPXXXXPHXXXXXPRXPPXXXPFLSFPFXXPPFDSXVPXRXFXXXXXTAPSPXRVVXPXXXGPPPGFLXSXPXRGPPGXPRARGPXPAAGRXPKPGXRXXPAXVXPXXPXPGPXXXGXGGEXXGXWKPXLXPAGXXPAGPGPPPPXQLGPAQAFXXLXXAKHPLPPSPFXGPVFLVLGPKSPISGPRGWKERGTKRAGEKGKKGKGERGXALGXPGNFPLPRPPGGXPPPYVXXXKPVPGPHPXGLGGLPFLWFPPLKGGVFKNFFFSGFSK

SEQ ID NO: 208525 - protein, 162 aa, Triticum aestivum
  unsure (1)..(162): unsure at all Xaa locations
  Clone ID: PAT_TA_102943.pep
NXSRXLPPFGNXSWSSTAVXAALELVDPPGXRNSAPXTFDPVPCXPYPYXXXSGATXXSPDXQNXXXXRSXGVPIXXIDWLPXPKVAAXXIPLLXCVRHKRNSXNVXQXILWXFYNDGSXAXFPGIIXAXKXQDGXVNXXDMXYYXXXGEGXTCXXXALXSC

SEQ ID NO: 208526 - protein, 178 aa, Triticum aestivum
  unsure (1)..(178): unsure at all Xaa locations
  Clone ID: PAT_TA_102944.pep
REQKLELHRGGGRSRTSGSPGLQEFGXXXKXXXPPLLPSXXXXGXLALXXXKTXMXXXGIXHXDXXXXXXTXHXXXXXXXXXXXXXXRXXXEPXXXNXXXXMXPXXXXXXQXDHQXGXXXXXXXXXXWTXXTYXXXLXXXXDXXXFXXXIXXXSHNDRLXXXXDYXXCGCPXVAXSXD

SEQ ID NO: 208527 - protein, 188 aa, Triticum aestivum
  unsure (1)..(188): unsure at all Xaa locations
  Clone ID: PAT_TA_102945.pep
MAATFNVNAEAGLKKLDGYLLSRSYISGYQASKDDLAVYSEFSVAPPSTCTNVARWYNHIDALLKLSGVTAPGQGVKVLSSVVPETSTTDVAEAPAADDDDDSDVDLFGEETEEEKKAAEERAAKAKASTKKKESGKSSVLLDVKPWDDETDMVKLEEAVRXIKMXGLLWGASKLXMPVGYGIKKLXX

SEQ ID NO: 208528 - protein, 151 aa, Triticum aestivum
  unsure (1)..(151): unsure at all Xaa locations
  Clone ID: PAT_TA_102946.pep
RPXXXCGXXWXLVLHDLPRXPMLXNAXXWLTELVMXRLYXTTXGITGTGXQXIAGPIWXGXTPLFXXGXRXSXLXXKTWGFGAFXYPIXRXLKLPREFLIXPNKTRTFYCXRXSVGFXPPLSXGTPVSLSPLVTSCRWXLFXWHKTXGXXP

SEQ ID NO: 208529 - protein, 246 aa, Triticum aestivum
  unsure (1)..(246): unsure at all Xaa locations
  Clone ID: PAT_TA_102947.pep
PSLKGTKAGAPPAVAAALELVDPPGCREFGTSDTHLGGEDFDNXRMVNHFVQEFKRKHKKDISGNPRSLRRLRTSCERAKRTLSSTAQTTIEIDSLFEGVDFYSTITRARFEELNMDLFRKCMEPVEKCLRDAKMDKSTIHDVVLVGGSTRIPKVXELLQDFFNGKELCKSINPDEAVAYGAAVQAAILSGEGNEKVXDLLLLDVTPLSLGLETAGGVMTVLITRNTTIPTKKEQVFFTYSDNQPG

SEQ ID NO: 208530 - protein, 413 aa, Triticum aestivum
  unsure (1)..(413): unsure at all Xaa locations
  Clone ID: PAT_TA_102948.pep
XXXLSXXSPXXLXLXSXXLFSRPXXXXXXLXSXFXLXXPXFXRXLLXXLXPXSXXXXXXXXSXLXXXXLXSXXRRXLPPXXPPXPFXXXXXCXXXXXXSXXXSXPLPFXPXXPXXXXXXXXXPXXXXXPXXLXXXXXXPPPXXXXPPXXPXPXXPXXXXXXPXXFXXSXXPSPXXXXLXXXXPPLLFSXXXXPFLFXXFXXXXXXXLXXLXXXXXXGLSXXPXPPXXXXXXLXFXPSXLXXXXFXXXXXXFXXSXLXXXSLXXSPXXLXXSXLLXPPXXXXXXXPFXXXXXALXXXPXXXPXXSXXXXXXXXPXSXXXXLXXSXPPPPXXXXXXXPXXLXXSXXXLXXXXXXXXXPPXXXFXXXXXXXXXSXFLKLXXFGXFXXXXRXFFXLRXXFPXXGGFFXQXXXXLSXP

SEQ ID NO: 208531 - protein, 179 aa, Triticum aestivum
  unsure (1)..(179): unsure at all Xaa locations
  Clone ID: PAT_TA_102949.pep
XAXPRXLLXDXXXXRTTXXXGDXXXIXXXLNXXXXLKXCXXQITXRXPXRGXXXGXQXQXLXXGEHDEXXHXRXXYGAAPXTRTXSAXXXAXWWRXRGWRAGLGMXAAXAAXPXNXXAGEVAAXMAAXRVWARXEISLXPNSCSPRDPLVLERPPPRWSSSXLFPXXXKVFXXSHLXXP

SEQ ID NO: 208532 - protein, 197 aa, Triticum aestivum
  unsure (1)..(197): unsure at all Xaa locations
  Clone ID: PAT_TA_102950.pep
MGKEKTHINIVVIGHVDSGKSTTTGHLIYKAWRYRQSRVIERFEKEAXLEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSXARYEEIVKEVSSYLKKVGXNPEKVPSFHLGV

SEQ ID NO: 208533 - protein, 163 aa, Triticum aestivum
  unsure (1)..(163): unsure at all Xaa locations
  Clone ID: PAT_TA_102951.pep
MAAKEPMRVLVTGAAGQIGYALVPMIARGVMLGADQPVILHMLDIEFAAEALKGVKMELIDAAFPLLKGVVATTDVVEACTGVNVAXMGWWIPRXEGMERKDVMTKNVSIYKAXAFALEAHAXPNCQGFCLLXTPXNTKWXLXLEGGLVPFYLETINLVWTPP

SEQ ID NO: 208534 - protein, 147 aa, Triticum aestivum
  unsure (1)..(147): unsure at all Xaa locations
  Clone ID: PAT_TA_102952.pep
REQKLELHRGGGRSRTSGSPGLQEFGTSDRSLDPHPLAARTKQRSSAMXGRGKGGKGLGKGGAKRHRKVLRDNIQGITXPAIRRLARRGGVKRISGLXYEETPGVLKIFSRRHFTPVTLEHAPPAETRPLGPFLPPKKGATPLGFFG

SEQ ID NO: 208535 - protein, 217 aa, Triticum aestivum
  unsure (1)..(217): unsure at all Xaa locations
  Clone ID: PAT_TA_102953.pep
EPFSLTLTKGNKSWSSTAVAARSRTSGSPGLQEFGTRKESTLHLVLRLRGGMQIFVKTLTGKTITLEVESSDTIDNVKAKIQDKEGIPPDQQRLIFAGKQLEDGRTLADYNIQKESTLHLVLKLRGGMXIFVKTLTGKXXTLEXEFFDTXFQRLRPXFPDXXGGFPRTNXRXFFXXGKQLEGLGRTLCIYKHFKKIPPLPLLPFVGALPKSFWKETL

SEQ ID NO: 208536 - protein, 207 aa, Triticum aestivum
  unsure (1)..(207): unsure at all Xaa locations
  Clone ID: PAT_TA_102954.pep
MKTFLIFALLAIAATSAIAQMETSRVPGLEKPWQQQPLPPQQQPPCSQQQQPFPQQQQPIIILQQSPFSQQQQPVLPQQQPVIILXQPPFXQEQQPGXXQXTPFFFXXXPXXXPXPXFFGXNNXQXXPQQPPFXKQQQPPFFAGSNKPXLQQPXLFHKQHQQVSQQQXPGGQPSVLXQLNPCXXFLQQQWXHXXMVATSXXAQMWXQ

SEQ ID NO: 208537 - protein, 202 aa, Triticum aestivum
  unsure (1)..(202): unsure at all Xaa locations
  Clone ID: PAT_TA_102955.pep
TGAXXXXXPTPCSGSXXXRAXXXXXTSXXETTPAXXRRSXXXCPXPAAGGRRALHRRXSRQRPSXGVKXXPXVXHXLAFQKRXXXDXGGXRGXXWLKXNXXRLESRALXGXXXPXXXXLEQSLRFSXLQKXNXRXQRVTLXGTFPXRFXPLGXGINPPGXPPGTGNLXGXYLXPGGIAXFPXGXERNWGXPXXIGFXXNGGL

SEQ ID NO: 208538 - protein, 176 aa, Triticum aestivum
  unsure (1)..(176): unsure at all Xaa locations
  Clone ID: PAT_TA_102956.pep
IXSWXIXIRVGXNXMPXYARIMLRCLHWRCSCRVFISQXPXCXXSRXCXLPIIRKQHFRSPXRQWXKFYKXXXXTNMHXYSIQXQALXTLPGFXLXSXXTTXXXXAVXQKLLSXRWXXNXXLYGXWXXSFVERLATPATSVHENXHXARXWSXXXMVXXVRIHXXLXRCXXXMLXX

SEQ ID NO: 208539 - protein, 187 aa, Triticum aestivum
  unsure (1)..(187): unsure at all Xaa locations
  Clone ID: PAT_TA_102957.pep
REQKLELHRGGGRSRTSGSPGLQEFGTSPRRPQQQFPQPQQPQQPFPQPQQPQLPFPQQPQQPFPQPQQPQQPFPQSQQPQQPFPQPQQQFXQXQQPQQSFPQQQQWMIQSFLQQQXMNPCKNFLLQQWXPVYWGDLGIIFKRIATQFKKPGHFTNGGHFPMQGNKQKGVPEWRGHFFSAQRWNSKP

SEQ ID NO: 208540 - protein, 141 aa, Triticum aestivum
  unsure (1)..(141): unsure at all Xaa locations
  Clone ID: PAT_TA_102958.pep
XLXTWXRGSARSSAPAERPLWREPRSWSSHRLLRNPHPGERDRCCXWADXRTSNQPGRRSSSSXSTGWPTSLXRQXHPLXATKXYFEEXHXTLXKXFTMRLEYRXLQRAXLLPSRXADEMXERXXPELKQHVWXCLLXXDC

SEQ ID NO: 208541 - protein, 231 aa, Triticum aestivum
  unsure (1)..(231): unsure at all Xaa locations
  Clone ID: PAT_TA_102959.pep
PLLEPSLKGTKAGAPPRWRPALELVDPPGCRNSAPDGNKKLDAAYQEAQAKGSSCPIFLFFSVNTSGQFVGVAEMTGPVDFEKTLEYWQQDKWNGSFSVKWHIVKDVPNNILKHIVLENNEGKPVTNSRDTXDINLEQGIQMLKIFKEHVNKTSILEDFAFYENRQKVXCXRKRIKQXPIPKQVWDNXASNPVAGEKHRKSPPEAVSDGWRNRCRMGKRWAMTGRSKPCTC

SEQ ID NO: 208542 - protein, 177 aa, Triticum aestivum
  unsure (1)..(177): unsure at all Xaa locations
  Clone ID: PAT_TA_102960.pep
MAAPTSAIGFEGYEKRLEITFSEASIFADPHGRGLRALSRAQIDSVLDLARXTIVSELSNKDFDSYVLSESSLFIYSQKNGIKTCGTTMXLLTIPKILELAEXCACRCXRKYSRGMXXFPGHKLLPKSFSEEXDVLXRSSAPEAGXNAYVIGDQRXWQKWHXYXATXQPDKPWPGKC

SEQ ID NO: 208543 - protein, 239 aa, Triticum aestivum
  unsure (1)..(239): unsure at all Xaa locations
  Clone ID: PAT_TA_102961.pep
TETXXXXHXXXXQXXXXXGXXXXXLXXYXXAALXXXXXIXLXXXXXXXXFXFXXRCHXXPXXXCXIXEGIXXXNPGGXHXTXGEXXGFGXLLXXIPNHXXFXGLPRXXISPXGIKETIXGXXXGHWXXTLXXTXLFPKQXKLVGPXXKXDXXPXHWNXXLGGXXSFXXPXHXXIFEXXGXEXDNXXGLQXNFXFFSKXPWXTXLFLPXGPXSXPLXPXXVSTPLXIXFQXFWPRDNWFE

SEQ ID NO: 208544 - protein, 109 aa, Triticum aestivum
  unsure (1)..(109): unsure at all Xaa locations
  Clone ID: PAT_TA_102962.pep
MAGMAXEGSQVDAXNYXSXIQXELLIQGETDEFFTFXDEVXXXXXDXXXXXNLXXGXDXXXXXKXYAIHERGIGAFFQXGLILXMXXQFXEHGCLPFWILMPWNKGPFG

SEQ ID NO: 208545 - protein, 180 aa, Triticum aestivum
  unsure (1)..(180): unsure at all Xaa locations
  Clone ID: PAT_TA_102963.pep
WIPRAAGIRHQQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLXQXQCNPVSLGXXLVSMILPRXSDCQVMQXQQCCQQLAQDXPARXQCAAXH

SEQ ID NO: 208546 - protein, 182 aa, Triticum aestivum
  unsure (1)..(182): unsure at all Xaa locations
  Clone ID: PAT_TA_102964.pep
MAPKADKKPAAENKVEKAAEKTPAGKKPKAEKRLPAGKTASKEAGGEGKTRGRKKGSKAKKGVETYKIYIFXVLKXVHPDIGIXPSXACXXMNXFINDIFXKLXGESGKLARFNKKPTITFREIQTFXRXVLPXEXAKHAVFEGTXGVNKLHSSKIDCVLLDLALDYLFCWGGEKTLAECHF

SEQ ID NO: 208547 - protein, 124 aa, Triticum aestivum
  unsure (1)..(124): unsure at all Xaa locations
  Clone ID: PAT_TA_102965.pep
WIPRAAGIRHQQQLKAIPXQSRCXAIHNVXHAIILQQQQQLVQATXTQPQQQQQQGQQQQQGLGSSQPQQQTQLDQGWIAVIGTWVIXTIPAMCDXHVPPYCYTTISPSSDVTTRHGRLRRREF

SEQ ID NO: 208548 - protein, 238 aa, Triticum aestivum
  unsure (1)..(238): unsure at all Xaa locations
  Clone ID: PAT_TA_102966.pep
REQKLELHRGGGRSRTSGSPGLQEFGTSQQPQQPFPQQPQQQFPQPQQPQQPFPQQPQQQFPQPQQPQQPFPQPQQPQLPFPQQPQQPFPQPQQPQQPFPQLQQPQQPLPQPQQPQQPFPQQQQPLIQPYLQQQMNPCKNYLLQQCNPVSLVSSLVSMILPRSDCKVMRQQCCQQLAQIPQQLQCAAIHGIVHSIIMQQEQQQQQQQQQQQQXQQGIQIMRPLFQFVQGQGIIQPQQT

SEQ ID NO: 208549 - protein, 214 aa, Triticum aestivum
  unsure (1)..(214): unsure at all Xaa locations
  Clone ID: PAT_TA_102967.pep
XXEXXNGXXXEXXXXSXXEXXXXLXKXXXXXKXXXXXGXDRTXXGAYVXXAXXSRXXXXXLVRAXWXXXXXXXXXRXXXXXXXXXXAXXXKXAXRGXXXAXXXXNLXFPXXXNXSXXXITHXMXSXXXXGXAPXVXXXAXLXVXXXHXXHSXXXRXXXXXSXDPSXSHKLSLPLSLSLSLSLSLSLLVPNSCSPGDPLVLERPPPRWSSSFCSL

SEQ ID NO: 208550 - protein, 166 aa, Triticum aestivum
  unsure (1)..(166): unsure at all Xaa locations
  Clone ID: PAT_TA_102968.pep
MXXHIXKKKXFVSDXVFYAXLXXMLTRELAXDXYXGXEVRVTPXXTEIIXRXXXXHNVLXEKGRXIXELTSVVHXRXDFXXNXVXLYAXXVXNXGXXAIXHAXXLRYKLLLALXXRXACYGVLRFVMXESGAKGCEDIVSXXLKXQXRAKXMKFKDXYHDPMVIPL

SEQ ID NO: 208551 - protein, 180 aa, Triticum aestivum
  unsure (1)..(180): unsure at all Xaa locations
  Clone ID: PAT_TA_102969.pep
MSTEVAAADIPVPQVEVAADAAVDTPAAKPAKAPKAAKAKKSTGPKKPRVTPAHPSYAEMVSEAIAALKERSGSSTIAIGKFIEDKHKAHLPANFRKILLTQIKKLVAAGKLTKVKGSYKLAKAPAAVKPKTATKKKPAAKPKAKAPAKKTAAKSPAKXAAAKPKAXAPTXAKAVAKPKA

SEQ ID NO: 208552 - protein, 224 aa, Triticum aestivum
  Clone ID: PAT_TA_102970.pep
SSSKLTLTKGNKSWSSTAVAAALELVDPPGCRNSARARFFVDNGTYLTEQGRFFLAWYSNNLIKHGDKILDEANKVFLGHRVQLAIKISGIHWWYKAPSHAAELTAGYYNLHDRDGYRPIARMLKRHHASLNFTCAEMRDSEQSSQARSAPEELVQQVLSAGWREGLNVACENALPRYDPTAYNTILRNARPHGINKSGPPEHKLFGFTYLRLSNQLVEGQNYV

SEQ ID NO: 208553 - protein, 175 aa, Triticum aestivum
  Clone ID: PAT_TA_102971.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIQTIPGN

SEQ ID NO: 208554 - protein, 198 aa, Triticum aestivum
  Clone ID: PAT_TA_102972.pep
WIPRAAGIRHEVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGFVASNSKDDPAKEAANFTSQVIIMNHPGQIGNGYAPVLDCHTSHIAVKFAELVTKI

SEQ ID NO: 208555 - protein, 156 aa, Triticum aestivum
  unsure (1)..(156): unsure at all Xaa locations
  Clone ID: PAT_TA_102973.pep
XXVAIVXXXXXXXXXSHPLFXXXGXXLXWXXGVDXHXSXGXXIXLGRVIGFXDGXSISXLLXXHXGXXLXXGXXCXSMFVVXFLVXXKXKXNXIVHXXXLYXSAXAXXFLXXVYXLSXXXXWMXLXLXXXXXXXXXXFXXXPXXFXCRIXXAXGXN

SEQ ID NO: 208556 - protein, 186 aa, Triticum aestivum
  unsure (1)..(186): unsure at all Xaa locations
  Clone ID: PAT_TA_102974.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGIFXDGQTREHALLAFTLGVKQMICCCNKMDATTPKYSKGPXLKKLSXEVSSYLEKXGYNP

SEQ ID NO: 208557 - protein, 176 aa, Triticum aestivum
  unsure (1)..(176): unsure at all Xaa locations
  Clone ID: PAT_TA_102975.pep
MKTLLILTILAMAITIATANMQVDPSGQVQWPQQQPFLQPHQPFSQQPQQIFPQPQQTFPHQPQQQFPQPQQPQQQFLQPRQPFPQQPQQPYPQQPQQPFPQTQQPQQPFPQSKQPQQPFPQPQQPQQSFPQQQPSLIQQSLQQQLNPCKNFLLEQCKPVSLVSXSFWSIILPPKR

SEQ ID NO: 208558 - protein, 160 aa, Triticum aestivum
  Clone ID: PAT_TA_102976.pep
REQKLELHRGGGRSRTSGSPGLQEFGTSTCAALLQQCSPTPYVQSQMWQASGCQLMRQQCCQPLAQISEQARCHAVCGVAQVIMRQQQGQSFGQPQQQQGQSFGQPQQQVPIEIRRMVLQTLPSMCNVNIPQYCTTTPCSTITQTPYNVPMATTCVGGTC

SEQ ID NO: 208559 - protein, 158 aa, Triticum aestivum
  unsure (1)..(158): unsure at all Xaa locations
  Clone ID: PAT_TA_102977.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSXQFGQXGXPYLNTYDGRTXRSQPFXXGNAL

SEQ ID NO: 208560 - protein, 162 aa, Triticum aestivum
  unsure (1)..(162): unsure at all Xaa locations
  Clone ID: PAT_TA_102978.pep
MPALAKPAARPAKPAAAAPKPKPAAAKPKAAAAGAAHPTYFEMIKEAIAALKDRTGSSSVAIAKYIEEKHGKALPPNFKKMLSVQLRASAAKGKLVKVKASYKLSDAAKKDSPKAKPAAKPAKDAAKPKKXAAEKPKKTAAVGTKRKAPEKKNWSPRPKIAG

SEQ ID NO: 208561 - protein, 166 aa, Triticum aestivum
  unsure (1)..(166): unsure at all Xaa locations
  Clone ID: PAT_TA_102979.pep
MPALAKPAXRPXKPVXAAXKXXPAVDKPKXAASGXAHXTYFEMIXKEAIACSRTXTGSSXVAIAXFIGXEITXRLXRPTSKKMLSVQXXRFRRQRAXXXXVKXSYKXXXAXQXGLPXAQARGXXPARTPXXPKKEXXXKXPKKTAXVXXKAQXXRRXXXLGXKGNR

SEQ ID NO: 208562 - protein, 202 aa, Triticum aestivum
  unsure (1)..(202): unsure at all Xaa locations
  Clone ID: PAT_TA_102980.pep
WIPRAAGIRHQGELRYPSYPQSHGWSFPGIGEFICYDKYLQADFKAAAAMVGHPEWEFPHDSGTYNDTPERTRFFVDNGTYLTEQGRFFLAWYSNNLIKHGDKILDEANKVFLGHRVQLAIKISGIHWWYKAPSHAAELTAGYYNLHDRDGYRPIARMLKRHHASLNFTCAEMRDSEQNSXAXSAPEELXQQVXSXAGWKKG

SEQ ID NO: 208563 - protein, 165 aa, Triticum aestivum
  unsure (1)..(165): unsure at all Xaa locations
  Clone ID: PAT_TA_102981.pep
NRXTHXPXXCHHRXXHPXXXXCXSCRDYVXLXITGXDGGXXXVXXHXEXXTEXXHPXDXXXXDEFLXVKXXXXRPVHXSXVXVDXRHXXWRXXVXXGACQXARAWSXXGXRTSXDXXAKXXGEXGXVASHXLXXAAPSXQKXPHXXXQHKERRXXXXRXXTXXET

SEQ ID NO: 208564 - protein, 168 aa, Triticum aestivum
  Clone ID: PAT_TA_102982.pep
CASSKLTLTKGNKSWSSTAVAAALELVDPPGCRNSARAKDDPAKEAANFTAQVIIMNHPGQISNGYAPVLDCHTSHIAVKFAEIQTKIDRRSGKEIEAAPKFLKNGDAGFVKMIPTKPMVVETFAQYPPLGRFAVRDMRQTVAVGVIKAVEKKDPTGAKVTKAAAKKK

SEQ ID NO: 208565 - protein, 90 aa, Triticum aestivum
  unsure (1)..(90): unsure at all Xaa locations
  Clone ID: PAT_TA_102983.pep
SLFEYNGVTVKKKKKNSRGGPVPNSPYSESYYNSLAXVVLQRRDWENPGVTQLNRLAAHPPFASWRNNEEARTDRPSHSCAPEWANGKLA

SEQ ID NO: 208566 - protein, 224 aa, Triticum aestivum
  unsure (1)..(224): unsure at all Xaa locations
  Clone ID: PAT_TA_102984.pep
XFSLFXSSKFTLTKGNKSWSXTAGXGAXEXLGPPGFRNXGXXGXXXXVXSXGAQXRGXFLFGQXXFQGGSXXXLHYLPXLVGQXPPLKLCLXLXCSSXXRGPNXRGXCNPKIXXHAPTGXVXXXPXXNGXSXXXYXPLXPHFQXXWRHXNCXFPRXRXLIXKFWENPLFXXXXXFXGKPXXXXPXGXPXXLGGGEGKXXAFWXXXKXIFFKXXRWGGXKTPGXG

SEQ ID NO: 208567 - protein, 210 aa, Triticum aestivum
  unsure (1)..(210): unsure at all Xaa locations
  Clone ID: PAT_TA_102985.pep
XRXVIXXLCXSXVVXAXIHPXRVHNXHKXHXHXXXWXLXWXXDSXXIAXXXCRXXXDVXXFGPRXCXTXGXXCXXCVRXDXLGXPPVXXSXXXXRXICRKSQVXLXSXNXICVWXXXAXXXXVXSXXPXTSASXSIGXGRIRASRXXXPTXSXSXXXXSKQIRLGERVWVXPEFLXPGGSXXXXXXXXPXXLQIXPFSXXIXXXXXRTXX

SEQ ID NO: 208568 - protein, 179 aa, Triticum aestivum
  unsure (1)..(179): unsure at all Xaa locations
  Clone ID: PAT_TA_102986.pep
WIPRAAGIRHQGASTGVYEALELRDGGSDXLGKGVSKAVNNVNSIIAPALVGKDPTAQTELDNFMVQQLDGTKNEWGWCKQKLGANAILAVSLAXCKXGASVXKIPLYQHIANLAGNKQLVLPVPAFNVINXGSHAGNKLXMHEXMILSTGAXSFKEAMXMGVGVYHNLKAXXKXNTRP

SEQ ID NO: 208569 - protein, 158 aa, Triticum aestivum
  unsure (1)..(158): unsure at all Xaa locations
  Clone ID: PAT_TA_102987.pep
MKTLLILTILAMAITIATANMQVDPSGQVQWPQQQPFLQPHQPFSQQPQQIFPQPQQTFPHQPQQQFPQPQQPQQQFLQPRQPFPQQPQQPXSQQPQQPFPQTQQPQQPFSQSKQPQQPFSQPQQPXQSFPQQQPSLIQQSLXQQVNPCKNXLLQQCK

SEQ ID NO: 208570 - protein, 95 aa, Triticum aestivum
  unsure (1)..(95): unsure at all Xaa locations
  Clone ID: PAT_TA_102988.pep
XWXXXXGKGXXXXXGXXPLXVENXXXXTXVXXXXYSXLVXAXKXXXAXXXXFXFRDCXXGYXAXIXXSFXXSXXXXSXPIKXPQXAYXFXVXGFX

SEQ ID NO: 208571 - protein, 160 aa, Triticum aestivum
  unsure (1)..(160): unsure at all Xaa locations
  Clone ID: PAT_TA_102989.pep
WIPRAAGIRHQTLASSHTPAYRIHPGTDHTENXLXSKDDSGPAXTYPXXXGAXRXXXHXXIXXHXCXVXEXCXXXTXXHXXAMCXFVAIDIFNXKXLXDIVPXXHNCDXPHVXRXXXHLIDITDDGXXSLLTEXXXTXDXLXLXXDDAXLGQXXXGCADX

SEQ ID NO: 208572 - protein, 157 aa, Triticum aestivum
  unsure (1)..(157): unsure at all Xaa locations
  Clone ID: PAT_TA_102990.pep
REQKLELHRGGGRSRTSGSPGLQEFGTRRERERERERERXXXXXRXXXRXXXRXXXXXXXXXXAXPXXCYPKXGARATXXRSXXXXXMXXSKNAXLLPSXAXRLGXPTLCVNGEKAXVPXXTXAXEXXCXGLFXXLXXXYNXXNLVFFFXTXVCPYX

SEQ ID NO: 208573 - protein, 76 aa, Triticum aestivum
  unsure (1)..(76): unsure at all Xaa locations
  Clone ID: PAT_TA_102991.pep
WIPRAAGIGTRREREREREREREREREREREREREREREREREREREXXRERLEGHPPLHQSPLARSTPWVLHKLC

SEQ ID NO: 208574 - protein, 209 aa, Triticum aestivum
  unsure (1)..(209): unsure at all Xaa locations
  Clone ID: PAT_TA_102992.pep
RVVLSPARNYPTKGNKSWSSTAVAAALELVDPPGCRNSAPAXVQQLLQDFFNGKELCKSINPDEAVAYGAAVQAAILSGEGNEKVQDLLLLDVTPLSLGLETAGGVMTVLIPRNTTIPTKKEQVFSTYSDNQPGVLIQVXEGERTRTRDNNLLGKFELSGIPPAPRGVPQITXCFDIDANGILNVSAEDKTTGQKXKITITNDXGXLSK

SEQ ID NO: 208575 - protein, 153 aa, Triticum aestivum
  unsure (1)..(153): unsure at all Xaa locations
  Clone ID: PAT_TA_102993.pep
MFGFGHHHKDQAPPASGPNQIFKIYCRASEDYCLAVRNXEVVLAPVNPKDETQHWLKDMRFSTTVKDEEGMPAFALVNKATGLAXXLHXQSHXXXXXPXXPXYERPLXXXGQKXKVHXXXXXRCIRMXKNTRLXFXXXNGKXDHGXGCTTPVG

SEQ ID NO: 208576 - protein, 85 aa, Triticum aestivum
  unsure (1)..(85): unsure at all Xaa locations
  Clone ID: PAT_TA_102994.pep
MVKFLKPGKDXXLLHGMYAXKKAVIXRXFXEGSRXXPFAHCLXNGAXNXXXKEXRXDXAXXXGMKXPXYVYXKXXXXXHXYHPSP

SEQ ID NO: 208577 - protein, 165 aa, Triticum aestivum
  unsure (1)..(165): unsure at all Xaa locations
  Clone ID: PAT_TA_102995.pep
MPPKLDPSQIVEVYVRVTGGEVGAASSLAPKIGPLGLSPKKIGEDIAKETAKDWKGLRVTVKLTVQNRQAKVSVVPSAAALVIKALKEPERDRKKVKNIKHNGNISLDDVIEIAKIMKVRSMAKEMAGTVKEILGTCVSVGCTVDGKDPKDLXQTEIDDXXVEIP

SEQ ID NO: 208578 - protein, 151 aa, Triticum aestivum
  unsure (1)..(151): unsure at all Xaa locations
  Clone ID: PAT_TA_102996.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVDSSDTIDNVKAKIQDKEGIPPDQQXRLIFAXKQLXDGRXLXDYNIQKESTLYLXLRFR

SEQ ID NO: 208579 - protein, 156 aa, Triticum aestivum
  Clone ID: PAT_TA_102997.pep
MKKFLVLALIVIAATTTAAEPFTAFRIASEPQHPSSPEQQPTLQPQEHPVPHQKLNPCRDALLHQCSPVADMSFLRSQVVQHSSCLVMWEQCCQQLKAIPKQSRCEAIHNVVHAIILQQQKQLVQGTSTQPQQQQQQGQQEHGQGSSQPHTNNNNS

SEQ ID NO: 208580 - protein, 160 aa, Triticum aestivum
  unsure (1)..(160): unsure at all Xaa locations
  Clone ID: PAT_TA_102998.pep
TKAXLXTTXXLXXPXSXXXIXXXGXKXMSISRTFXDXXXXQXXSXPMCXXTXXLXKHXWXXLXXEMXLPSGAXPXXXISLXXTQKXPPSLKAXXASXXIXXKPXXLALXGGGFKKPTYYXGLXNLPFHRAXWXXFFGFXRXPLFFFGCWXXKKKNXXFFX

SEQ ID NO: 208581 - protein, 146 aa, Triticum aestivum
  unsure (1)..(146): unsure at all Xaa locations
  Clone ID: PAT_TA_102999.pep
XKYGNXVPKGGXTYVPXNXQXESKXXXXFGXYXAXKIRGXAPLKRKPSXCPGXXXXXFLSXXXEXWIEXXESXKXGPIHCAQEXILIILGXRKXXKGSXNEXPPXEXXYLXXVYXXAWTKFXXXXXVXVXSDKKXAXSIPRXXSQL

SEQ ID NO: 208582 - protein, 177 aa, Triticum aestivum
  unsure (1)..(177): unsure at all Xaa locations
  Clone ID: PAT_TA_103000.pep
NIRGGHEERCAXNDPFXXTXLMTXMFKYXTVXXXHWKHXDIXLKDDKTLLFGXEKPFTVFXVRNPXEIPXGEXGARLPLWMSTGVFTDXGXXXCSLXKGGAKKVXISXPIKXXPXCLRVGXKXRTKYTSXLTXXLXMLXCTXXXXLLPXQXIIXDXFGIIXGXXTTVXCITGXQXTC

SEQ ID NO: 208583 - protein, 156 aa, Triticum aestivum
  unsure (1)..(156): unsure at all Xaa locations
  Clone ID: PAT_TA_103001.pep
WIPRAAGIRHQALPRYDPTAYNTILRNARPHGINKSGPPEHKLFGFTYLRLLNQLVEGQNYVNFKTFVDRMHANLPHDPCVDPVAPLQRSGPELTIEMILQAAQPKLDPFPFEEHTDLPVQGLGGIGGDVEXPTGGMGGEVQDPTGSMGGELPATV

SEQ ID NO: 208584 - protein, 235 aa, Triticum aestivum
  unsure (1)..(235): unsure at all Xaa locations
  Clone ID: PAT_TA_103002.pep
RRAGRAALSGXPGKWAHLEGLTGGRTTNEASTKQESKPALDCCRPSXARERAGPRARPGSDACLLFPGLESLGKGHPVIXALPVGQLPRCLGVNFFKPPGCLGLPGAGPNLXGLWAAFYLFSRXGLFCWNRFPGXGGLWGPXWPGAAXFPVGFXSXGDLFTKKLTLLTPGXKANPPARGRPRXPXFWNQRPXGAGVLRSKGREHLKERRAXPALTKAQGGFENKVRAPTPRAMRW

SEQ ID NO: 208585 - protein, 201 aa, Triticum aestivum
  unsure (1)..(201): unsure at all Xaa locations
  Clone ID: PAT_TA_103003.pep
WIPRAAGIRHQIVSASRDRTIKLWNTLGECKYTIGGDLGGGEGHTGWVSCVRFSPNNFAPTIVSGSWDRSVKVWNLTNCKLRCTLDGHGGYVSAVAVSPDGSLCASGGKDGVTLLWDLTEGKRLYSLDAGSIINSLCFSPNRYWLCAATQDSIKIWDLESKHIVQDLRPEVPVFTKQMLYCTCLSWSADGXTLYAXYTDGX

SEQ ID NO: 208586 - protein, 159 aa, Triticum aestivum
  unsure (1)..(159): unsure at all Xaa locations
  Clone ID: PAT_TA_103004.pep
WXPRAAGXRHQXFQLXXXXPSNXXXXXXXNGXGNXEVXQRXQXXXDSCXXRTXXXGPIXPPXXXLXXTVTEXXTRTTPSXLXXXSXWKXXXDQCLXCXHXTXKXXTXXGXXXXXXXVXXXXWXXXSXXVXRXXYXXXGLXXXXLTXPXXXXGXXXXLXR

SEQ ID NO: 208587 - protein, 169 aa, Triticum aestivum
  unsure (1)..(169): unsure at all Xaa locations
  Clone ID: PAT_TA_103005.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAXSIPEKNISWLTXLXHNXALGQI

SEQ ID NO: 208588 - protein, 172 aa, Triticum aestivum
  Clone ID: PAT_TA_103006.pep
PFANPTKGNKSWSSTAVAAALELVDPPGCRNSARGGMGAGRKLKTHRRNQRWADKAYKKSHLGNEWKKPFAGSSHAKGIVLEKIGIEAKQPNSAIRKCARVQLVKNGKKIAAFVPNDGCLNFIEENDEVLIAGFGRKGHAVGDIPGVRFKVVKVSGVSLLALFKEKKEKPRS

SEQ ID NO: 208589 - protein, 149 aa, Triticum aestivum
  unsure (1)..(149): unsure at all Xaa locations
  Clone ID: PAT_TA_103007.pep
MASKRILKELKDLQKDPPTSCSAGPVGEDMFHWQATIMGPSDSPFTGGLFLVNIHFPPDYPFKPPKVSFRTKVFHPNINSNGSICLDILKEQXWSPALTISKVLLSICSLLTDPNPDDPLVPEIAHMYKTDRXPKYEXTARXWTQKYAM

SEQ ID NO: 208590 - protein, 143 aa, Triticum aestivum
  unsure (1)..(143): unsure at all Xaa locations
  Clone ID: PAT_TA_103008.pep
MAPKAEKKPAAAEKTPAAEKTTAGKKPKAEKRPPKSKEGGADKKKKKAKKSVETYKIYIFKVLKQVHPDIGISSKAMSIMNSFIXNDIFEKLAGESAKLAXYNKKPTITSREIQTSVRLVLPGELAKHAVSEGTKAVTKFTSS

SEQ ID NO: 208591 - protein, 82 aa, Triticum aestivum
  unsure (1)..(82): unsure at all Xaa locations
  Clone ID: PAT_TA_103009.pep
LIXPSSILTLTKGNKSWSSTAVAAALELVDPPGCRNSAPGEREREREREREREREREREREREREREEEIAFRNNFFLVHLG

SEQ ID NO: 208592 - protein, 303 aa, Triticum aestivum
  unsure (1)..(303): unsure at all Xaa locations
  Clone ID: PAT_TA_103010.pep
RPXFXSXWSXPXTXXGXXVPSXXXLXSXFLFXXXXXXFXXXXGLPXSXXXXXPXXXXPSXLXLPPXXSXXAXPFAFVXXPSXYXXAPXSPSXXXWXPXSXPXACXXCFPXSXXXXLLPPXIXFLXPFGPLXALXXAQSSXCVLXLXLPLPXXLXFPXXPVXQXVSXLLPXXLVSLXXRAERXSPMVLSWXXXXKALLLXFIVXSSPPPXXXSPPPXXXFPLXXFPXXXXPXXXVSXXXXFPXXXXXVXPFXXSXXLFFFXPFFXXKRGFFSQKXXFXXQXGXFFPXKXXXXXXPSLLSXXXXL

SEQ ID NO: 208593 - protein, 98 aa, Triticum aestivum
  unsure (1)..(98): unsure at all Xaa locations
  Clone ID: PAT_TA_103011.pep
AEKKKKKNSRGGPVPNSPYSESYYNSLAVVLQRRDWENPGVTQLNRLAAHPPFXSWRXNSEXARTDRPSQQLRSLNGEWQIVSVNLLKFALNFCKSHF

SEQ ID NO: 208594 - protein, 79 aa, Triticum aestivum
  Clone ID: PAT_TA_103012.pep
LKSKLDNPTKGNKSWSSTAVAAALELVDPPGCRNSARKQEYARADGGDGCGRHGPRPTLRLLRGLADEQRRKRIAKGNT

SEQ ID NO: 208595 - protein, 164 aa, Triticum aestivum
  unsure (1)..(164): unsure at all Xaa locations
  Clone ID: PAT_TA_103013.pep
MKTFLIFALLAIAATSAIAQMETSRVPGLEKPWQQQPLPPQQQPPCSQXQQXFPQXHQPXXLWNHXXFSEEQQPVLPQQQPVIILQQPPFSQQQQPVLPQQPPFSQQQQQQQQQQPPFLXEQQPXXPQQPPFLXKQQPPFFXGGQPFXQXPFFQXPKXFQXQXL

SEQ ID NO: 208596 - protein, 289 aa, Triticum aestivum
  unsure (1)..(289): unsure at all Xaa locations
  Clone ID: PAT_TA_103014.pep
NXXXXXXGXKXXXKXWXXXGGXXXXXXGXXXXXXXXXXXXXKXXEKXRVXXXFXKNPAXXKXLGXTLWKKXXKKXGEXNDXRXGWXALGTKXXXPGXHEFXGXEKIEGXXRXXMXXXAXPHXXXGXXGXAXXGXXSGXXGXXXXXGXXKXRXQRIXXXXDXXXHRTXXRXSKKXXXXXEGXXRXEXRTGXRSGXXXKETXXRXGRWXRXXGSXXGXMXXXXXXXKRXLSIXLXXRTXQREXXXXWXXLSGXXVGXXKKXKXDXXCRKXXXXSXPGXXXGXXSXXXVYAX

SEQ ID NO: 208597 - protein, 209 aa, Triticum aestivum
  Clone ID: PAT_TA_103015.pep
REQKLELHRGGGRSRTSGSPGLQEFTRKTGNKDFLELSNLLVGNVGLIFTKGDLKEVREEVAKYKVGAPARVGLVAPVDVVVPPGNTGLDPSQTSFFQVLNIPTKINKGTVEITIPVELIKKGDKVGSSESALLAKLGIRPFSYGLVICNVYDSGSVFSPEVLDLTEEDLMDKFASGVSMVASLSLAISYPTMAAAPHMFLNAYKNVLA

SEQ ID NO: 208598 - protein, 214 aa, Triticum aestivum
  unsure (1)..(214): unsure at all Xaa locations
  Clone ID: PAT_TA_103016.pep
FASSKLTPLGTPGQVDLRTSGSGLQEFGSXNMXGPXNAVXXKTXXYLAXSTXAEXIXXIXLXXXEAXXXRXQTQPXFARGLXDGAXKGIKAEGAGXIYKGXXXXWXXXIXYTXMKXASFXTIXXLIXXHAXXXPKXECXXACQXGXXFAGGYIAXXFWXIVSHSADNXVSFLNNAKGAIXXEAXNXXVLXGLFXXGXPXRVXXIGTVTGAXTXN

SEQ ID NO: 208599 - protein, 169 aa, Triticum aestivum
  Clone ID: PAT_TA_103017.pep
WIPRAAGIRHQAFTATSAVAQLYTTCSQGYGQCQQQPQPQPQPQPQMNTCAAFLQQCSQTPHVQTQMWQASGCQLVRQQCCQPLAQISEQARCQAVCSVAQIIMRQQQGQSFGQPQQQVPVEIMRMVLQTLPLMCRVNIPQYCTTTPCSTITPAIYSIPMTATCAGGAC

SEQ ID NO: 208600 - protein, 152 aa, Triticum aestivum
  unsure (1)..(152): unsure at all Xaa locations
  Clone ID: PAT_TA_103018.pep
PXAVXXHARPXPXXXXXYRSXAXHLTRYMXXGXGRQXXWXXGSTTRKGXXSGSXXXXLQMAIQDXRRPXGLPHWRXRPPRLGRSNGXLXHPXXVGPXXLITKXXSXASDGXQGRCQXXTLYXKLSTTTDLTFXXFFXXXDXXGSARLHHXXA

SEQ ID NO: 208601 - protein, 151 aa, Triticum aestivum
  unsure (1)..(151): unsure at all Xaa locations
  Clone ID: PAT_TA_103019.pep
MKTLLILTILAMATTIATANMQVDPSGQVQWPQQQPFPQPQQPFCQQPQRTIPQPHQTFHHQPQQTFPQPQQTYPHQPQQQFPQTQQPQQPFPQPQQTXPQQPXLPFXQQPQQPFXQPXQXQQPFPQSQQPQQPFTXXQQXFPXXXQPXQS

SEQ ID NO: 208602 - protein, 202 aa, Triticum aestivum
  unsure (1)..(202): unsure at all Xaa locations
  Clone ID: PAT_TA_103020.pep
RVRFHLLEKELHRGGRSRTSGSPGLQEFGTRRGAPLAKVTFRHPFRYKHQKELFVAAEGMYTGQFVYCGRRATLSVGNVLPLRSVPEGGVICNVEHHVGDRGVFARASGDYAIVISHNPDNGTSRIKLPSGAKKIVPSSCRAMIGQVAGGGRTEKPMLKAGNAYHKYRVKRNSWPXVRGVAMNPVEHPHGGGNHQHIGHAFT

SEQ ID NO: 208603 - protein, 162 aa, Triticum aestivum
  unsure (1)..(162): unsure at all Xaa locations
  Clone ID: PAT_TA_103021.pep
MKTXXXFXLLXXXXTXAIAQMXTSXIPGLERPWQXQPXQQXETFPQXPPSSQQQQPFSQQPPFLQXQPSFSXQPLFXQKQQPGLPXQPAFSQQQQTXLXQQPAFSQXQHQQLXEQQIPXGHPSIXXQXNPCKVFLQQXCXPCGNAQHXARSQMWXQXNCXXM

SEQ ID NO: 208604 - protein, 204 aa, Triticum aestivum
  Clone ID: PAT_TA_103022.pep
LASSKLTLTKGNKSWSSTAVAAALELVDPPGCRNSARGLTNQDKNKYNTPKYRFVVRFTNKDVTAQIVYATIAGDIVMAAAYSHELPRYGLEVGLTNYAAAYCTGLLLARRVLKNRDLDEEYEGNVEATGEDFSVEPSDERRPFRALLDVGLIRTTTGNRVFGALKGALDGGLDIPHSDKRFAGFKKDEKSLDAEIHRKYIFGG

SEQ ID NO: 208605 - protein, 193 aa, Triticum aestivum
  unsure (1)..(193): unsure at all Xaa locations
  Clone ID: PAT_TA_103023.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGXLFMANXGPNTNGXQFFICTVPCNWLDGKHVVFGEVVEGMDVVKNIEKVGSRSGTCSXQVVIADCGSSNPPRAVAFAVSSPPPCRVVDLI

SEQ ID NO: 208606 - protein, 243 aa, Triticum aestivum
  unsure (1)..(243): unsure at all Xaa locations
  Clone ID: PAT_TA_103024.pep
REQKLELHRGGGRSRTSGSPGLQEFGTRATTMATXNMQVDPSGQVQWPQQQPFPQPQQPFWQQPQRTIPQPHQTFHHQPQQTFPQPQQTYPHQPQQQFPQTQQPQQPFPQPQQTXPQQPQLPFSQQPQQPFPQPQQPQQPFAQSQQPQQPFPXPQQQFPQAQQPQQSFPQQQQPAIQSFLQQQMNPCKNFLLQQCNHVSLVXSLVSIILPRSDWQVMQQQWCXQLRQILKKFRXXAFTGVGIH

SEQ ID NO: 208607 - protein, 210 aa, Triticum aestivum
  unsure (1)..(210): unsure at all Xaa locations
  Clone ID: PAT_TA_103025.pep
WIPRAAGGXHEXTXXADXPLXXPXHXLGTSXNMSTGDPXLPRPEXLRRQPXAXXRLXWXXPRPXAXXXXAAXIPTLAKREDAACGRXRTXTXPGRRLHYVHXXLXXTTSLXXXQTIXLHGPEXHXLXXXTPXXXXKXXPPFRPXLWXXNXXXKXXXXXKXFSXPXGXXKPLXWXXKXPLXSXXXXGXXAFAXXLXPXXXWXXXXXXXXSX

SEQ ID NO: 208608 - protein, 198 aa, Triticum aestivum
  unsure (1)..(198): unsure at all Xaa locations
  Clone ID: PAT_TA_103026.pep
LXXTXXILTILAXATTIGTGXMXXDXSRXLQWPHXQPPXQSXXRFSXXPXXXFXQXXXKXPGINYNNHFXQPEXXLPRRPHQQXDKXXXPQEPXXQXXQXELPFPXXPXQPXXHPQXXXHPFPXXXXPHQPFAXXXQQXPEAQQPQXLFXXQXXXXMIQSXLQQQXMNPCWNFLLXQCNPVSLXXSLXXMILPXMIGT

SEQ ID NO: 208609 - protein, 217 aa, Triticum aestivum
  unsure (1)..(217): unsure at all Xaa locations
  Clone ID: PAT_TA_103027.pep
WIPRAAGIRHQSILMQRHIMVDGKVRTDKTYPAGFMDIISIPKTGENYRLLYDTKGRFRLHSVKDEDAKFKLCKVRSVQFGQKGIPYLNTYDGRTIRYPDPLIKANDTIKLDLETNKIVDFIKFDVGNVVMVTGGRNTGRVGVIKNREKHKGTFETIHVEDAQGHQFATRLGNVFTIGKGTKPWVSLPKGXGXKLTIIXEQKEAGLPLPLLPRPDER

SEQ ID NO: 208610 - protein, 243 aa, Triticum aestivum
  unsure (1)..(243): unsure at all Xaa locations
  Clone ID: PAT_TA_103028.pep
REQKLELHRGGGRSRTSGSPGLXEFGXSHRXXXXXXXGACXWXQXLXAXGPXXIXCSSXLPXLSHXXFXITTXXXXXFPVXTITMXXXXSATTXXSXXXTRASXILAXXXXIHXXXLIXXHNRXEIIXSXAXYXXVDHKILATXXMVIEXSIHDXXXLXRXXXYXMXLVXWSXXLPNXXCXXXXRXGVXFNIXXXHPSXGLXXPAXSGGXSXXXXSLXXXXGCREXXXPXXFGXARXLVXFSP

SEQ ID NO: 208611 - protein, 238 aa, Triticum aestivum
  unsure (1)..(238): unsure at all Xaa locations
  Clone ID: PAT_TA_103029.pep
LEINPTKGNKSWSSTAVAAALELVDPPGCRNSAREQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQXQQCCQQLAQIPQQLQCAAIHSVVHSIIMQQEQRQGVQIRRPLFNXXGXGIIQPQQPAQLEVIXSLXLRTLPTMCNVMSN

SEQ ID NO: 208612 - protein, 241 aa, Triticum aestivum
  unsure (1)..(241): unsure at all Xaa locations
  Clone ID: PAT_TA_103030.pep
REQKLELHRGGGRSRTSGSPGLQEFGTSSHEWNLVNKQKPIWMRKPEEINKEEYAAFYKSLTNDWEEHLAVKHFSVEGQLEFKAVLFVPKRAPFDLFDNKKKANNIKLYVRRVFIMDNCEELIPEYLSFVKGIVDSKDLPXNISRETXQQNKILKVIRKNLVKKCIELFFEIAENKEDYNKFYEAFSKNLXLGXHXDXQNRTKIAELLRXHSTQSGDELTSLKDYVXRMKEGQNEIYYLLV

SEQ ID NO: 208613 - protein, 72 aa, Triticum aestivum
  Clone ID: PAT_TA_103031.pep
WFLLFRLEINPTKGNKSWSSTAVAAALELVDPPGCRNSAGIHSPAHGGLGPQLFHHTLNFHNTAMTTLEDIL

SEQ ID NO: 208614 - protein, 238 aa, Triticum aestivum
  unsure (1)..(238): unsure at all Xaa locations
  Clone ID: PAT_TA_103032.pep
REQKLELHRGGGRSRTSGSPGLQEFGTRDSRYNRPRGRGNGYYGFGNESQDGTIELNRGPRSGRFKNQKAFGHTVTIAVKGQTLPSSENKNASDIPDKAQFNLEDFPVQYDDAKFFVIKSYSEDDIHKSIKYNVWASTTNGNKXLDAAYQEAXAKGSSCPIFLFFSVNTSGQFVGVAEMTGPVDFEKTLEYWQQDKWXXSFSVKWHIXKDVPNNILKHIVLENNEGKPVTNSRDTXDX

SEQ ID NO: 208615 - protein, 225 aa, Triticum aestivum
  unsure (1)..(225): unsure at all Xaa locations
  Clone ID: PAT_TA_103033.pep
REQKLELHRGGGRSRTSGSPGLQEFGTRQPXXXXXXPPXLXXQXXXYXXSXXLXXLIPCXVLLXXQCXPVAMPXSXARXXXXXXXXXXXXQHXCXQQXPRIPXXSRXDAIXXIXYSIVLQEQHPXXGXNQXXQXQPLXSVQGVXXPHQQXXXIGQXSFQRPTXXXXXPWPXPXPXXXGTLFATHXIACXXXRTXIALXTXAMMCSVNXPXYXTXTNXPFNCLLKM

SEQ ID NO: 208616 - protein, 257 aa, Triticum aestivum
  unsure (1)..(257): unsure at all Xaa locations
  Clone ID: PAT_TA_103034.pep
LWXPSIXXHLPXVASSIFPXQVXTSSPFSFSXFXTVLFSXFFXFTXDVXLHSXFXGXRSHAHXWKPNXXCGPMFHQXPXQXYEPSXDLXXXPTXMXXWLHXXXAWFFEKXGASAXVGAAMDQRDLDXGALGFXAWSPGVCXEHXXGYXWXXRRXRIXWWGAWPSSCATXXADXAGQXXEGPLXVAPXRSXSAXRGGGXNSEXXGGRRGXFXGXVRRHQVLVPNSCSPGDPTSSRAAATAVELXLXSXXXGYXSXGLX

SEQ ID NO: 208617 - protein, 153 aa, Triticum aestivum
  unsure (1)..(153): unsure at all Xaa locations
  Clone ID: PAT_TA_103035.pep
AXPXTLXIXNSXLNXTXIXXXSXPXPXRTXXAXXXXXPDPXXLLAPXPIXPRGXXLLXHXSPXXPHRXXXXPXLCXXXXXXXXGRXXXXXCXXFXLXXQNXXLVXVXXKXXXXXGXXXXTYXLNXCXXXXQXXPVXIXTXXXPXXXXXDIXST

SEQ ID NO: 208618 - protein, 113 aa, Triticum aestivum
  unsure (1)..(113): unsure at all Xaa locations
  Clone ID: PAT_TA_103036.pep
RXNPRPSCGLAXXXRATIIXDACXXGFPXCXVHLFGPLMRQPPPPPMPRVVRRSPVTDGMGILKMVMWMLCNRSQPLILYFGEASTAVPTKLRARLCLVTRRNSGGKKMRPEL

SEQ ID NO: 208619 - protein, 144 aa, Triticum aestivum
  unsure (1)..(144): unsure at all Xaa locations
  Clone ID: PAT_TA_103037.pep
VYFFPDKNQTHXCXEGQRXXQPETXELXQXMXXXXXYLXXXXIXKRERAVVXXXCSXWXXKQXLGXMWEAXVXAXVXPLXIXYRAXHXXDXSXVXSGXRSQXXXXXSNGXXXXXXEFXQPXGXXSSRXSXXRGGAPAFVPFSEG

SEQ ID NO: 208620 - protein, 151 aa, Triticum aestivum
  unsure (1)..(151): unsure at all Xaa locations
  Clone ID: PAT_TA_103038.pep
MVKAVAVLTGSEGVKGTIFFTQEGDGPTTVTGSVTGLKEGLHGFHVHALGDTTNGCMSTGPHFNPAGHVHGAPXDEIRHXGDXXNVKXGTDGVANINGTDWHIXLTGPNSIVGRAVVVHGDADDLXKGGHELNKXTGNXGARVXCGIFXXK

SEQ ID NO: 208621 - protein, 161 aa, Triticum aestivum
  unsure (1)..(161): unsure at all Xaa locations
  Clone ID: PAT_TA_103039.pep
MAGRKGGERKKSVTRSVKAGXXFPVGRIGRFLKKGRYAQRVGSGAPVYLAAVLEYLAAEVLELAGNAAKDNKKTRIVPRHLLLAVRNDQXELGRLLAGXTIAHGGVIPNXNPVLVPXKFPPPPXKRRPXKSXKKXRAGQPPKKPPAEVTLLLRPEPCRGCL

SEQ ID NO: 208622 - protein, 180 aa, Triticum aestivum
  unsure (1)..(180): unsure at all Xaa locations
  Clone ID: PAT_TA_103040.pep
MKTFLVFALLTVAATSAIAQMETRCIPGLERPWQQQPLPPQQTFPQQPLFSQQQQQQLFPQQPSFSQQQPPFWQQQPPFSQQQPILPQQPPFSQQQQLVLPXQPPFSQXQQPGLPSQQSPFPQQQQQHQQXLVQQQIPXVVKPXILXELKPMQGISFKQASASPVAMPQRLARSQMLQAR

SEQ ID NO: 208623 - protein, 160 aa, Triticum aestivum
  unsure (1)..(160): unsure at all Xaa locations
  Clone ID: PAT_TA_103041.pep
IQSFLAVSPLFPFXDXXXVIXXAXXAXXKNXTXXKXSXRGXDLHXXLIXYTXDXVHXFXAXAXXXFKXXLXKXPXXXAIXXXQXEKRXSXXXKPELVXXXLXDMXIALEMIGWXTGGQKRXXXIPXANYTGTVGAFLGQVFIXYLSFKXXKAXVCDXHYH

SEQ ID NO: 208624 - protein, 82 aa, Triticum aestivum
  unsure (1)..(82): unsure at all Xaa locations
  Clone ID: PAT_TA_103042.pep
CLXXSSKLTLTKGNKSWSSTAVAAALELVDPPGCRNSAXDXMTAAFYATLNLSIQSADADLIITALVNTGNEDGSGLAIQML

SEQ ID NO: 208625 - protein, 139 aa, Triticum aestivum
  unsure (1)..(139): unsure at all Xaa locations
  Clone ID: PAT_TA_103043.pep
MARGLKKHLKRLNAPSHWMLDKLGGAFAPKPSSGPHKARECLPLILILRNRLKYALTYREVQSILMQRHIMVDGKVRTDKXTYPAGVMDIIFISXTXENFQAXFLTKGSVSPTFGLRILKQTFKGERGCCHNFAPKGPP

SEQ ID NO: 208626 - protein, 206 aa, Triticum aestivum
  unsure (1)..(206): unsure at all Xaa locations
  Clone ID: PAT_TA_103044.pep
HPCXXPXKLTXAHRDEXXKRDNLPVFHXPKLXLPKNXXFXLXASPLAEXXXLLXXPNXXASXLEXSLTMLPPXXKSXTXWRIHSMHCXIPFXGXQHVLSSQKHGIEVXWXIHXXQCLLXXXKXLSPXXXXXXXXXXLXXIXFXXGXFPKXKGSFXXXPXLXPFCQTXFXXGXTLLPFVXWGXGNCPLEXXLFFGGXFXGVLAXKXX

SEQ ID NO: 208627 - protein, 138 aa, Triticum aestivum
  unsure (1)..(138): unsure at all Xaa locations
  Clone ID: PAT_TA_103045.pep
MATQISKKKKFVSDGVFYAXELNEMLTRELAEDGYFGVEVRVTPMRTEIXIRATRTQNVLGEKGRXIKELTFVVXKRXNFXENGVELYAEKVXTRGXCAIAKPESLXXKLLGXLAVPRLAXGXLPFVLEXXLKGLKAF

SEQ ID NO: 208628 - protein, 109 aa, Triticum aestivum
  Clone ID: PAT_TA_103046.pep
FFLLEINPTKGNKSWSSTAVAAALELVDPPGCRNSARERERERERERERERRERRFRNHWPFRWPFFMFVPFSYHFMFDSLLKFFPFFLPIFFPFQFFPFFPLFFFFGF

SEQ ID NO: 208629 - protein, 170 aa, Triticum aestivum
  unsure (1)..(170): unsure at all Xaa locations
  Clone ID: PAT_TA_103047.pep
MKTFLILALLAIVATTATNAVRVPVPQLQPQNPSQQQPQEQVPLVQQQQFLGQQQPFPPQQPYPQPXPFQXQQXXLQXQPFSXPQLXYWQPQPFXPQQPXPQPEPQXXETTTTILQQQQQQQQQQQQQQQQQQEQQILQQIXXQQLIPCXXVXXKQHNISAXXITSLQQK

SEQ ID NO: 208630 - protein, 116 aa, Triticum aestivum
  Clone ID: PAT_TA_103048.pep
REQKLELHRGGGRSRTSGSPGLQEFGTSAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 208631 - protein, 106 aa, Triticum aestivum
  unsure (1)..(106): unsure at all Xaa locations
  Clone ID: PAT_TA_103049.pep
MGXSQEFXFSFALTAAQVNALGLLPVYAKELIAGGALXHCQRXVLATXXGKXXXRXTTQGLNXXXMSNXEEAXPYEGVXSXYXXNGXSXXXTGXYAXLXYMXYXLL

SEQ ID NO: 208632 - protein, 145 aa, Triticum aestivum
  unsure (1)..(145): unsure at all Xaa locations
  Clone ID: PAT_TA_103050.pep
MARTKQTARKXTGXKAPXKQLXTKAARKSAPATGGVKKPHRFXXXTVALREIRKYXKSTELLIXKLPFQXLXREIAQDFKTDLRLQXXXXFALXXAAEAYLVGLFEDTNLCAIHAKRXTXMPKDIQLAAASASAPRCMRPSAPEC

SEQ ID NO: 208633 - protein, 124 aa, Triticum aestivum
  Clone ID: PAT_TA_103051.pep
REQKLELHRGGGRSRTSGSPGLQEFGTSTILGFKRSKSNQYESTSLVQVEGVNTKEDVAWYAGKRLAYVYKAKTKSNGTHYRCLWGKITRPHGNSGVVRAQFKSNLPAESMGRKVRVFMYPSSI

SEQ ID NO: 208634 - protein, 116 aa, Triticum aestivum
  unsure (1)..(116): unsure at all Xaa locations
  Clone ID: PAT_TA_103052.pep
WIPRAAGIRHQXMXHXLXXXPSXTMXPXXXXXXSXLXTXMXXXXHTXXPHXXSXXXXXPXVEHIXXAXXXDXYXXXLCLLLXPXXXAAXQXXXXXXXXXXXXXXQGSEPXCWXXXT

SEQ ID NO: 208635 - protein, 104 aa, Triticum aestivum
  Clone ID: PAT_TA_103053.pep
VTFLEINPTKGNKSWSSTAVAAALELVDPPGCRNSAPARAKKTEGELFESEKEATKNLPDFKKDDQKAIDAELMKAIDAVPDLKNYLGARFSLRDGDKPHEMTF

SEQ ID NO: 208636 - protein, 193 aa, Triticum aestivum
  unsure (1)..(193): unsure at all Xaa locations
  Clone ID: PAT_TA_103054.pep
IVXXCIFSLLQGSRSXVXVETXAPVTXAMALAGXGXSXGWSXSGSXXXXXXXQRXXGLCRPXXSXXXXALXXISASLXSYERXISERXGXNGXXXATGTVXXAXGXXXXXXXXXSXXXLXXXXXXQRVXXRXXKICXDXXMDLHRVRRXXXXXXXGCNXLXXRXXLVPNSCSPGDPLVLERPPPRWSSSFCSL

SEQ ID NO: 208637 - protein, 171 aa, Triticum aestivum
  unsure (1)..(171): unsure at all Xaa locations
  Clone ID: PAT_TA_103055.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADEKFVHKHTKPGIXFMGNAGPNTNXFQFFICTVPCNWLDGKHVVFGXVVXGIDVVKNIRRRWASASGHLPKQGRSADLGA

SEQ ID NO: 208638 - protein, 90 aa, Triticum aestivum
  unsure (1)..(90): unsure at all Xaa locations
  Clone ID: PAT_TA_103056.pep
MRECIFFXIMTVXHXGTAXXCXEXYCLXHXIXPXXXMXXXXXXGXXXDAXXXFFXXTXXGXXTXGXDFIDXDPXXXDXXXTGXHXPXXSP

SEQ ID NO: 208639 - protein, 107 aa, Triticum aestivum
  unsure (1)..(107): unsure at all Xaa locations
  Clone ID: PAT_TA_103057.pep
TNPPKGNKRWXXTXXXGRSIXXXXXXLXELITXPNXLSLSLTCGLPTPHAXVXFRRADHXLTXXXXVXXYXVXXILNHIRTQPXXHILSIXXXNXTXLCTSIAXXXP

SEQ ID NO: 208640 - protein, 174 aa, Triticum aestivum
  unsure (1)..(174): unsure at all Xaa locations
  Clone ID: PAT_TA_103058.pep
MLVYQDKLSGDELLSDSFPYRELENGVLWEVDGHWVVQGAVDVDIGANPSAEGGGDDEGVDDQAVKVVDIVDTFRLQEQPAFDKKQFISHMKRYIKNLSXKLEGDDLXAFKKNVEXXTKYXXSKLKGPXXFXWQKXSXKXGGXGXPLLXXGXXGDPTFLXFAHGLKRGVLNRTC

SEQ ID NO: 208641 - protein, 131 aa, Triticum aestivum
  unsure (1)..(131): unsure at all Xaa locations
  Clone ID: PAT_TA_103059.pep
HXXMXYGPSXGXLXPDXXTLXXVQAXQNXMLCRHXPLRXXNXGIDEXHXXXFKSXXXXXNXXXXXKXXMVXXXXTSXXIXGXKSISDXXXXXXXXHXXXFXXRHXRXXXXSXXENRXXXFWCRIPAARGIH

SEQ ID NO: 208642 - protein, 327 aa, Triticum aestivum
  unsure (1)..(327): unsure at all Xaa locations
  Clone ID: PAT_TA_103060.pep
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXKGGFLKKAXRGCRGXPXPGPAFRFAPENFSPWXRPPGGGEIPPTLRFSPXERPGPPAPHPPPGWGRAFPXRPFFLVFPPPFF

SEQ ID NO: 208643 - protein, 116 aa, Triticum aestivum
  unsure (1)..(116): unsure at all Xaa locations
  Clone ID: PAT_TA_103061.pep
WIPRAAGIRHQGXRXNSXSLPNXYGGXGHLGGXSRHTXGRXLVTGLPXSASWXDLXXHXXXAXDVCXXXVYXEXGGXXGXAXYXYXXDXXXAXXKLXDTXSXNAFSTXXIXXTEYA

SEQ ID NO: 208644 - protein, 198 aa, Triticum aestivum
  unsure (1)..(198): unsure at all Xaa locations
  Clone ID: PAT_TA_103062.pep
MKTFLIFALLAVAATSAIAQMENSXSLVWRDHRQQPFCQQPQQTIPQPHQTFHHQPQQTYPHQPQQQFPQTQQPQQPFPQPQQTFPQQPQLPFPQQPQQPFPQPQQPQQQFPQSQQPQQPFPQPQQQFLQPQQPQQSFPQQQQPLISAXLQQQMNPCKNFLXQQCNPVSLVSSLISMILPRSDWQVMQQQCXXQLAQI

SEQ ID NO: 208645 - protein, 192 aa, Triticum aestivum
  unsure (1)..(192): unsure at all Xaa locations
  Clone ID: PAT_TA_103063.pep
MKTLLILTILAMAITIATANMQVDPSGQVQWPQQQPFLXPXQPFFQQPQQIFSQPQQTFPHQPQQQFPQPXQPQQQFLQPRQPFPXQPQQPYSQQPQEPXPQTXQPQQPFPSXRQPQQPFSQAQQPXQXFPXQQPSVIQQSXQQQVDPCKNFXLQQCKPXSLXXSXWXIILPPSDWXVMRQQCCQQLAQILK

SEQ ID NO: 208646 - protein, 161 aa, Triticum aestivum
  unsure (1)..(161): unsure at all Xaa locations
  Clone ID: PAT_TA_103064.pep
MGICXAXIXMLLXLAXXLXXPXXXXYXALAARGXXMXEAXXXLXAXXFYXTMAXXPLILVXYTPWCAHXEXLAPKXXKAXXLLXKXXPPIVLAXGDXNHXKNKPLXXXIXXQXXXTLXIFXXXGKNIPEYXGPKEAXGIVXXXXKQAGPASXXIKALYMLP

SEQ ID NO: 208647 - protein, 141 aa, Triticum aestivum
  unsure (1)..(141): unsure at all Xaa locations
  Clone ID: PAT_TA_103065.pep
WIPRAAGIRHQKPCVAFLQQKCSPLRMPFLQTQVEQLSSCQIVQYQCCQQLAQIPERTRCHAIHIVVEAIIQQQSQQQWQEPQQQAQHKSMRMLXENLSLMCNIYVPVQCQQQQQLGQQQQQQLQEQLTPCTTFCNSSVAQ

SEQ ID NO: 208648 - protein, 146 aa, Triticum aestivum
  unsure (1)..(146): unsure at all Xaa locations
  Clone ID: PAT_TA_103066.pep
MGILRDXMHKRRATGGKQKAXWRKKPKYELGXRQPTNTKLSSNKTXRRVRVRGGNVKWRALRLDTGNFSWGSEAVTRKTPLLDVVYNSSNNELVRTQXTLVKNAIVQVDAAPFKQXYLTHYGXEIXXKNKACCSCQRRNLLMGQEA

SEQ ID NO: 208649 - protein, 139 aa, Triticum aestivum
  unsure (1)..(139): unsure at all Xaa locations
  Clone ID: PAT_TA_103067.pep
MARTKQTARKSTGGKAPRKQLATKAARKSAPATGGVKKPHRFRPGTVALREIRKYQKSTELLIRKLPXQRLVREIAQDFKTDLRFRASPSSPCRKAAEAYLXGLFEDTNXWAIHAKARHHXCPKDISFGPAGIPGEAAP

SEQ ID NO: 208650 - protein, 217 aa, Triticum aestivum
  unsure (1)..(217): unsure at all Xaa locations
  Clone ID: PAT_TA_103068.pep
WIPRAAGIRHQPQQPFPQPQQPQQPFPQSQQPQQPFPQPQQQFPQPQQPQQSFPQQQQPAIQSFLQQQMNPCKNFLLQQCNHVSLVSSLVSIILPRSDCQVMQQQCCQQLAQIPQQLQCAAIHSVAHSIIMQQEQQQGVTILRPLFQLXQGLGIIQPQQPAQLEGIRSLVLKTLPTMCNXVVPPNCFTINVPYANIDAWHWNGKMQDHRCLADPSRR

SEQ ID NO: 208651 - protein, 151 aa, Triticum aestivum
  unsure (1)..(151): unsure at all Xaa locations
  Clone ID: PAT_TA_103069.pep
XXFIXFXXPTKGQSWSXPRWRPSXLVDPPAAGIRHQRQGPNKTXCPPQRRLDAPRARRGGAQDRAGPTQLLSQLLPAVEVPRIPGRRPXXXCIRLXYSPHXLLLFSCQTXLSLYPSTHNLAFFFLXRTSFCTLLVRRNVKKVRGEXWCACQ

SEQ ID NO: 208652 - protein, 177 aa, Triticum aestivum
  unsure (1)..(177): unsure at all Xaa locations
  Clone ID: PAT_TA_103070.pep
RKTPITPFQLKGGKTKKRLWRPSPPRPGLGAGAPFKNLKVGGFPPPGGPLAGKFFGATGKGKGKGAKAKRGPKGAGWGGTLPKNLNNLSKGGLKARVHPRHSGILSFKGPWXIMNSFINDIFEKXLAGESAKLARYNKKPTITFREIQTSVRSXFPASLAKHAVFEGTKXAVTKFTS

SEQ ID NO: 208653 - protein, 191 aa, Triticum aestivum
  unsure (1)..(191): unsure at all Xaa locations
  Clone ID: PAT_TA_103071.pep
MKTFLILALLAIXATTATTAVRVPVPQLQLQNPSQQQPQEQVPLVQEQQFPGQQQPFPPQQPYPQPQPFPSQQPYLQLQPFPQPQLXYPQPQPFRPQQPYXQPQPQYSQPQQPISQQQQQQQQQQQQQQQXLQQILQQQLISCRDGXLEQHNIAHGSSQVXKKLPVHNVVAVGEIPSSRGPSHSQGHAIIW

SEQ ID NO: 208654 - protein, 219 aa, Triticum aestivum
  unsure (1)..(219): unsure at all Xaa locations
  Clone ID: PAT_TA_103072.pep
FTPTKGNKSWSSTRGGGRSRTSGSPGLQEFGTSRVRGGNVKWRALRLDTGNFSWGSEAVTRKTRLLDVVYNSSNNELVRTQTLVKNAIVQVDAXPFKQWYLTHYGVEIGRKKKAAAAAKKEPAEGQEAEVAAAAXEEAKKNNNVXRKLEKRXQGRTLDSHIEEQXFNGGRLLACISSXPGQCGRADGYILEGXELEVYFRNSQKXGKXHLSLKSCSLIF

SEQ ID NO: 208655 - protein, 148 aa, Triticum aestivum
  unsure (1)..(148): unsure at all Xaa locations
  Clone ID: PAT_TA_103073.pep
WPRAGIRHEGLQETYLQQLXXQQLXXXPEQSRXQAIHNGGHAIILXXQHHHHPQQQQPQPQPPVSQXFFQQPQQQYSSSQGFFQPSQQNPQAQGSFQPQQLAQFEAIRNLALQTLXAMXNXXXPSYXTIAPFGIFGLTEKRRTLVVDI

SEQ ID NO: 208656 - protein, 139 aa, Triticum aestivum
  unsure (1)..(139): unsure at all Xaa locations
  Clone ID: PAT_TA_103074.pep
MARTKQTARKSTGGKAPRKQLATKAXRKSAPATGXVKKPHRFRPGTVALREIRKYQKSTELLXRKXPFXRLVREIAQDFKXDLRFQXSSAXFALQEGXEGYXVGLFXETTFXHHAKRVTXMPXDIQVGXRIXXEKLSFL

SEQ ID NO: 208657 - protein, 162 aa, Triticum aestivum
  unsure (1)..(162): unsure at all Xaa locations
  Clone ID: PAT_TA_103075.pep
XXXXLXFTLPTKGNKSWSSTAVAAALELVDPPGXXNSXPSXVXSLGLWFSIXSXXTXHLXFRFXKGARSCCCLXERCPXXXRGRXGXFCRFSSEADLRGRGGTCPCSGRLNGGYIDPPHVEPHPPGXXLREXGDGNGFKESEAHGQAXGXKXXHDGTEGGIC

SEQ ID NO: 208658 - protein, 216 aa, Triticum aestivum
  unsure (1)..(216): unsure at all Xaa locations
  Clone ID: PAT_TA_103076.pep
NRTSQIILGFFFEKLSEVGLSVVRQCXXXXTXPSSIDVHXYAQALMQLYLQQDRRVDXGKPLVFHQLXYKVSXNCKXXXXSYXXXKXNGFSLRTIXXXXXXXXXHMLXXXPXXGXPFTPFAYVLXRXQQXXKSEAXWQRNXALXAXXXXXQPXXEXLXPXPXXXXXAXXXIXXXKXKXPXXEFLQPGGSTSSRAAATAVELQLLFPLVRVNFELGE

SEQ ID NO: 208659 - protein, 204 aa, Triticum aestivum
  unsure (1)..(204): unsure at all Xaa locations
  Clone ID: PAT_TA_103077.pep
ILSSSQREQKLELHRGGRSRTSGSPGLEGTSPTQTLPGGATQRAEAFHQDQIFVKTLXGKXXTLEVESXDTIDNVKXKIRTKEGIPPDQQRLIFAGKQLEDXRTLADYNIQKESTLHLVLRLRGGAKKRKKKTYTKPKKQKHKHKKVKLAVLQFYKVDDATGKVTRLRKECPNADCGAGTXMANHFDRHXXXKCGXTYVYTRXL

SEQ ID NO: 208660 - protein, 181 aa, Triticum aestivum
  unsure (1)..(181): unsure at all Xaa locations
  Clone ID: PAT_TA_103078.pep
MNACGXAEMXQXPXEXXXRXXALYXXDNTTVXXNXGFXXYXTEXGKXLLLNAYKSPAQXLIHNEXXXKEXLAXTXLAXXNYLSAKIIXXPDSTAIHENRXXTXQXLSXTXSXXVGGEFLALHYHERXIYIPXXXWXNDPKXFTFTXLTXRSYRXYXPXTXGLDFXRLLXKXNLLKPMWMLP

SEQ ID NO: 208661 - protein, 203 aa, Triticum aestivum
  unsure (1)..(203): unsure at all Xaa locations
  Clone ID: PAT_TA_103079.pep
NYGPGEEGTSENTTRTFSRASSKQAGILPKGREKETRWGGRKSPKKDPPGGPKEKNPKGPRKAEPGPGRAFXGPRGPGKGXPRPPKGPFXPPGXFPKXKREKGPPNPXFQPGFXKGGKXIXPKKTGXPGXPGPFXVSPXPPXAXKAFRXXKGHPAPVFFPXXGPPPKXGPPFXPXKPFPPLKFGLGPLGSFWGALESFAFFVK

SEQ ID NO: 208662 - protein, 213 aa, Triticum aestivum
  unsure (1)..(213): unsure at all Xaa locations
  Clone ID: PAT_TA_103080.pep
GERKKFWEKKWGSGPPSPKKKKKREKKKKGGGXXHPAGGXGXGXGGXKKKKKXKXWXXXPAXGEXEGEKPXGGGGXXKTTTXKKKXAAGGGXGRQXXGGXEKKEKGRKGGXKKXKXXXGGRXKREKGKPHKKERGSKKKKSGKKGKQNGKRKAKDKRGRKGTKNKQGEEKKGKGGKRKREKRGRGKGGTGGKKRKKKGGEKKKERGGGEERKQ

SEQ ID NO: 208663 - protein, 156 aa, Triticum aestivum
  unsure (1)..(156): unsure at all Xaa locations
  Clone ID: PAT_TA_103081.pep
MKTFLXFXLLTVAXTSAIAQMETRCIPGLERPWQQQPXPPQQTFHNNHYFXQQQQQQLFSXQPSFWQXQPPFWXXQPPFSXQQPIXPQQPPFWXXQQLGXPXQXPFFQEQQPVLPXQQYLXQQQQQHQQVXXQQXCCLAFILQQLNPCXXFLQQQG

SEQ ID NO: 208664 - protein, 114 aa, Triticum aestivum
  unsure (1)..(114): unsure at all Xaa locations
  Clone ID: PAT_TA_103082.pep
GPIQDXXGXHCWXRXTLXXXXSXLRXVAPLPXTXSRSSXPYTXCXNYRXRXXXQEDDLHHAQEAKAQAXEGESRLISXSTWSTTPPAXSPXXGXXXRTPLRRXFLYCQPLXIDX

SEQ ID NO: 208665 - protein, 153 aa, Triticum aestivum
  unsure (1)..(153): unsure at all Xaa locations
  Clone ID: PAT_TA_103083.pep
XXXXXXXNEQXVXQXXXXNXXXMXVXXXXKRXXAPXGXGXPXXSXXXRXRCXXTXLXXXXXMXAXRXRXPXPVLGXXXXXXXVWSXVXGXXLXSRFXXXMXXXMXIXTNXXXXXXLYXAXXRXXXXCSAVXXRXXMKSXXXXXXXSXXFXXXX

SEQ ID NO: 208666 - protein, 175 aa, Triticum aestivum
  unsure (1)..(175): unsure at all Xaa locations
  Clone ID: PAT_TA_103084.pep
GWGIPPRGALARGKIFGATPRKPQNSPTPKGQKTPRIGAPRPPEKPKNGGRGKSSHPGPGAKGGAPAGKKPSLGPPKGGAPQSRAPGHGAGVKKPHRFXPGTVALREIRKYQKSTELLIRKLPFQRLVREIAQDFKTDLRFQSSAVSALQEAAEAYLVGLFEDTNLXCAIHAXAR

SEQ ID NO: 208667 - protein, 111 aa, Triticum aestivum
  unsure (1)..(111): unsure at all Xaa locations
  Clone ID: PAT_TA_103085.pep
MSSSSPVNDPXITTEYMTYMFKYDTVHXHWKHSDIKLKDDKTLLFXEXPVPXXGVRNPXEIPWGEAGAHYLVESTGVXTXDRTKGAXHXXXXAXKXXXFAQQKCPIFXGXG

SEQ ID NO: 208668 - protein, 153 aa, Triticum aestivum
  unsure (1)..(153): unsure at all Xaa locations
  Clone ID: PAT_TA_103086.pep
MXTXLFXXLXIXXXTXXXXXMEXXCXXGXXXXXXXRPLPXQXTFXTQPVXXQQXQQXLFPQXPLFXXXXXXFWXXQPXFSEQQPILPXDXHFXXTQLXYRXXTIFXAXQPXLPXQQSSFTQXQXXQQQLVHQXIRXXKXXILQQIXPCXGFXQ

SEQ ID NO: 208669 - protein, 128 aa, Triticum aestivum
  unsure (1)..(128): unsure at all Xaa locations
  Clone ID: PAT_TA_103087.pep
WIPRAAGIRHQXLXXXXHIXXHFPPXLXDXXXXXXXRXRXQAXXXXXXGXXXSXXLXXLTNDEPXXRSXPSTWXXFPRTSXRXXLDESLNXXXLLHIHIXXSSKDLLLMLLSSTEXPXHADXVYLLPG

SEQ ID NO: 208670 - protein, 141 aa, Triticum aestivum
  unsure (1)..(141): unsure at all Xaa locations
  Clone ID: PAT_TA_103088.pep
MATETETFXFQAEINQLLSLIINTFYSNKEIFLRELIXNSSDALDKIRFESLTXKSKLDAQXELFIHIIPDKXTNXLXIVDSXIXDDPSPTLXNKPRDHRQXGGPREXMEALGRGAXDVXMIGQFGVGFYSXYXLVAERVC

SEQ ID NO: 208671 - protein, 95 aa, Triticum aestivum
  Clone ID: PAT_TA_103089.pep
SFPFNPPKGNKSWSSTAVAAALELVDPPGCRNSARTFYKPCLHGKMLQELQTIGPLLWDPVSDLLPHGHYLPVMESNEALTMKLTELSSRLIFIL

SEQ ID NO: 208672 - protein, 146 aa, Triticum aestivum
  unsure (1)..(146): unsure at all Xaa locations
  Clone ID: PAT_TA_103090.pep
MPWQIFLVSHACPLPFPLPPFFLPPKRVKGPNPPGPPAPGSFGGLAPRKNFFPPLAQRXPPGGGXKFPPXPFKGFXPLRXRAGGPPGPPKPPGRGFGGKXPFPXRVLFFFGFSPPPFFRLKGFLKIFFPRKGPLGGIFYKFFFFKK

SEQ ID NO: 208673 - protein, 91 aa, Triticum aestivum
  unsure (1)..(91): unsure at all Xaa locations
  Clone ID: PAT_TA_103091.pep
SSFEYXCSKLTLTKGNKSWSSTAVAAALELVDPPGCRNSARTTMSLTPLSYRFNNHHSSIPIMSYNIHLTSASATSITSWSTLAWRSNIAH

SEQ ID NO: 208674 - protein, 158 aa, Triticum aestivum
  Clone ID: PAT_TA_103092.pep
WIPRAAGIRHQQPQLPYSQPQPFRPQQPYPQPQPQYSQPQQPISQQQQQQQQQQQQQQQQQQQQQQQILQQILQQQLIPCMDVVLQEHNIAHGRSQGLQQSTYQLLQELCCQHLWQIPEQSQCQAIHNVGHAIILHQQQKQQQQPTIRAMSFKPLPRP

SEQ ID NO: 208675 - protein, 144 aa, Triticum aestivum
  unsure (1)..(144): unsure at all Xaa locations
  Clone ID: PAT_TA_103093.pep
MAAKEPMRVLVTGAAGQIGYALVPMIARGVMLGAXQPVILHMLDIEFAAEALKGVKMEXIHAXFPLLKGVVATTDVVEACTGVNVXGIGXGIXQERKEWXRKDVXTKNVSIYKAQASALEAHAXPNCXGLVVAXPTNTHAXILX

SEQ ID NO: 208676 - protein, 161 aa, Triticum aestivum
  unsure (1)..(161): unsure at all Xaa locations
  Clone ID: PAT_TA_103094.pep
MXRTKQTARKSTGGKAPRKQAGHQGRRKSARXTGGVKKPHRFRPGXXALREIRKYQKSTELLIRKAPLQRLXXEIAXDFKDRPAFQSFPSSALARKAPRPYLGGLSKEQPKCAFNPKPPFNPIQLPKNFPSLWATGPGNPGAEKGAPLKAYPVSPVFKPNW

SEQ ID NO: 208677 - protein, 172 aa, Triticum aestivum
  unsure (1)..(172): unsure at all Xaa locations
  Clone ID: PAT_TA_103095.pep
WIPRAAGIRHEQQPFXQQPQQPXPQTQQPQQPFXQQPQQPFPQTQQPQQPFPQXQQPHQPFHQPQQQXPQPQQPQQSXPQQXQRPXIXAXXQQRLNPCKNILLQQXKPAAIXDSXWSIIWAQSDXKVMQXQCWQELAQIPQQLQCAAIHSVXHFIXVQQXQQQXQQPPPPPP

SEQ ID NO: 208678 - protein, 129 aa, Triticum aestivum
  unsure (1)..(129): unsure at all Xaa locations
  Clone ID: PAT_TA_103096.pep
GGSPLGCKVTXPPRPXFRXKIPPXXKGPIWXPRXXGGPPFPGFGPPGKNFFPPLAPKGPPPGGGGKFPPQPFKGFFPLKKRPGXPPXPPXPPXRGLGGKGLPKPFFFWFPPPFFGGKKEGKFFLLRFPP

SEQ ID NO: 208679 - protein, 434 aa, Triticum aestivum
  unsure (1)..(434): unsure at all Xaa locations
  Clone ID: PAT_TA_103097.pep
PPEKFKLKRPLGKEPFAPRPGPVFLKENPGGPRKFPGVLFVSRGGVFTXAPPXGXPKKKGGFPKXFXPXFGPPPXLGPPXGXKXXTGGPXFXVKXFGXXKGGXGPLAPGGPPKXXKFCFSQFSPGPRGFXFSXKTRGPRGFXPXXKXGGFGPPGFPXKPXXXGKXXFPGKKPQPGGGPXGGXPPXFSXKXGKXGGGXPPXFXRKKXEKRXVXPGGXPPGXKXXKKGGXKKAPGXPXKXFXGGGGFSPENPXGGXEXXPXXXVLKRAPKGKKPLFXGXPGXPXGGGGPPGKXXTPGGGKKRKTXGPGGKRGXKKXAPKXGGGXGGGXXPXKXXKGGPPPFXGXPPXKXKGPGXNPGXPGXSPPGPGKKKPFKGXPPVPGGSPQAGKXPAGPCSGLKGRAASRGRRRGNRLPRLVRILSRDHLRRPRLLTFYSMSF

SEQ ID NO: 208680 - protein, 112 aa, Triticum aestivum
  unsure (1)..(112): unsure at all Xaa locations
  Clone ID: PAT_TA_103098.pep
IPCSXLTLTKGNKSWSSTAVAAALELVDPPGCRNSAGIPRLLPLRGPYRQRKAGTYDGPTCPPVSLSVQGLLYPTLVYPVKYPYLTFFYGPLTDSVFDLVDGTTAVTADIAG

SEQ ID NO: 208681 - protein, 197 aa, Triticum aestivum
  unsure (1)..(197): unsure at all Xaa locations
  Clone ID: PAT_TA_103099.pep
MARTKAKRAREIHPGGQRAPGGKGKPWAEPXXPGPAXKRFPGPPGGPTPGPGPVGKKKKPPPNPRVFFPAPPRGXTXVSGRXFPRGEXKFPGXXXLXPKEKGKAQPPERXLXFSNFPGPKGXFPPPFFPKXRPPWGLGRGGKKFXAGPRXNLFLKGNPXNPFPRXFXPXKGLSPAPXSFXGRPLXKXXGXPXPXGAP

SEQ ID NO: 208682 - protein, 126 aa, Triticum aestivum
  unsure (1)..(126): unsure at all Xaa locations
  Clone ID: PAT_TA_103100.pep
LXKLQIHDCPEFSSVIHISSIESLRHVRIRQVKVLKEFTYSKSSDGAELEIVGEGYLHRLDQVLVFDKEIGYPKQSLQRLSIRNSRAFLSSFSRHSFPSSLQFLELVGVEDLGTLEPLSNLYFVTD

SEQ ID NO: 208683 - protein, 119 aa, Triticum aestivum
  unsure (1)..(119): unsure at all Xaa locations
  Clone ID: PAT_TA_103101.pep
QNNKVMKSMNXTCRXEVPXXNXQLPFGDGFIGEXGDLXGXGLAAHDXVGXRXXRRSPSPDSGAPYCSTRSWRXRXRXXRAGXPXRGGAGREXXGGXPSXXTRAXRVXPLXGAGKTATLA

SEQ ID NO: 208684 - protein, 103 aa, Triticum aestivum
  unsure (1)..(103): unsure at all Xaa locations
  Clone ID: PAT_TA_103102.pep
MANPRVFFDMTVXGAPAGRIVMELYKDAVPWTVENFXALXTGEKGXVXKSGXPLHYKGSSFHXVIPDFMCQGXDFTKGNXTXGESXYXXKFXXXKXVHKHTKP

SEQ ID NO: 208685 - protein, 90 aa, Triticum aestivum
  unsure (1)..(90): unsure at all Xaa locations
  Clone ID: PAT_TA_103103.pep
MRECISIHIGQAGIQVGNACWELYCLEHGIQPDGQMPGDKTDGGGDDAFNTFXSETGAXKHVPRAXFVDLEPTVIDEXRTGAYRQLXHPE

SEQ ID NO: 208686 - protein, 115 aa, Triticum aestivum
  unsure (1)..(115): unsure at all Xaa locations
  Clone ID: PAT_TA_103104.pep
NXIVQSMGNRGSQDVGGSCELAAKQQLVTADLTSIIIQLISTAGSMLPSMKTXLLSSNPAVRQLNTPGSPMGFGSIXNQRPSTVREEMVPDISKTSDYEELMNTLNTAHDEXDDL

SEQ ID NO: 208687 - protein, 86 aa, Triticum aestivum
  Clone ID: PAT_TA_103105.pep
MVAHKAASWLPVDFRLPAVPQAALGILAFEAGAAMSKLLSLHRSLSEQEVSRLRSDAMRSPGVAYLNFTDQAFLLRLACAELVLSL

SEQ ID NO: 208688 - protein, 96 aa, Triticum aestivum
  unsure (1)..(96): unsure at all Xaa locations
  Clone ID: PAT_TA_103106.pep
DPLVTAASVVXFRKYQRSTELLIRKLPFQRXVREIAQDFKTDLRFQSSAVSALQEAVEAYLVGLFEDTNLCAIHAKRVTIMPKDIQXARRXXGERA

SEQ ID NO: 208689 - protein, 127 aa, Triticum aestivum
  unsure (1)..(127): unsure at all Xaa locations
  Clone ID: PAT_TA_103107.pep
EHILNVCTPMSPAIAPPTXGGGHDPPTQQPEEEIAVRVIPASEDVEEPAADTTSFLCPLVPLXTATLANGMHVLLVQSTSTDLSPXGLQALLVPASCWEDGPRDHQXRRNIDXRMAXXXVXXFXXWS

SEQ ID NO: 208690 - protein, 117 aa, Triticum aestivum
  Clone ID: PAT_TA_103108.pep
ELSFRPRLRPRSPESPPCVLASSPPIPDSFRIAFDLISLAVAVALDSTRLVSPLRAIPGSDRSGDSFIWFASLSQILFRVYGSVYNCGSRVPRIRVRIRARWSDSRARSHRFLCAHP

SEQ ID NO: 208691 - protein, 109 aa, Triticum aestivum
  unsure (1)..(109): unsure at all Xaa locations
  Clone ID: PAT_TA_103109.pep
TIRPRTHSMCGKMDEVHLHMEHKSLPGGEFGGVRASMSKPPTSSTSRPNSMVVKKVCPREYIPPHIVAEAISTLHXLDLRWSGPITPSERLYVEQYVMAKYPQYSHGLI

SEQ ID NO: 208692 - protein, 150 aa, Triticum aestivum
  unsure (1)..(150): unsure at all Xaa locations
  Clone ID: PAT_TA_103110.pep
VXLKXXLGXQXVXGXXGAGXSWXPXXXLXXRRXXXPXPAGXRXRXXRPWLPSPSLTPPSSLALLSYPLXXLRASARASRXKNPLPHQRRPCPPATHRRAASVXRPADFETMRGCGCGVERSGGTLSGATPSXLGTSGIPPHWRPLLVDPS

SEQ ID NO: 208693 - protein, 56 aa, Triticum aestivum
  unsure (1)..(56): unsure at all Xaa locations
  Clone ID: PAT_TA_103111.pep
GPASXRNYGLFYPDGTPVYNVGLRGYLPPMADSHGARQAVHAILLIAIATVGFALS

SEQ ID NO: 208694 - protein, 86 aa, Triticum aestivum
  unsure (1)..(86): unsure at all Xaa locations
  Clone ID: PAT_TA_103112.pep
XGELPNGLPVAVKVLKVSMNKKVQEGFMAEIGTIGRTYHVHLVRLYGFCFDPDTKALVYEYLENGSLEKYLYHHGGDRDREGKALT

SEQ ID NO: 208695 - protein, 133 aa, Triticum aestivum
  unsure (1)..(133): unsure at all Xaa locations
  Clone ID: PAT_TA_103113.pep
ADEAAMRTRGFPPVETHLGRLVVSVQYLPSLAXYNFEITSLSSAMLITDYVGSPAAEPMRSFPSSLTEPASSALPLPSRXPNSWASPAGAYWPQSPGQHAKFSPPTLYASPTPSSPTFGGGYLQSRLCGETAP

SEQ ID NO: 208696 - protein, 81 aa, Triticum aestivum
  unsure (1)..(81): unsure at all Xaa locations
  Clone ID: PAT_TA_103114.pep
XVVTASGVLGLAISFTSMWFLRQTSATTYSLVGSLNKIPLSIAGILLFKVRTSMENSISILFGLLAGVXXSRAKLRENSQS

SEQ ID NO: 208697 - protein, 136 aa, Triticum aestivum
  unsure (1)..(136): unsure at all Xaa locations
  Clone ID: PAT_TA_103115.pep
PXPSSSSSSSSMSMEIRSSHHHEEATGNLMRPGSEYPPGMQRGGAPATATHRRQFQPIPAPFMSFRPPTSSTPMTMPHXHQGQLRFHGHHGGSRPFHQPSPGANPGAXDGXXXTTHQXXTXMSAAFRSCGWXLRPK

SEQ ID NO: 208698 - protein, 84 aa, Triticum aestivum
  unsure (1)..(84): unsure at all Xaa locations
  Clone ID: PAT_TA_103116.pep
WPPXGAAGDGGGRGREGVRAQRRGAPGGSLGQSEAGRVRRRSGGRALAAPAPVMLPQRGCFSWTVSVRCSVLGNAIRTYXLCKK

SEQ ID NO: 208699 - protein, 144 aa, Triticum aestivum
  unsure (1)..(144): unsure at all Xaa locations
  Clone ID: PAT_TA_103117.pep
DADLAADMVRLSREFLALPAEDKVRYDMSGXKKGGFIVSXHLQGEAVXDWRELVTYFSYPVKARDYXRWPEKPAXWRAVVERXSERMMELXCKLLGVLSEAMXLETESLAKXXXVDMDQKVXXNXYXXXSXXPSLPWAVKRHTP

SEQ ID NO: 208700 - protein, 134 aa, Triticum aestivum
  unsure (1)..(134): unsure at all Xaa locations
  Clone ID: PAT_TA_103118.pep
VRRXATXAAAAEEQRXRXLRRCGAEGLASVREEAVGAXHAQRXRSLLRXRHXRRQPWXRLLRRXRGARRLRAQXSAGAXXXAQHXAPAXPXQSGAXHHHSSCSSWLXLXXXXQXPPPSXXVALALDGGLQFQGP

SEQ ID NO: 208701 - protein, 143 aa, Triticum aestivum
  unsure (1)..(143): unsure at all Xaa locations
  Clone ID: PAT_TA_103119.pep
GSAISIHIGXAGIQVGNACWELYCLEHGIQPDGQMPGDKTVGGGDDAFNTFFSETGAGKHVPRAVFVDLEPTVIDEVRTGTYXQLFHPEQLISGKEDAXNNFARGHYTIGKEIVDLCLDRIRKLADNCTGLXGFLVXNAXGGG

SEQ ID NO: 208702 - protein, 101 aa, Triticum aestivum
  unsure (1)..(101): unsure at all Xaa locations
  Clone ID: PAT_TA_103120.pep
MAPKAAEKKPVEKTPXGKKPKAEKKVPASKEGGDKKGKKKAKKSXETYXIYIFKVLKQVHXDIGISSKAMSIMNSXINDIFEKXAXXSXKLARYNXKPTIX

SEQ ID NO: 208703 - protein, 111 aa, Triticum aestivum
  Clone ID: PAT_TA_103121.pep
VEATYRQAASAEVKSYYASVSGYHDELLWAALWLHRATGRASYLDYVVDNAHEFGGTGWAITEFSWDVKYAGVQILATRLLLRGEHEERHRATLEGYRAKAEHYVCACMGR

SEQ ID NO: 208704 - protein, 138 aa, Triticum aestivum
  unsure (1)..(138): unsure at all Xaa locations
  Clone ID: PAT_TA_103122.pep
VKEALVLFXRFWSSGIRADGHVLSSIVGVFADFALIEQGRQVHCYTVKNPXRAGRVSANSLVDMYHKCGLTDEAEQRXWETPEEERRVIGQXXXNGLGXXGXGRXALXMFEKMXPEGVEPDEVSYLAXLSACSHSGLV

SEQ ID NO: 208705 - protein, 114 aa, Triticum aestivum
  unsure (1)..(114): unsure at all Xaa locations
  Clone ID: PAT_TA_103123.pep
IEQKEESRGNEAYVASIKEYXTRIETELSKICDGILKLLDSHLVPSATAAESKVFYLKMKGDYHRXLAEXKAGAERKEQAXENTLVAYKLSPRTGLTLPYQPHPIRALGPCTKL

SEQ ID NO: 208706 - protein, 147 aa, Triticum aestivum
  unsure (1)..(147): unsure at all Xaa locations
  Clone ID: PAT_TA_103124.pep
GLGKKVXGKRVGTGXEXALKVSXTXPVIXASGWRXXGFFNXRPRXGPGXXNTRXXXWXPXPKDXHRDPRAXVDLVAHPRLRQVLVDCLYSGWPLRKXVMLCXIPXDIPXAVAAGAMPQQQARRTTATTRRSCAPAMAELSXGRRTND

SEQ ID NO: 208707 - protein, 158 aa, Triticum aestivum
  unsure (1)..(158): unsure at all Xaa locations
  Clone ID: PAT_TA_103125.pep
XAVGXPAFXIGAAPAAEMEMXPXLXPPXPSXGXGXIXEDSDGVRVAGXGAGVGVXVDXRXLRQRXGAQGHATTTXAXQXXKXRXVXRXXXLXXRXXXXCPYGASXTXPFTPAGRFSMHLEGXIXXLXXVTXYINALAPTXRFNRKGXXLTTLKSRSXX

SEQ ID NO: 208708 - protein, 106 aa, Triticum aestivum
  unsure (1)..(106): unsure at all Xaa locations
  Clone ID: PAT_TA_103126.pep
KXCXEGKLKPAKVAGKIVFCELGVTAQAAKGQAVKLAGGAXAILTGAKEDGEQVITSPHVTPXRDXXHXAAAXKIKKYIXTQTSPTATIXFRYRGRLDAFPRMASF

SEQ ID NO: 208709 - protein, 156 aa, Triticum aestivum
  unsure (1)..(156): unsure at all Xaa locations
  Clone ID: PAT_TA_103127.pep
TQGLIAALGKELPVVSVXEHLXAAVFSVVARLCFGDDIDEGYLRAMRCGIRDIQLIAVVEAKPXXGSMMAKLTGWRVLRQXLXXHARMGEIFLRLVAARRESRRPCDGGSRRPYVDSLIDLRVPDGDGGRRAVRDDELVLLVLEFRGARPLGRQHA

SEQ ID NO: 208710 - protein, 138 aa, Triticum aestivum
  unsure (1)..(138): unsure at all Xaa locations
  Clone ID: PAT_TA_103128.pep
ASGDLVPLSYIAGLVTGRANSVATAPDGSKVNAAEAFKIAGIQHGFFELQPKEGLAMVNGTAXVGSGLASMVLFEANILSLLAEVLSAVFCEXSLNGKPEYTDHLTHKLKHHPGQIEAXAIMEHILEGSSYMXLAKKL

SEQ ID NO: 208711 - protein, 98 aa, Triticum aestivum
  unsure (1)..(98): unsure at all Xaa locations
  Clone ID: PAT_TA_103129.pep
SPQKSQDAPGVGQNXLSPTXLSSRTYLKSASISAXKCVAVNPNKQXEYDDTISXETEXAVDGLSRRFKDACLVQQRRKPSFLSHRMLIADSKALVDLA

SEQ ID NO: 208712 - protein, 103 aa, Triticum aestivum
  unsure (1)..(103): unsure at all Xaa locations
  Clone ID: PAT_TA_103130.pep
TSFXTNXTXDGGLLDRLDAGSVTTFSFCNFHXEYRGKNLTVIGDADITKGALQITPDTVNEAGHFSPTSAARXLLLSXQALETQEGXAGTCLCRXGXXVLLPH

SEQ ID NO: 208713 - protein, 124 aa, Triticum aestivum
  unsure (1)..(124): unsure at all Xaa locations
  Clone ID: PAT_TA_103131.pep
KAEMARFADAFIALPGGYGTLEELLEVITWAQLGIHKKPVGLLNVDGFYDPLLSFIDVAVNEGFXTXEARQIIXSAPTAKELVMKLEDYFPEYVGLVWEDQGQKPSNSLVPEPLETPAIPPPDR

SEQ ID NO: 208714 - protein, 116 aa, Triticum aestivum
  unsure (1)..(116): unsure at all Xaa locations
  Clone ID: PAT_TA_103132.pep
VELVAVNDPFITTDYMTYMFKYDTVHGQWKHHEVKVKDSKTLLFGQKEVAXLXXRNPEXIPWAAAGXEYXXXXTGVFTAXXKIXAHIKXXAKXGXXXXPXQNAPMFVXGVNEKXYT

SEQ ID NO: 208715 - protein, 128 aa, Triticum aestivum
  unsure (1)..(128): unsure at all Xaa locations
  Clone ID: PAT_TA_103133.pep
PKVKKPKVTVADAAALIDAENLAAHLVDISASYENQEGIQLMRFADYFGRAFANVSAAQFPWAKMFKESPMPKMVDVPLSHVPEPVCKTASDWITQRSPDALGEFVLWCIDSIMSXELSGPTVGPKGS

SEQ ID NO: 208716 - protein, 128 aa, Triticum aestivum
  unsure (1)..(128): unsure at all Xaa locations
  Clone ID: PAT_TA_103134.pep
READRADIFKEPGESLHDKLLSEFTEETEGTGLVITGWAPQLEILAHGATAAFMSHCGWNSTMESLSHGKPILAWPMHSDQPWDAELLCKYLKAGLLVRPWEKHSEVLPAAAIQEVIXEEAMLTDKGM

SEQ ID NO: 208717 - protein, 122 aa, Triticum aestivum
  Clone ID: PAT_TA_103135.pep
MRAGDQASPPSSKMRAGDQASPPSSKFRAGDQASPPSTKFRAGDQASPPSTKMRAGDQANQAGQLATTDRLDRLLSQPANKCCADCGAPDPKWVSLTFGAFICIKCSGAHRSLGVHISKIVS

SEQ ID NO: 208718 - protein, 103 aa, Triticum aestivum
  unsure (1)..(103): unsure at all Xaa locations
  Clone ID: PAT_TA_103136.pep
IQDATFCSSPKIHKARKSIASPGFSPSKLSESSPGEADFETYRKSAVRSXLQSSKLSPTDSLAASXQRGLHIIEYHQQNXPAPRKSFVGLSFDHFALNPQSKA

SEQ ID NO: 208719 - protein, 113 aa, Triticum aestivum
  unsure (1)..(113): unsure at all Xaa locations
  Clone ID: PAT_TA_103137.pep
XXFVFLLYLYAKRFLGANPMLNGAGATSXRXIFVGDSPFPRRGLPASVLRTXPVAVYGGGAXPKTPXGXGRRSSRDXLECAVCLSEVANGXKVXTLXKCDHRFTXLNRLWFHS

SEQ ID NO: 208720 - protein, 96 aa, Triticum aestivum
  unsure (1)..(96): unsure at all Xaa locations
  Clone ID: PAT_TA_103138.pep
MGDWQELAQSAAIGLIFAFLVAKLISVVLAFKEDNXRITRSPRTPPPXPTPPXPRSTXGTSGGDSDSDGDWEGVESTELDEDFSAAPLLALRAASR

SEQ ID NO: 208721 - protein, 104 aa, Triticum aestivum
  unsure (1)..(104): unsure at all Xaa locations
  Clone ID: PAT_TA_103139.pep
LEREMLKSDRSYILDCGTEIFLWIGMTTLVSEKKTSATALEEYVHLQGRSSIAALXIMTEGHEIVDFKLHFQHWPKNVVQKLYEAGRQKVAAIFKHQGYDVAEI

SEQ ID NO: 208722 - protein, 119 aa, Triticum aestivum
  unsure (1)..(119): unsure at all Xaa locations
  Clone ID: PAT_TA_103140.pep
APSNSKAPAAAPPAAAPAAATTTTPRKFPMRFFRRSDRGSRCMAFLDLLLRIAAFGPALAXGHWHRHVRQTXPXYRVLQFAPVSTTSGFCSSWWRVRSPRGTCLIAPFSAVVVLRLNTV

SEQ ID NO: 208723 - protein, 125 aa, Triticum aestivum
  unsure (1)..(125): unsure at all Xaa locations
  Clone ID: PAT_TA_103141.pep
MGIDLVAGGRNKRTKRVAPKSDDVYLKLLVKLYRFLVRRTKSKFNAVILKRLFMXKXNXPPFSLRRLSNFMKGKEEKNIAVVVGTITNDMRIQEVPAMKXTALRFTXTARARIVNAGGECLTFDQ

SEQ ID NO: 208724 - protein, 104 aa, Triticum aestivum
  unsure (1)..(104): unsure at all Xaa locations
  Clone ID: PAT_TA_103142.pep
RHRXQGSEDKDYKEPPPAPLFEPGELKSWSFYRAGIAEFMATFLFLYVTILTVMGYSGATSKCASVGIQGIAWSFGGMIFALVYCTAGIXSGGHINPGGPFGGG

SEQ ID NO: 208725 - protein, 106 aa, Triticum aestivum
  unsure (1)..(106): unsure at all Xaa locations
  Clone ID: PAT_TA_103143.pep
MLVYQDKLSGDELLSDSFPYRELXNGVLWEVDGHWVVQGAXDVDIGANPLXXVGGDXXRGFXTKXLKXVDIXDTXRLXXQPAFXKKHFISQMKRYIKNLSPNXXXG

SEQ ID NO: 208726 - protein, 170 aa, Triticum aestivum
  unsure (1)..(170): unsure at all Xaa locations
  Clone ID: PAT_TA_103144.pep
TAQGSIFCPSTDKAGAMVRSSQWTRRATPSSATPSAAPSSPFPALTNPKGDKPRSLSITRXDTXHQALYVMDRFPAARNAFIFEALIYGKNSWEWHRLPXPPYVNNPXYNCTAIQSTCCLGEWLDHXHILXXGXLHXAPTGLIPXAXXGKKXGXLDLXISLDXLXLFLNX

SEQ ID NO: 208727 - protein, 67 aa, Triticum aestivum
  unsure (1)..(67): unsure at all Xaa locations
  Clone ID: PAT_TA_103145.pep
LYKCQRHLLTFRMVSAAINSITSKRSDETELHKVCVSEMIKHTPSIPKYKSLEIPIWTRYXMYIDTV

SEQ ID NO: 208728 - protein, 124 aa, Triticum aestivum
  unsure (1)..(124): unsure at all Xaa locations
  Clone ID: PAT_TA_103146.pep
SLLGGFLSDSYLGCFWTMLTFGFVELSGFILLSVQAHLPQLKPPPCNMXVHWTAACEQARGFKSSIXFVALYLVALGSGCXKPNMIAHXXDQFXXXDNAXSLSTYFNXAYFSFCLGELAHSAGC

SEQ ID NO: 208729 - protein, 114 aa, Triticum aestivum
  unsure (1)..(114): unsure at all Xaa locations
  Clone ID: PAT_TA_103147.pep
ESARVFCPGGGDVDGGGGEGGGAGPGQGGGAVXAXQAPXLRQGAQRGGEGXLERFPXRKMXXIXAXEARTHGVPXLESKXXSPQALGXGDVNTAXAGXXTXAFXVGTLTDKNRN

SEQ ID NO: 208730 - protein, 105 aa, Triticum aestivum
  unsure (1)..(105): unsure at all Xaa locations
  Clone ID: PAT_TA_103148.pep
PGVSGYIXAEKSKVVEQLQSGSASSKKNLRTELPAVGDPDGVINEXXALKDKDVXXQGQXXXGXVYIAGSESEGHFXLINKAYSMFXHTXPLXXXCFKKCGTRLS

SEQ ID NO: 208731 - protein, 74 aa, Triticum aestivum
  unsure (1)..(74): unsure at all Xaa locations
  Clone ID: PAT_TA_103149.pep
GMAKRKRNTTHAPHPGADYLSSFISFMTCERPRIFFPLLPFIMXQLLXXXFCLLWGQHVTVVVQRXPRINCPXF

SEQ ID NO: 208732 - protein, 124 aa, Triticum aestivum
  unsure (1)..(124): unsure at all Xaa locations
  Clone ID: PAT_TA_103150.pep
NKDGGANHRHKLTNHPCVDRNAQNKXARQMPIQQXRXMLDLXGXAHKCPPLGCQYPDCRXLKGXFGHATRCQKRAARRACHFXXDGXFXXXLPELCKESKCPXRDAGDLKAHLRGXQHQSQSRR

SEQ ID NO: 208733 - protein, 100 aa, Triticum aestivum
  unsure (1)..(100): unsure at all Xaa locations
  Clone ID: PAT_TA_103151.pep
XGDPSKPKHTHATLLRPARPARPARHQRARRARQARWHQXVPPVPRASVAPDEPDHTRRGLFQQGTPLMNLPWGSSRMNPAPALANQGKMSSHAALGMAR

SEQ ID NO: 208734 - protein, 131 aa, Triticum aestivum
  unsure (1)..(131): unsure at all Xaa locations
  Clone ID: PAT_TA_103152.pep
GLIGEVISRFEKKGFYLKGLKLQNVEKSFAEQHYADLSXKPFFAGLVEYIVSGPVVAMVWEGKSVVSTGRKIIGATNPLAXEPGTIRGDFXVDIXRNXXHGNQLIXNPRKEIXWXFLGLPMEDHPNLVFKA

SEQ ID NO: 208735 - protein, 79 aa, Triticum aestivum
  unsure (1)..(79): unsure at all Xaa locations
  Clone ID: PAT_TA_103153.pep
PTPLSXRXTARRSRREMSGVTADEDKNPXRRGAPHQPQVKGRCNEFSSLKXRHTENCEPSAPXCDSLLLLSCLALDNLD

SEQ ID NO: 208736 - protein, 106 aa, Triticum aestivum
  unsure (1)..(106): unsure at all Xaa locations
  Clone ID: PAT_TA_103154.pep
XTGGTNNWLXSAQLXSNKPVLTKGALGVAVGXMAVCCXPSXARXARTXXHXPXXFLPSXRPPRPPKXLVXAAPHGXWPGXGRAGXPPRLGRGKNFXPPNPQXXPWG

SEQ ID NO: 208737 - protein, 78 aa, Triticum aestivum
  unsure (1)..(78): unsure at all Xaa locations
  Clone ID: PAT_TA_103155.pep
RGVRGRPXGPRPXXMLTWXXLTLXRAFQFIKXRAQPXNFXXPPFXLFFKNPKXXKXTXIFXENKKRGFLLXXLKGLEN

SEQ ID NO: 208738 - protein, 37 aa, Triticum aestivum
  Clone ID: PAT_TA_103156.pep
SSSIVPEPLSINKILGFKNEHAICYFVGFCNSRVQMS

SEQ ID NO: 208739 - protein, 109 aa, Triticum aestivum
  unsure (1)..(109): unsure at all Xaa locations
  Clone ID: PAT_TA_103157.pep
FGFFLKKGPXKKKFXXXLKKNXXKKNXFXPKXRPKXPXKFFXIGGXXXPFFGXXXRFETPGVKKEVFSPPGRATKXKKKRXRDXREPMSPGXTLRPWVDESEKSARXNT

SEQ ID NO: 208740 - protein, 93 aa, Triticum aestivum
  unsure (1)..(93): unsure at all Xaa locations
  Clone ID: PAT_TA_103158.pep
ARARLRRRGLRPTSSSRXRFEXWLGKPGGSSLSWKXGMKNMAGEMETXHLEKWHGECXGQRYPTSRTTGLPXSAGTXVHTRTXXCXFTXXXTN

SEQ ID NO: 208741 - protein, 99 aa, Triticum aestivum
  unsure (1)..(99): unsure at all Xaa locations
  Clone ID: PAT_TA_103159.pep
RLPKTFANXVQAYVHVXETAAAHVLVFQSPAAAGRYXCVADGAVXHREDVVTIXRKFXPEYSXPSKCSYEVNXQXXPYXXLNXRLLELGLEFTPVGXCL

SEQ ID NO: 208742 - protein, 67 aa, Triticum aestivum
  unsure (1)..(67): unsure at all Xaa locations
  Clone ID: PAT_TA_103160.pep
RMGRRIAYHSLHSXSXVDPSYXGVGPLRVXESRXSXLKGSEHRASQSTRGPNTADRPXCSNFLVRGX

SEQ ID NO: 208743 - protein, 79 aa, Triticum aestivum
  unsure (1)..(79): unsure at all Xaa locations
  Clone ID: PAT_TA_103161.pep
RVXENAANMCPELXKRAXXSSNAXGKSAXPNESTRSHANSANIRXVKMFIIRTSKXIQSVQEXMSQQRPPLICSVGSRS

SEQ ID NO: 208744 - protein, 101 aa, Triticum aestivum
  unsure (1)..(101): unsure at all Xaa locations
  Clone ID: PAT_TA_103162.pep
RVSASGAGVLHVLKLTGLXAKEDHYMVGRYDDEAGHLRXPREPERGDDPGNWRRLDHGHXYASKSXYXXRKKAALLWPWVXKNNGGGVXRGWAGIXAFPRA

SEQ ID NO: 208745 - protein, 113 aa, Triticum aestivum
  unsure (1)..(113): unsure at all Xaa locations
  Clone ID: PAT_TA_103163.pep
AFQLEKVKRMLPAFSSCXEDIVSRWRXSLGSKGSCELDVWPELKNLTGDVISRTAFSSSYLEGRKIFQLQEEQAXPLXXNIRGLLIPGYLFLPTRNNRRMHQINKEIESILKN

SEQ ID NO: 208746 - protein, 113 aa, Triticum aestivum
  unsure (1)..(113): unsure at all Xaa locations
  Clone ID: PAT_TA_103164.pep
FRLPDFAXXAAAAARRPRLLPVDEMVRCFYSSSLLSYKHPKHVSFADSPRRSAEYCRNCSFQRIPGYVFLVDLFPXXSXXVLDAKSQGLAVSKSSTIESXWSICVIXFXCLPX

SEQ ID NO: 208747 - protein, 113 aa, Triticum aestivum
  unsure (1)..(113): unsure at all Xaa locations
  Clone ID: PAT_TA_103165.pep
VLVAVSIFVAIHSLRQRRSLGLPSWPVVGMLPSLXXGVRGDMYEWITGVXKARGGTFTFCGPWFTNLHCVVTATXXNLKHLLKTKFGNFPXGPYFXDTVRDXXXDGIFGADXX

SEQ ID NO: 208748 - protein, 112 aa, Triticum aestivum
  unsure (1)..(112): unsure at all Xaa locations
  Clone ID: PAT_TA_103166.pep
MLRRAAXSAATALLRRALSNSPRPRSSAAATAVASSSAVNSILLRSLKEHYLEVSKMTPPPKISPPKPYNIVKGXALDQTSGPVLRRSYGEAGEEISISVXRLSNIMPPGAD

SEQ ID NO: 208749 - protein, 88 aa, Triticum aestivum
  unsure (1)..(88): unsure at all Xaa locations
  Clone ID: PAT_TA_103167.pep
MRPSSVFAWAAAVLLAVAAFSAMADASPPPSKFLKVGFYKHTCPQAEYXVLNAVRRAFARNPGLAGGIIRMHFHDCFVRGCDGSLLIN

SEQ ID NO: 208750 - protein, 75 aa, Triticum aestivum
  unsure (1)..(75): unsure at all Xaa locations
  Clone ID: PAT_TA_103168.pep
MADQLTDDQIAEFKEAFSLFDKDGDGCITTKELGTSMRXSLGQNPTEAELQDMINEVDADGNGTIDFPEFLNLMA

SEQ ID NO: 208751 - protein, 82 aa, Triticum aestivum
  unsure (1)..(82): unsure at all Xaa locations
  Clone ID: PAT_TA_103169.pep
MARALGGASAPNVGRGGRRAQASHASLDSDLEAFSHNPAHGSXFAPLAFQPSAMTNCVNQRFLSYXVELLSRHCHQXGKTNL

SEQ ID NO: 208752 - protein, 167 aa, Triticum aestivum
  Clone ID: PAT_TA_103170.pep
KSGGLRFASPGITGSEGGFHWQWSVAYWAWARQWPAGSEESRGNPRRFGYRPRQWRKKVEGITMDGAGVGGAGVFGMWEMQGKMCGSWPRRGVVADPDPLPGSNVRWWLPDRTRPRDSMWLGMPWASPDLGASEVELGGAGRTGGRRLGWSGLRVAVVGWRRKVDGG

SEQ ID NO: 208753 - protein, 132 aa, Triticum aestivum
  unsure (1)..(132): unsure at all Xaa locations
  Clone ID: PAT_TA_103171.pep
TETPSFPRCTSSRRPRRTLPLQFRPAPAAAWTGASAACSLLRRRRPARAARGGCSAASFVKGGGVGKITRRRSWSKFRGVRQRSWGKWAAEIRDPHRAVRKWLGTFDTAVDAARAYDLAALEFRGHRARLNX

SEQ ID NO: 208754 - protein, 113 aa, Triticum aestivum
  Clone ID: PAT_TA_103172.pep
GAPVWWWRRGGDPCTRCLMEVPSPDPGENLVLGLMPRPALAALFCVITFLKASPWRSSRPLSATSGENPRSVDQMTVARWCRFLLGGVILGGVHGFEGPVSGFFGGAVLHPAH

SEQ ID NO: 208755 - protein, 146 aa, Triticum aestivum
  unsure (1)..(146): unsure at all Xaa locations
  Clone ID: PAT_TA_103173.pep
RGLSPELNSLDQIKDIERPVEIPDYGLLCDLLWSDPSSDTQGWGESDRGVACTFGADKLVEFLEKXNDLDLICRAHQVVEDGYEFFAERRLVTIFSAPNYCGEFDNAGALLSIDESLMCSFQILKPKETGAPHSRKPISNKAPTVD

SEQ ID NO: 208756 - protein, 128 aa, Triticum aestivum
  unsure (1)..(128): unsure at all Xaa locations
  Clone ID: PAT_TA_103174.pep
MELPAAPEEIPAACRSAAPEYARLVQQGLGATLLGLLPEALGLRPGHLEEEHGCLXNGISLACHYYPACPEPQLTLGTPRHSDADFLTVLLQDSVGGLQILVDLXAEDGGERKRPVWVDVPPVAGALV

SEQ ID NO: 208757 - protein, 143 aa, Triticum aestivum
  unsure (1)..(143): unsure at all Xaa locations
  Clone ID: PAT_TA_103175.pep
MAPKAEKKPAAAEKTPAAEKTTAGKKPKAEKRPPKSXKEGGADKKKKKAKKSVETYKIYIFKVLKQVHPDIGISSKAMSIMNXFINDIFEKLAGESAKLARYNKKPTITXREIQTXVRLVLPGEXAKHAVSXGTKXVTKFTXS

SEQ ID NO: 208758 - protein, 136 aa, Triticum aestivum
  unsure (1)..(136): unsure at all Xaa locations
  Clone ID: PAT_TA_103176.pep
MAPKAAEKKPVEKTPAGKKPKAEKKVPASKEGGDKKGKKKAKKSVETYKIYIFKVLKQVHPDVGISSKAMSIMNSFINDIFEKLAGESAKLARYNKKPTITSREIQTFVRLVLPXEXSXXXLFXXGXKAVTKFTXS

SEQ ID NO: 208759 - protein, 159 aa, Triticum aestivum
  unsure (1)..(159): unsure at all Xaa locations
  Clone ID: PAT_TA_103177.pep
MVRRWIRFLGKDEALKLMNWNNSDPYFSLRVNTTNGYTRDDLVNRLEDLQVHYEKSIMDEFVRIREGHAGSLQAGLLKEGMCAVQDESAGFVVSVVDPQPGETIMDCCAAPGGKTFFMASRLAGQGKVXALDINKGRLXILMXAAKCHNLDDIITDIHG

SEQ ID NO: 208760 - protein, 133 aa, Triticum aestivum
  unsure (1)..(133): unsure at all Xaa locations
  Clone ID: PAT_TA_103178.pep
MARALGGASAPNVGRGGRRAQASHASLDSDLEAFSHXNPAHGSFAPLAFQPSAMTNCVNQRFLSYXVELLSRHCHQXGKTNLSHDGLNPAHVPYWWVNNPTLGEFCFTMIGRAXDIEGSKSNVXMNAWLXQAS

SEQ ID NO: 208761 - protein, 100 aa, Triticum aestivum
  unsure (1)..(100): unsure at all Xaa locations
  Clone ID: PAT_TA_103179.pep
MAIKRTKAEKKIAYDQKLCQLLEEYTKVLIAVADNVGSKQLQEIRKGLRGDSIVLMGKNTLIRRCIKVHSEKTGNKDFLELSNLLVGNVGXIFTKGDLKE

SEQ ID NO: 208762 - protein, 115 aa, Triticum aestivum
  unsure (1)..(115): unsure at all Xaa locations
  Clone ID: PAT_TA_103180.pep
ALRLRTGSSSTARRSMTIFYNGRVVAVDVTELQAREIITMASQQILTEQQDSGGGGGGTAVAQYGAHENPSQPAPQRWAPLLASRSLLRDXGCCAGHQPSGRSSMHLEGRIIXLV

SEQ ID NO: 208763 - protein, 99 aa, Triticum aestivum
  unsure (1)..(99): unsure at all Xaa locations
  Clone ID: PAT_TA_103181.pep
PPAARPPHPPPWPAAAEEEGXSRPAPRAAPVRNPPAPARPAPPPATTQSSGGGXMSGIGSTNXXQGHWLFGTGSAMXHRAVDAVMGPXTIQHXTVVGEA

SEQ ID NO: 208764 - protein, 98 aa, Triticum aestivum
  unsure (1)..(98): unsure at all Xaa locations
  Clone ID: PAT_TA_103182.pep
XXXXXWAFXKYSXAVCRPVXPXXXKNXTXRXFLLKXKAAGKKGGHLRQRRRLXXMREPXRRLLGARGXREEQARGLLXAQQRRSAVRXLDKGPQVHRR

SEQ ID NO: 208765 - protein, 115 aa, Triticum aestivum
  unsure (1)..(115): unsure at all Xaa locations
  Clone ID: PAT_TA_103183.pep
MEGKEEDVRLGANRYSEHQPIGTAAQGGGADEKDYKEPPPAPXFEAGELTSWSFYRAGIAEFLATFLFLYISVLTVMGVVGNPSGSKCGTVGIQGIAWSXGGMIFVLVYCTAXXS

SEQ ID NO: 208766 - protein, 99 aa, Triticum aestivum
  unsure (1)..(99): unsure at all Xaa locations
  Clone ID: PAT_TA_103184.pep
VEDDGAASYNFAXVDADKPXXVRYHEQLLKLVRVGGTIIYDNTLWGGTVALPAGTPMSDLXTRFFXAXRDLNAKLAXDPRIEVCQLAIADGVTICRRIV

SEQ ID NO: 208767 - protein, 86 aa, Triticum aestivum
  unsure (1)..(86): unsure at all Xaa locations
  Clone ID: PAT_TA_103185.pep
MAAFAKIAMECVHDPLIWLLIASVALVILRRRRLNPPLPPGPKPLPIIGNMMMADQLTHRGLAALAKQYGGLLHLXLGSLRVFAVS

SEQ ID NO: 208768 - protein, 119 aa, Triticum aestivum
  unsure (1)..(119): unsure at all Xaa locations
  Clone ID: PAT_TA_103186.pep
PLPEPFNLREELYLDALXXGHSAEGVXEFSSEKGFSNASHFPQSFQKLMSQKSITKVTEKTRLLSDPVEVTSLXADDTGGPDRSSNKHVSXPVNTNISDTPSRHSISFCENSTPKQVIS

SEQ ID NO: 208769 - protein, 118 aa, Triticum aestivum
  unsure (1)..(118): unsure at all Xaa locations
  Clone ID: PAT_TA_103187.pep
CFVSVPXYTGFLPXLFWXGHGKLARXMTLLXAFCDYLGNAXKDXVSAPRPCSPPVRRVTATEDEKENAMEYGLPSSHALNTVCLXGYMXHYXLTYGPCDGFTIATGLSLAFMLVXXIG

SEQ ID NO: 208770 - protein, 93 aa, Triticum aestivum
  unsure (1)..(93): unsure at all Xaa locations
  Clone ID: PAT_TA_103188.pep
KIPTTPPPPPPLWIDPLQPTSSPSGLIPSNPAAATXEXXPTPXFSTAGDLFSSSLPPPPAADPCRTDLSSTVSVAPFPLIRSASCILAPRRRG

SEQ ID NO: 208771 - protein, 114 aa, Triticum aestivum
  unsure (1)..(114): unsure at all Xaa locations
  Clone ID: PAT_TA_103189.pep
KRIPRTGQRVTVVVGDPINFXDLMAENSNDSQHISRGDLYDKVTERIGQRLQQLKVEVDRLXXEQXAELQNRHTDNTVNDGYKVWQQVDWESFGIGNMLXSAEHSLAQEPXKQI

SEQ ID NO: 208772 - protein, 106 aa, Triticum aestivum
  unsure (1)..(106): unsure at all Xaa locations
  Clone ID: PAT_TA_103190.pep
PTKGEALEQAKKDMIGALKXLEADLGDKDYFGGEAFGFVDVAFVTLTPWFYTYXKYXDFXXEEHCPRIVAWAARCRERESVAKALTDPXKVXEIXRSMVTKQSLSM

SEQ ID NO: 208773 - protein, 75 aa, Triticum aestivum
  unsure (1)..(75): unsure at all Xaa locations
  Clone ID: PAT_TA_103191.pep
MEGAGLLWSQVGSPLASFPAMLFTVAAMAAGAFXVYFYAPSLRLRXVPGPLAYGLVGHLPLLDKHGSQAFGVLAK

SEQ ID NO: 208774 - protein, 140 aa, Triticum aestivum
  Clone ID: PAT_TA_103192.pep
QIRKFDQEASYQELTRMIIMHGYPLSIVEHEEMKRFAKGLNPVFNMASSLDMEEYSILLFQKEKSDLKEKIALSSRRVSLSASVWVPHGADPTVKYLCLTAHFIDAEWKLQRRIIKFGVLWSSPSDLERMIHCKEACVLE

SEQ ID NO: 208775 - protein, 93 aa, Triticum aestivum
  Clone ID: PAT_TA_103193.pep
MSEADRLRLRAAALALDGGAVRDKPDSKANVFADLGSPVSPLRARASMTTSSSSSSGSAKSPAQSNVGAVGAAGGRSHSGELAVESHPPRLPG

SEQ ID NO: 208776 - protein, 95 aa, Triticum aestivum
  unsure (1)..(95): unsure at all Xaa locations
  Clone ID: PAT_TA_103194.pep
LRSYTVPLHRCIAMMDLQEXNERLFYKLLIDNVEELLPVVYTPVVGEACQKYGSIYRRPXGALHXXLEDKGKVXEVXKNWPERSIXVIVVTDGEX

SEQ ID NO: 208777 - protein, 93 aa, Triticum aestivum
  unsure (1)..(93): unsure at all Xaa locations
  Clone ID: PAT_TA_103195.pep
PARQLWRPPIGALELGIVGXKGLLPMRTADGKGCTDAYAVAKYGXKWARTRTXXDSYDPAWXEQXYTWPVYDPCTVLTVGVLXDPHSLPDEGK

SEQ ID NO: 208778 - protein, 90 aa, Triticum aestivum
  unsure (1)..(90): unsure at all Xaa locations
  Clone ID: PAT_TA_103196.pep
IPCVSHDCDDVSTTYRPPGPKPNLRGDRPCACPAYPRNPVDGRCRSDDATTITXAANATDGXXNPXYPVXFRAVGSCAPGELLESLXVGA

SEQ ID NO: 208779 - protein, 100 aa, Triticum aestivum
  unsure (1)..(100): unsure at all Xaa locations
  Clone ID: PAT_TA_103197.pep
GDAKAVFVVEEDIAAYKVRAIDDPRTLNXTNILYMRPPVNMVSHNEFIAMWGRKTGRTXRIERIPEADLLKLIKGRKGTCIIVHLPGTHMVVCLYIVAAL

SEQ ID NO: 208780 - protein, 113 aa, Triticum aestivum
  unsure (1)..(113): unsure at all Xaa locations
  Clone ID: PAT_TA_103198.pep
MDRMQKITPNPKNYVLHRIIVSXLFLLLSCTAASGQQAPYKPLISRLAKDLNTSLYTIIIKADKSPLLLDLAGSLVWSXTCPPSAQSTVACGSGKCGSAASQECPHRCLHVDG

SEQ ID NO: 208781 - protein, 60 aa, Triticum aestivum
  Clone ID: PAT_TA_103199.pep
MGQGTPGGMGKQGGAPGDRGKPGGDGDKKDKKFEPPAAPSRVGRKQRRQKGPEAAARACI

SEQ ID NO: 208782 - protein, 56 aa, Triticum aestivum
  unsure (1)..(56): unsure at all Xaa locations
  Clone ID: PAT_TA_103200.pep
MAGGPVVNTGGGKDYPGKLTMFVLFACIVAATGGLIFGYDIGISGGVTXMNPFLMX

SEQ ID NO: 208783 - protein, 65 aa, Triticum aestivum
  Clone ID: PAT_TA_103201.pep
MGKKGSGWITALKKAFTTNPKDKPTNVQLVAQYPPQQPPPQPQQQYRGSARDKKRWGFGRSRQHA

SEQ ID NO: 208784 - protein, 102 aa, Triticum aestivum
  Clone ID: PAT_TA_103202.pep
VLSHGGGVATRVEGGGRSPGMSGGSREKELVRRGLRGAGSMDPDVAPLIRQTPDGSGEGIWGRVWSTNDPGEVVARGRSWWPGPVLGMAARRRGGKWWPAVR

SEQ ID NO: 208785 - protein, 93 aa, Triticum aestivum
  unsure (1)..(93): unsure at all Xaa locations
  Clone ID: PAT_TA_103203.pep
MAVQVVTSELVAPSEATPRRALWLSNLDLGARNGYSPTVYFFRAPDXGDGKAESFFSAXVLRAALARALVPFHPFAGRLXRGPHXRAEIDCND

SEQ ID NO: 208786 - protein, 74 aa, Triticum aestivum
  Clone ID: PAT_TA_103204.pep
LLDPQIYTKLRTAIEGNQLNNLQSLIACEQEARTGGIGGSHTLRRRRRRREPWLRLDRRFLGETGGGAGLDWIG

SEQ ID NO: 208787 - protein, 75 aa, Triticum aestivum
  unsure (1)..(75): unsure at all Xaa locations
  Clone ID: PAT_TA_103205.pep
SPXPAGAHDLNPSAPRRSVHPPSVSGEEKTDQSFGIGAEEDFLLTWPAPAIVDPSWRTGWPCRRHPARERSCQAS

SEQ ID NO: 208788 - protein, 113 aa, Triticum aestivum
  unsure (1)..(113): unsure at all Xaa locations
  Clone ID: PAT_TA_103206.pep
DFASSYGALLFQVSRLDXNGADHANKDXQVVKQQVAAGQYKQAQATLNRMLNWIIVNSGHVDVYNFLLDTGMDPVVAASSSPAVPEYSRYLESKSVGDSIXEAMNGAIKQKLK

SEQ ID NO: 208789 - protein, 113 aa, Triticum aestivum
  unsure (1)..(113): unsure at all Xaa locations
  Clone ID: PAT_TA_103207.pep
AGVLFALETVSSRWRSALLWRAFFTTXVVAVVLRALIDICKRGRCGLFGKGGLIMFDVTSGYVNYHVIDLPPVITLAVFGGVLGSLYNFFLDKVLRLYNVINEKGRTYRLLLA

SEQ ID NO: 208790 - protein, 155 aa, Triticum aestivum
  unsure (1)..(155): unsure at all Xaa locations
  Clone ID: PAT_TA_103208.pep
RKKGQKRARQQRFAFVTKSEVDHLEDGYRWRKYGQKAVKNSPFPRSYYRCTNSKCTVKKRVERSSEDPSVVITXYEGQHCHHQTSFQRGGMHFHGAATVALAEQMSFVSTQQLYNLPPLRRQQMNPASSESAVSSVPPSLQQLNGGDELRRSTSY

SEQ ID NO: 208791 - protein, 155 aa, Triticum aestivum
  unsure (1)..(155): unsure at all Xaa locations
  Clone ID: PAT_TA_103209.pep
ISAFAASRCISILFCTSXPLLPCREPRRYRLTMSSPDSIAAPSGSSVATAASDGNSDSNASHHHDTHSSMQHEEPEIRRPDSPSDDEATDFTSVVTRSEVAIDESEPSPEETIPTEQLEAAASLREVFETSASQRFQTRSSSMRAPTRLYPQRDE

SEQ ID NO: 208792 - protein, 109 aa, Triticum aestivum
  Clone ID: PAT_TA_103210.pep
MDSLSELYNLWQIQLIVLLSFVLQVFLFFTGSLRQGSTNGLLRGAIWLAYLGADMVAIYALGYLSRHQDNGTMETHPLVFFWTPFLLIHLGGQDTITAFSMEDNKLWLR

SEQ ID NO: 208793 - protein, 155 aa, Triticum aestivum
  Clone ID: PAT_TA_103211.pep
RGFVVFHAKFAENYRLYSRSHFVKGIELMTLLIVYQLFGQTSHSTIAYIFVTSSMWFLVLTWLFAPFLFNPSGFEWAKILDDWSDWNKWISNRGGIGVSPEKSWESWWEIEQEHLKHTGTIGIIFEIILSLRFFIYQYGLVYQLTIAKNNKSIVV

SEQ ID NO: 208794 - protein, 96 aa, Triticum aestivum
  unsure (1)..(96): unsure at all Xaa locations
  Clone ID: PAT_TA_103212.pep
MAAAAAARELRHRQVEANGITMHVAESGPASAAAPTVLFVHGFPELWYSWRHQMEHLAARGYRCVAPDLXGYGGTSAPSDPAXYTXLHVXGDLVRS

SEQ ID NO: 208795 - protein, 126 aa, Triticum aestivum
  Clone ID: PAT_TA_103213.pep
PELPHPNVPEVPKMPKVPHPTTPEVPHHVVPEMPHLIVPEVPKIPEVSHLLAPEAPKTELEHPPTPEVPKMPEIPEIPHPAIDEMPKIPEVPHIDVLEVSKPEVPHPAAPEGPKGKSHYPKTEAKP

SEQ ID NO: 208796 - protein, 69 aa, Triticum aestivum
  Clone ID: PAT_TA_103214.pep
QQKDQGDHGRGHNRDISGISSVVTMSFYPASSIAMHLSVFYVFRYIYKVSVPCIHDEYYYFVIVICLLV

SEQ ID NO: 208797 - protein, 114 aa, Triticum aestivum
  Clone ID: PAT_TA_103215.pep
QPLLDKLKSALYEAEDILDSVEYEHLKKQIQDAKSDGSKMDLLKKNVRSAMPSSPLKDKVTGMSKVELKKSLEKIESAINDACEILKQLNLPCVSNDKGRPAVPTNARSAGISP

SEQ ID NO: 208798 - protein, 68 aa, Triticum aestivum
  unsure (1)..(68): unsure at all Xaa locations
  Clone ID: PAT_TA_103216.pep
MEERYXALKELGTGNFGVARLVRDKSTKELVAVKYIERGKKIDENVQREIINHRSLRHPNIIPFXEVC

SEQ ID NO: 208799 - protein, 118 aa, Triticum aestivum
  unsure (1)..(118): unsure at all Xaa locations
  Clone ID: PAT_TA_103217.pep
VVPGVSRFTKSRAELTDGTXLDLDAVVMATGYRSNVPQWLQGTDFFGKDGYPTTAFPNGWKGQSGLYSVGFTRRGLSGASADAVRIAKDLGQVWREETKPTTKRAAGACHRRCISVIF

SEQ ID NO: 208800 - protein, 119 aa, Triticum aestivum
  Clone ID: PAT_TA_103218.pep
ADVLALAARDSVFMAGDLYYMVPMGRKDGYVSRAADTSALPAATLNASELIKVFVGDHGFTVPELVALSGAHTLGQAHCANFKNRLSGFGKAGKDPTMEAWMAASLAKTCKAGGDGATA

SEQ ID NO: 208801 - protein, 120 aa, Triticum aestivum
  unsure (1)..(120): unsure at all Xaa locations
  Clone ID: PAT_TA_103219.pep
LKNLPHLELLSLGHNLLNGTIPNDFNQLHXLKVLDLSSNRLSGEIPHALADLTNLTALLLDNNKLTGKIPAEFANAASLTTFNMSFNNLSGPVPTNSSAVGCDSIIGNPLLQSCHTYTLA

SEQ ID NO: 208802 - protein, 62 aa, Triticum aestivum
  Clone ID: PAT_TA_103220.pep
MACPAAALLLPLLLGFLAAPSPARATDPYAAFDWDVSYVTRSPLGVPQKVIAINKEFPGPVV

SEQ ID NO: 208803 - protein, 99 aa, Triticum aestivum
  unsure (1)..(99): unsure at all Xaa locations
  Clone ID: PAT_TA_103221.pep
RVGYAIKTDKLDALYEKVKXKGVTKTLLXVKAAGMALAQHPVVNASCRDGKSFSYNSSINIAVAVAIEGGLLTPVLEDVDKSDIYLLAQKWRALLKKTR

SEQ ID NO: 208804 - protein, 77 aa, Triticum aestivum
  unsure (1)..(77): unsure at all Xaa locations
  Clone ID: PAT_TA_103222.pep
MSGRGKGGKGLGKGGAKRHRKVLRDNIXGITKPAIRRLARRGGVKRISGLIYEETRGVLKIFLENXIXDAVTYTXHA

SEQ ID NO: 208805 - protein, 92 aa, Triticum aestivum
  Clone ID: PAT_TA_103223.pep
MAPIKIGINGFGRIGRLVARVALQSPDVELVAVNDPFITTDYMTYMFKYDTVHGQWKHHEVKVKDSKTLLFGQKEVAVFGCRNPEEIPWAAA

SEQ ID NO: 208806 - protein, 111 aa, Triticum aestivum
  unsure (1)..(111): unsure at all Xaa locations
  Clone ID: PAT_TA_103224.pep
LNTGGFAATMRDGFHTGILGKAPWSLSGNQGNFTQGDHTHYKLFVPGKTKGKGGPKAVIXPLNLGKTVCSQTVFPSPWAASGPGTLATAFFXGKXLGFPPLDGVRAQSXQV

SEQ ID NO: 208807 - protein, 207 aa, Triticum aestivum
  unsure (1)..(207): unsure at all Xaa locations
  Clone ID: PAT_TA_103225.pep
NRSPQXYXNXPXHQXWXPKRLDVPLVGLRWXVITIICDXPVVRXRIHMXXDANAHTHTHTIRTHILRILCAPHISYATXYAPYXFGLRXTSHIRTYAHNPSHITHTYASLYCXIVCTCXVTCXCCQQLXTTHAHFPHMCPXXCVHTCMCTLHITLVFGXMHTAXSXMVAQYXLAHXCILCHMWASHCAHAILQXYCTXVXSQQAYIT

SEQ ID NO: 208808 - protein, 158 aa, Triticum aestivum; identical to SEQ ID NO: 133204
  Clone ID: PAT_TA_103226.pep

SEQ ID NO: 208809 - protein, 169 aa, Triticum aestivum
  unsure (1)..(169): unsure at all Xaa locations
  Clone ID: PAT_TA_103227.pep
KKHQPPLLPRSPPPPSIHSPECQISLPQHASGSSAPPXPAASSSSPPATSAACSLATPPPPDPDAPPXHRPPWPCRRPPDAPLAADAVAPPAVVHSEPVAMPRPAVHKQRRRXPPPVVALWRPPVAFHQRWSHPPPGPVPTXDPHRRRPVPETAPAPPAHLDSVAAPPP

SEQ ID NO: 208810 - protein, 184 aa, Triticum aestivum
  Clone ID: PAT_TA_103228.pep
LVPNSAGHRSSSISISVSSMPSAMSGRGKGGKGLGKGGAKRTVSPPATTSRGITKPGHPGGLWRRAGAGVESGLSGAHLRSGGPGAAVAQRSSCGGTVIRRSGAVTYTGGTAAPARPSPPWDGCLRRLKATWDGTLYGFGRARLAAPGWLHRVGLCWDGWLVPLAMGFGFWRWRWSCFSIGLCS

SEQ ID NO: 208811 - protein, 92 aa, Triticum aestivum
  unsure (1)..(92): unsure at all Xaa locations
  Clone ID: PAT_TA_103229.pep
GNGERREFFGIHKLCVFDRTDGVSSSEPVIRLAKPGRNHQSATNWITPPPPKXGXGRXTRKHTXXSTXXAKXEXEHKRXGKNXKIPXMMRKG

SEQ ID NO: 208812 - protein, 187 aa, Triticum aestivum
  unsure (1)..(187): unsure at all Xaa locations
  Clone ID: PAT_TA_103230.pep
XPLPSDAAGRAGCXLGMMVTAAWQWMAQRLVSLEQXTDEVGXQAGTXCRCRRQAGSILEAGGQVIEVTAADLTGRGSWKGSLQDEQHHSASSGTLQDHQQEGRHSXHRHMKQVGHSFTAQHRWHRQHRQLQQHSXLVAELHSHQAAIAQHRWTLQGTVCFSAGHIVVEGIGDHGMLHAAAGIWRLGF

SEQ ID NO: 208813 - protein, 123 aa, Triticum aestivum
  unsure (1)..(123): unsure at all Xaa locations
  Clone ID: PAT_TA_103231.pep
MCPVPACSCAVMCCAVLCFPSCAVMCCVVLCFTVLCPCCXADVCLCCAVLCLLCXCAVLCCATVMCCACMLCVLCCVCYRACLVMCAGVLCLLCCAVLCCACYRAVQCPAVLCILCWRATLDV

SEQ ID NO: 208814 - protein, 120 aa, Triticum aestivum
  unsure (1)..(120): unsure at all Xaa locations
  Clone ID: PAT_TA_103232.pep
SSPVHSCVGFSFGXSTSXQWGVAGLGHTPRFXIFTRWALXASSAXGHXGSPGMVPLRLPLRAGALXVLISVFGXPXPCPVRFCGANARLXIXHPFVVLRYSFRGYPYVVRFXFFYSVVFV

SEQ ID NO: 208815 - protein, 96 aa, Triticum aestivum
  unsure (1)..(96): unsure at all Xaa locations
  Clone ID: PAT_TA_103233.pep
LLECDLYXLGRLXDTAGIWXTTYLVEYTVPGXPSGXIGLDSGILYWGQCGYLCHGXGXGSVAGXISXGXANANLNGLPLAVVATEIILGLQWNSWT

SEQ ID NO: 208816 - protein, 248 aa, Triticum aestivum
  unsure (1)..(248): unsure at all Xaa locations
  Clone ID: PAT_TA_103234.pep
MLHINIVVIGHVDSGKSTTTGHLIYKLGGIDKRVIERFEKEAAEMNKRSFKYAWVLDKLKAERERGITIDIALWKFETTKYYCTVIDAXGHRDFIKNMITGTSQADCAVLIIDSTXTGGFEAGISKDGQTREHALLAFTLGVKQMICCCNKMDATTPKYSKARYEEIVKEVSSYLKKVGYNPDXVPFVPISXGFEGDNMIERSTNXDWYKGPTLLEALDQIKSPRRPQTSPESSLXDVYKIGGLNCGL

SEQ ID NO: 208817 - protein, 63 aa, Triticum aestivum
  unsure (1)..(63): unsure at all Xaa locations
  Clone ID: PAT_TA_103235.pep
CSEFCATDALLLLLLLLLLLFFYSTTSTXXLLLLLLLLLLXLLLLLLLLYFXSLPRFXIYLSM

SEQ ID NO: 208818 - protein, 138 aa, Triticum aestivum; identical to SEQ ID NO: 141364
  Clone ID: PAT_TA_103236.pep

SEQ ID NO: 208819 - protein, 151 aa, Triticum aestivum
  unsure (1)..(151): unsure at all Xaa locations
  Clone ID: PAT_TA_103237.pep
MAPKAAEKKPVVAAEKTPAGKKPKAEKRAPASKEAGGEGKTRGRKKGSKAKKGVETYKIYIFKVLKQVHPDVXISSKAMSIMNSFINDIFXKLAGXSAKLARYNKKPTIXSREIXTSVRLVLPGXLAKHXVSEGTKAVTNSLHPRCPCFMN

SEQ ID NO: 208820 - protein, 103 aa, Triticum aestivum
  unsure (1)..(103): unsure at all Xaa locations
  Clone ID: PAT_TA_103238.pep
MSGRGKGGKGLGNGGANRHRKVLRDNIQGITXPAIRXLARRGGVKRIXGLIYQXTRGVLXIFLENVXRDXVTYXXHARRKTVTAMDVVYALNRHGRTLYGFSG

SEQ ID NO: 208821 - protein, 84 aa, Triticum aestivum
  Clone ID: PAT_TA_103239.pep
DSDMNKPKMRHYVHCYALHCLDEEASNALRSVFKERGENVGAWRQACYKPLVTIAGTQGWDIDAIFNAHPRLAIWYVPTSLSHV

SEQ ID NO: 208822 - protein, 138 aa, Triticum aestivum; identical to SEQ ID NO: 141364
  Clone ID: PAT_TA_103240.pep

SEQ ID NO: 208823 - protein, 140 aa, Triticum aestivum
  unsure (1)..(140): unsure at all Xaa locations
  Clone ID: PAT_TA_103241.pep
MSDTDEHHFESKADSGASKTYPQQAGAIRKGGHIVIKARPCKVVEVSTSKTGKHGHAKCHFVAIDIFNGKKLEDIVPSSHNCDVPHVDRQDYQLIDITDDGYVSLLTXESGNTKDDLKLPTDDVLLGPDQRTGFADGQGT

SEQ ID NO: 208824 - protein, 185 aa, Triticum aestivum
  unsure (1)..(185): unsure at all Xaa locations
  Clone ID: PAT_TA_103242.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLXRLDHNRALGQISERLGVQVSDVKNAII

SEQ ID NO: 208825 - protein, 168 aa, Triticum aestivum
  Clone ID: PAT_TA_103243.pep
GQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVA

SEQ ID NO: 208826 - protein, 39 aa, Triticum aestivum
  unsure (1)..(39): unsure at all Xaa locations
  Clone ID: PAT_TA_103244.pep
NVIRDAVTXTEHARRKTVTAMDVVYALKRQGRTLYGFGG

SEQ ID NO: 208827 - protein, 166 aa, Triticum aestivum
  unsure (1)..(166): unsure at all Xaa locations
  Clone ID: PAT_TA_103245.pep
ARAFWDVVVDSMKGDTPDYSYLVNLVNEVRDALHQMASKGWKEEITNNINLEILSQVLESSTQGTQYLGQILQYSLGMLRKLSSPAKEEEMKISHXKLLNELIGHSDSHDRDPNAFVIAVIKGLRFTMEELKALQSEVSRARIQLLKPIIKGSGGVESCRKLLPIA

SEQ ID NO: 208828 - protein, 166 aa, Triticum aestivum
  unsure (1)..(166): unsure at all Xaa locations
  Clone ID: PAT_TA_103246.pep
GTSFNQLRLSGLTPNEFRLLPSDCGSALASIFHGQQFHAQIIKAGADSDPHVSNALIDMYAKCGFIEEXXLLFESTXEKDVICWNSMISTYAQHGHAEEALRVFGMMGGAGVEPNYVTFVGVLSACAHAGLGEXGLHHFNSMKTKYAVEPGTEHYASVVNLFGRSG

SEQ ID NO: 208829 - protein, 167 aa, Triticum aestivum
  unsure (1)..(167): unsure at all Xaa locations
  Clone ID: PAT_TA_103247.pep
GTRYXXRERERERXREREIHXXXXRERXRXXDRHXHXXXETDXDLSXGGAXTPPLYPLXXXXXLDRXVXXSVTGXSLXXFPLFXXXSLIPXXAVWFXXHXXXPTXFXPFFXHLXXXXSSXRSXXXXXXLSXLCXNFSXFCXXYXLHXSPXXFXPFGLPSSXSLXXLP

SEQ ID NO: 208830 - protein, 86 aa, Triticum aestivum
  unsure (1)..(86): unsure at all Xaa locations
  Clone ID: PAT_TA_103248.pep
XRNKTNPXWYXGXXPXXXQXPVFGXXXGNXXSXQTHXGPSGXXHIVPTXXXXIVXXQXXLXXLXXVSXGSXXXXSXLSXXHSXAXX

SEQ ID NO: 208831 - protein, 145 aa, Triticum aestivum
  unsure (1)..(145): unsure at all Xaa locations
  Clone ID: PAT_TA_103249.pep
MARTKQTARKSTGGKAPRKQLATKAARKSAPATGGVXKPHRFRPGTVALREIRKYXKSTELLIRKLPFQRLVREIAHDFKTDLRFXSSAVSALXEXAXAYLVXALXGXXLCAIHAKRVXIXPKDIXLARRXRGERALLISDLVSS

SEQ ID NO: 208832 - protein, 51 aa, Triticum aestivum
  Clone ID: PAT_TA_103250.pep
HPPPPLPPSNSQPPPPNLPTPPEPASMAPKAHKSRPRRPRSRRRPRRPPRA

SEQ ID NO: 208833 - protein, 91 aa, Triticum aestivum
  Clone ID: PAT_TA_103251.pep
RERERERERERERERERERERERERERELVPNSAESPLLSSRRRRQEAANAEPSASPSALAYGGDSVRGGIGGSLLRTLAAVVGGTSPARA

SEQ ID NO: 208834 - protein, 151 aa, Triticum aestivum
  unsure (1)..(151): unsure at all Xaa locations
  Clone ID: PAT_TA_103252.pep
MAGRKGGDRKKAVTRSVKAGLQFXVGRIGRYLKKGRYAQRVGSGAPVYLAAVLEYLAAEMLELAGNAAKDNKKTRIIPRHLLLAVXNDQELGRLLAGVTIXHGGVIPNINSVLLPKKSPAAXEKEAKSPKKKTSTKVXQRRRSRSSPPINY

SEQ ID NO: 208835 - protein, 152 aa, Triticum aestivum
  unsure (1)..(152): unsure at all Xaa locations
  Clone ID: PAT_TA_103253.pep
MAPKAEKKPAAKKPVEEEPAAEKAEKTPAGKKPKAXKRLPAGKSSAAAKEGGKAXKXAKKSVETXKIYIFKVLKQVHPDIGISSKAMSIMNSFINDIFEKLAGEAAKLAKXNKKPTITSREIQTSVRLVLPGXLXKHAVSEGTKAVTXFTSS

SEQ ID NO: 208836 - protein, 151 aa, Triticum aestivum
  unsure (1)..(151): unsure at all Xaa locations
  Clone ID: PAT_TA_103254.pep
MAPKAEKKPAAAEKTPAAEKTTAGKKPKAEKRPPKSKEGGADKKKKKAKKSVETYKIYIFKVLKQVHPDIGISSKAMSIMNSFINDIFEKLAGESAKLARYNKKPTITXREIQTXVRXVLPGELAKHAVSEGTKAVTKVHILLDRLVSFRG

SEQ ID NO: 208837 - protein, 151 aa, Triticum aestivum
  unsure (1)..(151): unsure at all Xaa locations
  Clone ID: PAT_TA_103255.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGKLLAGVTIAHGGVIPNINSVLLPRKXPAGXEKEAKSPRKKTTGKSSKKENGRTKGVARP

SEQ ID NO: 208838 - protein, 151 aa, Triticum aestivum; identical to SEQ ID NO: 208837
  unsure (1)..(151): unsure at all Xaa locations
  Clone ID: PAT_TA_103256.pep

SEQ ID NO: 208839 - protein, 74 aa, Triticum aestivum
  unsure (1)..(74): unsure at all Xaa locations
  Clone ID: PAT_TA_103257.pep
RCXLRLLLXXXRXFFPATQGPITPQHYXNSDSSNCALIKHRSLTTNGAEGCTNCNNRNNIILTAVLVITVGTTI

SEQ ID NO: 208840 - protein, 110 aa, Triticum aestivum
  Clone ID: PAT_TA_103258.pep
FSLLFFFFLFTFVNLLSISLHYIHNVGCNYLNRGCTINNLHNLNTLPNLPNSGANTRPWPGNILTQLSQPIDRHNNALGMPMRLSTPTSRLPIAYTLNSNSISRRSTNDW

SEQ ID NO: 208841 - protein, 149 aa, Triticum aestivum
  unsure (1)..(149): unsure at all Xaa locations
  Clone ID: PAT_TA_103259.pep
MAPKAEKKPAEKKPAAEVAEKAEKTPAGKKPKAEKRLPASKSAKEGGDKKGRKKNKKSVETYKIYIFKVLKQVHPDIGIXSKXMSIMNSFINDIFEKLAGXGGKLARYNKKPTITYREXQTSXRLVLPXELAKHAVXEGTKAVTKFTSN

SEQ ID NO: 208842 - protein, 194 aa, Triticum aestivum
  unsure (1)..(194): unsure at all Xaa locations
  Clone ID: PAT_TA_103260.pep
GTSSFSLHPXPKSHAASIAFFLTPAAPSPAVNALAVVFAXADSSHIRVQIDLAXETGGQTGPXXXPKKXXSWXDXNXTXGTXQVRLFXXXLPKPAXALXFXPXHXXFGLLLRXTXPMXXGFXFFXXNWXLXXXAFKXXXGPSXLKXFQAXNPXGYXVNKXRLQNGFPGVSXXKRXPXGFGXFFXGXXFXGGXFF

SEQ ID NO: 208843 - protein, 30 aa, Triticum aestivum
  Clone ID: PAT_TA_103261.pep
NQINAKNTAVLKLMRLLSAEVTAYIHNGHQ

SEQ ID NO: 208844 - protein, 136 aa, Triticum aestivum
  unsure (1)..(136): unsure at all Xaa locations
  Clone ID: PAT_TA_103262.pep
MAPKAAEKKPVEKTPAGKKPKAEKKVPASKEGGDKKGKKKAKKSVETYKIYIFKVLKQVHPDIGIFSKGMSIINSFINDIFEKLSGESSKLARYNKKPTITSREIQTSVRLVLPGELAKXHPSPRGTKGVTKFTSS

SEQ ID NO: 208845 - protein, 128 aa, Triticum aestivum
  unsure (1)..(128): unsure at all Xaa locations
  Clone ID: PAT_TA_103263.pep
PETDSGRRWTLGTVAILGNCVCLACWYLLQGRIARKYPYVYSCNAFLSTFSFLQVAVVXLCVQHNLSAWIITNKFQILTXLXSGVVATGMSFVLLTWCIQKRGAVFVAAFIPXVSQVIVCIMDFTIPA

SEQ ID NO: 208846 - protein, 89 aa, Triticum aestivum
  Clone ID: PAT_TA_103264.pep
LVASSLKNDFIKNTYSDFLIIREKISLEVLSKCSYKAPNLVSEGQKVAKYSWIVPCYKLHFPQGPHCKNNIISSRQDAHLKHLQINSHS

SEQ ID NO: 208847 - protein, 95 aa, Triticum aestivum
  unsure (1)..(95): unsure at all Xaa locations
  Clone ID: PAT_TA_103265.pep
HPAKQRPXAPKAEKKPAXAEKTPAAEKTTAGKXPKGEXXAPKCKGGGADKKKKKAKXSVETYKSYIFKVLKQVHPDIGISSKAMFIMNSFINDIF

SEQ ID NO: 208848 - protein, 153 aa, Triticum aestivum
  Clone ID: PAT_TA_103266.pep
FLRLCPGARSATVQNLVDRLKNIGDLLSVTVTQYGDLHLQVSTSLVTVGSEFKRLRILGARANAPVVDQNVSATIRMEMAVERGEALSVQVSMKHLVKSLQCHLAKPDCTFYGIAPNGACLTVIFQYFIPGTRLTDKSISFYCRLPVLDPGTS

SEQ ID NO: 208849 - protein, 112 aa, Triticum aestivum
  unsure (1)..(112): unsure at all Xaa locations
  Clone ID: PAT_TA_103267.pep
ALXASPSFPAAVICAYLATVLLLHRRILPLPPLPPRALRAVSALHNCVLLALSAAMAAGCVLSAAATAPSPRWAFCFPPGGATEPSGPVFFWAHVFYLSKMYELGDTLLILL

SEQ ID NO: 208850 - protein, 109 aa, Triticum aestivum
  unsure (1)..(109): unsure at all Xaa locations
  Clone ID: PAT_TA_103268.pep
MAPKAEKKPAAAEKTPAAEKTTAGKRPKAEXXPPKCXXGGADKKKKKAKKSVETYKXYIFKVLKQVHPDIGISSKAMSIMNSFINDIFEKLXGEXXKLARYNKKATITS

SEQ ID NO: 208851 - protein, 73 aa, Triticum aestivum
  unsure (1)..(73): unsure at all Xaa locations
  Clone ID: PAT_TA_103269.pep
RYXNSFLQNIFYSGGAGTSDKKVEKNEEVFKGPRRVVVNITDIKRPPLPQYVDKYPPCSTHQCHHSDHEIACY

SEQ ID NO: 208852 - protein, 209 aa, Triticum aestivum
  Clone ID: PAT_TA_103270.pep
HHMLSQKEKIIYCGWLDRFRGIFDPCFVASAQLNYNCVSVHPVDHMKLIFLAFPLQEELCRDAGETNWDYISTMMHPDVMGCRIDWVKKKKIMIVHEMTETDPACEMKIKHEALAKKFQHRFCTLFNDMFGAGLVETRGLSFVYPLVAQHGQCSSGVYILHYFVEFIRLPTINTNPGSDRALAQEVCLRNSDHEGKQWGYSGALIRHNH

SEQ ID NO: 208853 - protein, 249 aa, Triticum aestivum
  unsure (1)..(249): unsure at all Xaa locations
  Clone ID: PAT_TA_103271.pep
PVPAKKKTEKVTNPLFEKRTKQFGIGGALPPKKDLHRFVKWPKVVRIQRQXRILKQRLKVPPALHQFTRTLDKNLATNLFKMLLKYRPEDKVAKKERLLKRAQAEAEGKTVEAKKPIVVKYGLNHVTYLIEQSKAQLVVIAHDVDPIELVVWLPALCRKMEVPYCIVKGKSRLGSIVHKKTASVLCLTTVKNEDKLEFSKILEAIKANFNDKFDEVRKKWGGGVMGSKSQAKTKARERLIAKEAAHGLN

SEQ ID NO: 208854 - protein, 93 aa, Triticum aestivum
  unsure (1)..(93): unsure at all Xaa locations
  Clone ID: PAT_TA_103272.pep
MSDTDEHHXESKGDSGASKTYPQQAGAIRKXGHIVIKARPCKVVEVSTXKTGRXXHAKCHFGAIDIFNGKNLRISXXSXHNXDVPMLTARILI

SEQ ID NO: 208855 - protein, 88 aa, Triticum aestivum
  Clone ID: PAT_TA_103273.pep
YKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 208856 - protein, 149 aa, Triticum aestivum
  Clone ID: PAT_TA_103274.pep
PTGSGKTHTVFGTARNPGLVPLTLQKIFAAADESEGGNQSPRSFYLSMFEILCEGKGEQILDLLSGGAELVLQQSATIKGLKEVAISSAMDAESVVSRGMLKRSTAATDANSESSRSQCIITIRAVHKKIEQQSEYPISGSVLTIADLA

SEQ ID NO: 208857 - protein, 176 aa, Triticum aestivum
  Clone ID: PAT_TA_103275.pep
TPRHLRTTIHFLPAPLGWAVQSRRNRRFRHNFQRSCVPFPSLIGSTNGKSPWLASRVARVGPWGIPNWNPPFLKKFLWALNPRKFFLRGPTRVREIPPKFGPFSKFSRVSKPKPQKPFGPLFFFGGAFGKPFPGRGAPGVPFFWGIGGVGLPLSCNCKFWQWLNSFFRKGSNAWNA

SEQ ID NO: 208858 - protein, 84 aa, Triticum aestivum
  unsure (1)..(84): unsure at all Xaa locations
  Clone ID: PAT_TA_103276.pep
MAPKAEKKPAAAEKTPAAEKTTAGKSXKAEKRPPKSKEGGADKKKKKAKKSVETYKIYIFKVLKQVHPDIGISSKAMSIIELLY

SEQ ID NO: 208859 - protein, 156 aa, Triticum aestivum
  Clone ID: PAT_TA_103277.pep
QLGRHPPSTSEEKHGKALPANFKKMLSVQLRASAAKGKLVKVKASYMLSDAAKKDAPKPKAAAKPSKDAAKPKKKAAEKPKKTAAAGTKRKAPEKKEAGHQGPRKSPACQRPKAERPEGTGPGSPGGKGKGPAKGPPRPALEPGLESPPGLGLGAL

SEQ ID NO: 208860 - protein, 104 aa, Triticum aestivum
  unsure (1)..(104): unsure at all Xaa locations
  Clone ID: PAT_TA_103278.pep
MAAKEPMRVLVTGAAGQIGYALVPMIARGVMLGADQPVILHMLDIEFAAEALKGVKMELIDAXAFPLLKGVVATTDVVEACTGVNVAGMVGGFPRKEGMERKDV

SEQ ID NO: 208861 - protein, 122 aa, Triticum aestivum
  unsure (1)..(122): unsure at all Xaa locations
  Clone ID: PAT_TA_103279.pep
MAPKADKXPAAEIKVEKAAEKTPAGKKPKAEKRLPAGKTASKEAGGEGKTRGPEEGXSRAKKGVETYKIYIFKXVLKQVHPDIGILLPRANVPFMKLPFIQTEPFFPKNGFRPGRPQRAFPR

SEQ ID NO: 208862 - protein, 125 aa, Triticum aestivum
  unsure (1)..(125): unsure at all Xaa locations
  Clone ID: PAT_TA_103280.pep
MSGRGKGGKGLGKXGAKRHRKVLRDNIQGITKPAIRRLARRGGVKRISGLIYEETRGVLKIFLENVIXRDAVTYTEHARRKTVTXMDVVYALKRQGRTLLRISEARATTTRFRSVLGVPWAVGCK

SEQ ID NO: 208863 - protein, 97 aa, Triticum aestivum
  unsure (1)..(97): unsure at all Xaa locations
  Clone ID: PAT_TA_103281.pep
KAKKSVETXYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 208864 - protein, 117 aa, Triticum aestivum
  unsure (1)..(117): unsure at all Xaa locations
  Clone ID: PAT_TA_103282.pep
KSEAANYEKGYGEPMPVKEVADRVASYVHTAYTLREKLRPSGRGGHVGGYDRDRPQLYMNDPSGLSYKHLGAAPGKGRQAAKTEIXEKFKLNELTCRECIXKVAKIIXGAHDETERH

SEQ ID NO: 208865 - protein, 69 aa, Triticum aestivum
  unsure (1)..(69): unsure at all Xaa locations
  Clone ID: PAT_TA_103283.pep
RSEPSTFRGGPTTPRPYXSASYNDTWNVPLQRKXWENPVQTPLSDVAVHPTVASWGNDHKAGTNRPRDH

SEQ ID NO: 208866 - protein, 136 aa, Triticum aestivum
  Clone ID: PAT_TA_103284.pep
MARTKQTARKSTGGKAPRKQLATKAARKSAPATGGVIKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 208867 - protein, 136 aa, Triticum aestivum; identical to SEQ ID NO: 106789
  Clone ID: PAT_TA_103285.pep

SEQ ID NO: 208868 - protein, 167 aa, Triticum aestivum
  Clone ID: PAT_TA_103286.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAATEEAKKSNNVQRKLEKRQQ

SEQ ID NO: 208869 - protein, 103 aa, Triticum aestivum; identical to SEQ ID NO: 107316
  Clone ID: PAT_TA_103287.pep

SEQ ID NO: 208870 - protein, 103 aa, Triticum aestivum; identical to SEQ ID NO: 107316
  Clone ID: PAT_TA_103288.pep

SEQ ID NO: 208871 - protein, 132 aa, Triticum aestivum
  Clone ID: PAT_TA_103289.pep
RAVFPSIVGRPRHQGVMVGMGQKDSYVGDEAQSKRGILTLKYPIEHGIITNWDDMEKIWHHTFYNELRVAPEEHPVLLTEAPLNPKANREKMTQIMFETFNSPAMYVAIQAVLSLYASGRTTGIVLDSGDGV

SEQ ID NO: 208872 - protein, 83 aa, Triticum aestivum
  Clone ID: PAT_TA_103290.pep
GTLKLHITYAHGLHHDKDAHITNDNTKYPEIKLNILVVECTRTTTPGSCVISEQPCSWNLLMLPPTMQFSPVLLDSSFPSKHC

SEQ ID NO: 208873 - protein, 185 aa, Triticum aestivum
  Clone ID: PAT_TA_103291.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITA

SEQ ID NO: 208874 - protein, 173 aa, Triticum aestivum
  Clone ID: PAT_TA_103292.pep
MKEELQKQYASLGESLKKVEAEQMECLRSYGDEKEARIAAESSRNELSEELNRVKLEQKRLNDQIKMLQDTNKRLQEYNTSLQQYNCNLQADATKNAETIDKLQKEKNTMVETMNGLKDHSNSVKLQLEMAKSSQSEALKQKNNLLSEVEALRGELHQVRDDRDHKSAEINSL

SEQ ID NO: 208875 - protein, 172 aa, Triticum aestivum
  Clone ID: PAT_TA_103293.pep
NEVAEVLDTFHVLAELPSDSFGAYVISMATAPSDVLAVELLQRECHVKKPLRVVPLFEKLADLEAAPAALARLFSVEWYRNRINGKQEVMIGYSDSGKDAGRFSAGWQLYKAQEELIKVAKAFGIKLTMFHGRGGTVGRGGGPTHLAILSQPPETIHGSLRVTVQGEVIEQS

SEQ ID NO: 208876 - protein, 150 aa, Triticum aestivum
  Clone ID: PAT_TA_103294.pep
LVQIPMYNEKEVYKLSIGAVCALTWPPDRIIIQVLDDSTDPIIKELVELECQEWASKKIDIKYEVRNNRKGYKAGALKKGMEHVYAQQCEFVAIFDADFQPESDFLLKTIPFLVHNPKIALVQTRWKFVNYDACLMTRIQKMSLDYHFKV

SEQ ID NO: 208877 - protein, 103 aa, Triticum aestivum; identical to SEQ ID NO: 107316
  Clone ID: PAT_TA_103295.pep

SEQ ID NO: 208878 - protein, 132 aa, Triticum aestivum
  Clone ID: PAT_TA_103296.pep
PNPSSMATVAMDISKPPPAASGDESAKGARGGGEGLRQYYLQHIHDLQLQIRQKTHNLNRLEAQRNDLNSRVRMLREELQLLQEPGSYVGEVVKVMGKSKVLVKVHPEGKYVVDIDKSIDITKITPSTRVAL

SEQ ID NO: 208879 - protein, 56 aa, Triticum aestivum
  unsure (1)..(56): unsure at all Xaa locations
  Clone ID: PAT_TA_103297.pep
CHTHLSQEYXVGHILQGXKIQKKNKHELLFFSFLQHIPTNVTTHFTAHTNKMIRND

SEQ ID NO: 208880 - protein, 132 aa, Triticum aestivum
  unsure (1)..(132): unsure at all Xaa locations
  Clone ID: PAT_TA_103298.pep
HERRWNXXRVADAVVMEDERSVRLISQDHDLGFLDIRSRGSVQEPWTYCNTTTPTCYPKLAVHGGLLLASKDDSISVYGGPNHDRLRLALRGSQGGGAIADFSVGGDRLFAVHHEDNVPDVWETLPPPIASI

SEQ ID NO: 208881 - protein, 113 aa, Triticum aestivum
  Clone ID: PAT_TA_103299.pep
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAG

SEQ ID NO: 208882 - protein, 114 aa, Triticum aestivum
  Clone ID: PAT_TA_103300.pep
AEKKVPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 208883 - protein, 96 aa, Triticum aestivum
  Clone ID: PAT_TA_103301.pep
LPRDTMARRAEEDRRFDLISSFLLGSEKGHALTAGRLAGQPLVDDWRCLETMVSSYEDHCGPLSTYGRKYLRVLASVCNAGIPEEVMAKAASQLCW

SEQ ID NO: 208884 - protein, 138 aa, Triticum aestivum; identical to SEQ ID NO: 141364
  Clone ID: PAT_TA_103302.pep

SEQ ID NO: 208885 - protein, 264 aa, Triticum aestivum
  unsure (1)..(264): unsure at all Xaa locations
  Clone ID: PAT_TA_103303.pep
CVQAFKXRSDFQTLWAWXWTKRLSLCLDPKPKLAFCRSPIQSPMPLWXSPPCHXEARRKANLNAMDCIPCLSHSTTHRPSSFRPSGSPFSYSVPTLMDASSTDGTQPPCSCPPSTVLLCLLLLVLPLLPAGRDAPLLGLNGVARTLLCLEEEEASCDRGGDGVDGDEEAAATNVTLLLLGSFFAAPEENKNLEEKRSRDMPLLHGPGCRRRRRRWRRAAGEEPRRREREGSEGLTGDSAQPRRVKSSLALGRRGGGGRWRVARA

SEQ ID NO: 208886 - protein, 100 aa, Triticum aestivum
  Clone ID: PAT_TA_103304.pep
GSLCSICLFRLLFLFYAGMVCPICHNPDGPCEPGDLVLHEFDVVLNESCFRHMYIPYNFRAFVAYYIDEQRDAAMMLQYKKVEPALLTYEGRSYPPLFKH

SEQ ID NO: 208887 - protein, 175 aa, Triticum aestivum; identical to SEQ ID NO: 115797
  Clone ID: PAT_TA_103305.pep

SEQ ID NO: 208888 - protein, 89 aa, Triticum aestivum
  Clone ID: PAT_TA_103306.pep
QHNACIALPQPRFHGLGCSHFARRYYGNRFCFLFLWLLRCFSSPGCLLPAHGFSRQFKRLTYLGISGSMLIFNSPKHFVACYALPRLLV

SEQ ID NO: 208889 - protein, 175 aa, Triticum aestivum; identical to SEQ ID NO: 115797
  Clone ID: PAT_TA_103307.pep

SEQ ID NO: 208890 - protein, 151 aa, Triticum aestivum
  Clone ID: PAT_TA_103308.pep
ARDNFSPKVSGFSLSRALTIEYNYDDSVVVRRHYSDPSFVQCGLLTVKSDVYSFGIILMELISRKLSTYDEDCELTDLVILYNKAYDSEKRGAAMFDKDITADKDIILLEDIGKLAIECTKLGPDLRPTMKEVAERLEILRASWGKASQGR

SEQ ID NO: 208891 - protein, 259 aa, Triticum aestivum
  unsure (1)..(259): unsure at all Xaa locations
  Clone ID: PAT_TA_103309.pep
MAGATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSFXPLGXAEDPEAFAELKVKEIXNGRXMFSMFGFFVQAIVPQGALENLPTLXDPXNNNAGPCNXXVX

SEQ ID NO: 208892 - protein, 120 aa, Triticum aestivum
  Clone ID: PAT_TA_103310.pep
HEPRSQPQQPATLGGACSPSAHSLLPGSSAPLALPRCLWRAASLASPLVALAGRGCARAPTVVVACWPEAHAPASWSPPRRHRSRAAPFASFPELSCLPPLSRPKSVLHVTEYACRPPPA

SEQ ID NO: 208893 - protein, 184 aa, Triticum aestivum
  unsure (1)..(184): unsure at all Xaa locations
  Clone ID: PAT_TA_103311.pep
MALHLLTPTHLHHPSSPLPRRRAAASATATLAHPLRAHPRLRLRLATAASSPRTGPRRAGMSAIRSSLIDPDGGALVDLVAPPGRRAALRAEAEALPRXRIAAXDVEWAHVLAEGWAXPLXGFMRKHEYLXVXLTSNFXXLPSXGXVNMSXSIVLRRKPVKGTGVRSPRTPCAPQRGEALDCLK

SEQ ID NO: 208894 - protein, 70 aa, Triticum aestivum
  unsure (1)..(70): unsure at all Xaa locations
  Clone ID: PAT_TA_103312.pep
GPLXAPAXAXXXXSRXXSXSWSSSRAALXTXSPGXXSAXSAASPAXSIPDGXXDAIDAASAPMIQLXVSD

SEQ ID NO: 208895 - protein, 95 aa, Triticum aestivum
  unsure (1)..(95): unsure at all Xaa locations
  Clone ID: PAT_TA_103313.pep
HAANWCYATVXAPRARSSTXVASLGTPAPFNSSSFRPKLIRNTPVQAAPVAPALMDAXVERLKTGFXKFKTEVYXQEARFXLSXSRPXQAPKYIL

SEQ ID NO: 208896 - protein, 152 aa, Triticum aestivum
  unsure (1)..(152): unsure at all Xaa locations
  Clone ID: PAT_TA_103314.pep
MANPRVFFDMTVGGAPAGRIVMELYKDAVPRTVENFRALCTGEKGVGKSGKPLHYKGSAFHRVIPDFMCQGXDFTRGNGTGGESIYXEKFADEXFVHKHTKPGILXMDNAGPNTNGSQXFICTXPCIWXDGKHVVFGEVXXGXXXXXNXXXX

SEQ ID NO: 208897 - protein, 117 aa, Triticum aestivum
  unsure (1)..(117): unsure at all Xaa locations
  Clone ID: PAT_TA_103315.pep
MAAQGLLSGRQLLGRPLQSSISRSSSSRKXPFVVRASSSPPAKQNDNKQLWFASKQSXTYLDGTLPXDFGFDPLGLPDPXGHXCGFIXPXWLLTRRFNWVIDVCLHYFHSYLSTTLL

SEQ ID NO: 208898 - protein, 106 aa, Triticum aestivum
  unsure (1)..(106): unsure at all Xaa locations
  Clone ID: PAT_TA_103316.pep
MAPTVMASXAXFVXPXQGLKSTXXXPXSRXSNXASLXSXSNGGRIRCMQVWPIEGIKKFETLXYLPPLXNGGXFLKHVDYLIRSKWPXCLXFIPGSXFXFPLPFLL

SEQ ID NO: 208899 - protein, 156 aa, Triticum aestivum
  unsure (1)..(156): unsure at all Xaa locations
  Clone ID: PAT_TA_103317.pep
HEPKYLGPFSEQTPSYLTGEFPGDYGWDTAGLSADPETFAKNRELEVIHSRWAMXGALGCVFPEILSKNGIKXGEAXWFKAGAXIFXEGXLDYLXNPNLVXAXSXLAIWAVXVVLXGFXEGYRXCXGPLXXGLXIIYPXXGFXPFXLXXXXXXXLK

SEQ ID NO: 208900 - protein, 175 aa, Triticum aestivum; identical to SEQ ID NO: 115797
  Clone ID: PAT_TA_103318.pep

SEQ ID NO: 208901 - protein, 210 aa, Triticum aestivum
  unsure (1)..(210): unsure at all Xaa locations
  Clone ID: PAT_TA_103319.pep
MXAXFSSTXXAPAXTPTNXLGKKLKKQXTXXXNYHXKSSKANRFTXMXXXNXDEXRNTDKXKGLAYDISDDQQDIXRGKGIVDSLFRRPXGRRTHEAVLKLLXYVSQGLXKYDFXNTMGGFYIAXAFMDKXVXHXFKNFMTLPNIKXPLXLGIWGGXGQXKSXQCELXFAXMGINPIXXSXGELXXGTXXXPARLLRXXYRXGXDMIXXX

SEQ ID NO: 208902 - protein, 154 aa, Triticum aestivum
  unsure (1)..(154): unsure at all Xaa locations
  Clone ID: PAT_TA_103320.pep
TAATRRAAASRSRPSRSIVIGVRRGWSESGRSPPIRGFICLASTRRHQIGAPIAFFDPETTAGATRRATAGGHCKSGTPHSIVILXRGGWSESAPXSTNRGLISIRKGCXALNFREEAGSXLTTXXXFLSGXLSGGXQESXXXNXKDXXXXXFG

SEQ ID NO: 208903 - protein, 69 aa, Triticum aestivum
  unsure (1)..(69): unsure at all Xaa locations
  Clone ID: PAT_TA_103321.pep
FLGXPGFAXGSDGAATAALTRKRTAPRRAGRTGRGEAVLAAMPWWCXAGLRRESSMADAILCVTDSLVP

SEQ ID NO: 208904 - protein, 157 aa, Triticum aestivum
  unsure (1)..(157): unsure at all Xaa locations
  Clone ID: PAT_TA_103322.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGXGTANQCPTIDGGFXFFPLRSXSLDEXVXLXPXFFIXXXXGNEKALPRKLPVFFLL

SEQ ID NO: 208905 - protein, 179 aa, Triticum aestivum
  unsure (1)..(179): unsure at all Xaa locations
  Clone ID: PAT_TA_103323.pep
MAAAFFSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLXFGYLGXGKGQGKTFQCELXFAXMGINPNH

SEQ ID NO: 208906 - protein, 192 aa, Triticum aestivum
  unsure (1)..(192): unsure at all Xaa locations
  Clone ID: PAT_TA_103324.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIXFKPPGCEESARPKQAHYHGPHIKCHCFQL

SEQ ID NO: 208907 - protein, 187 aa, Triticum aestivum
  unsure (1)..(187): unsure at all Xaa locations
  Clone ID: PAT_TA_103325.pep
ILQIRLPLSKLGVFLPVISLLAASERGDFRMIVASSVHKKENPLALLGQYSDDEEEDEVATDQPIGETKGSPTDASAEVIHDQGDITGDNGDADSELPASVSVQQEVSQADDVKIITETVAQEFTVAPDPTLENECVTAMEAVPDSSGMQIGGDIGGNWKAXMHDXVIXATTXTQXQEKLLXEXXKX

SEQ ID NO: 208908 - protein, 134 aa, Triticum aestivum
  unsure (1)..(134): unsure at all Xaa locations
  Clone ID: PAT_TA_103326.pep
MEGEKNSFDLMXXSXLFAEAXXTGYXKNSVEGIXKEKVAXGASAXIXYSAXXXGKLXDXPXXQXLXKAXGYLKQYXSGGXXXXKTDXPAXADAPKPXAPXDAAPAPAPAAEEXXSSDGFXXYXXXXGAXXXXXK

SEQ ID NO: 208909 - protein, 104 aa, Triticum aestivum
  unsure (1)..(104): unsure at all Xaa locations
  Clone ID: PAT_TA_103327.pep
GTRPLARIAGAKVLAFDRPAFGLTSRXRWSGDDTKPLNPYSMXFSAMATLAFIDHLGAGKADLVGHSAGCLVAVEAYFEAPERVAALVLVAPAIXXPRKGEKEN

SEQ ID NO: 208910 - protein, 135 aa, Triticum aestivum
  unsure (1)..(135): unsure at all Xaa locations
  Clone ID: PAT_TA_103328.pep
ARXXXNXXXXRXMXHAXLSTISXIXYLCXXXXXXGPXPXIXCAXIXPTSXXXXCIXICALTLWIXGDIIVTYTLPVMLNXIXLXGXFRIYAXAXILAXGFVXMXVPDTKGMPLXVXTEXXSXXAXXXKEATDYLL

SEQ ID NO: 208911 - protein, 97 aa, Triticum aestivum
  Clone ID: PAT_TA_103329.pep
QHNACIALPQPRFHGLGCSHFARRYYGNRFCFLFLWLLRCFSSPGCLLPAHGFSRQFKRLTYLGISGSMLIFNSPKHFVACYALPRLWVPRYPPPRA

SEQ ID NO: 208912 - protein, 195 aa, Triticum aestivum
  unsure (1)..(195): unsure at all Xaa locations
  Clone ID: PAT_TA_103330.pep
MAASSLLRSLSRVSRRGCAPAFYRPRXPLSPLSTAAAAXASDAGDAXXLRRGLAGLGPTAXGEKPRXVXXXTXWAGSXLMKDLXXTGYXVXXVXPRXHMXFTPVXAXTXXXTXEXXSXAXXIQXAXSTXPGFXFXXAXCTGVXPXAHTIDWETXVLKVEKDTXKPXEIXGMKKLWLEEGILGIELNGTCQFFGKK

SEQ ID NO: 208913 - protein, 156 aa, Triticum aestivum
  unsure (1)..(156): unsure at all Xaa locations
  Clone ID: PAT_TA_103331.pep
AGGSGAVAPPQSPQAPRAGGKXGGERDGXGEXGRARAGGRWAPGXGGRAWGSGGRRGRAGGGAGXRGSGGSGGGRGAGGSRAAWRGAGXGACGRSGAGSRAPPAGPAPGSGPAXGGGMGLAGAAGAGXAFAAHRTASVRGSGVVGAAAGWRRRPRA

SEQ ID NO: 208914 - protein, 227 aa, Triticum aestivum
  unsure (1)..(227): unsure at all Xaa locations
  Clone ID: PAT_TA_103332.pep
MGKIKIGINXFGRIXRXVXRVALQSDDVELVXVNDPFITTEYMTYMFKYDTVHGHWKHSDXKLKDDXTLLFGEKPVTVFGVRNPEEIPWGEAGADYVVESTGVFTDKDXAAAHLKGGAKEXXSXLXQXKMPPMFEXGXNEDKYTSDVNIXSNARCTTNCLAPLSKXLNDNXGXIXGLXDPCXXITXPTXXPXMXPXXRXSKKGKAFNHSGAWQAQLSEGLNRFLGSP

SEQ ID NO: 208915 - protein, 184 aa, Triticum aestivum
  unsure (1)..(184): unsure at all Xaa locations
  Clone ID: PAT_TA_103333.pep
GTSRRNCRLLWCTMCGSGICLIACATGAAIAGLVIATHAMAALLAAAPACAAPRVSCCSTLAWMKRLQQHMDRLDAAARGADVLNNDMDTIERLVDRLHATVKGDKILVRLRLERGRGQHHTXEEVVRQLRKNHPSLLCQLADLXEHIXXLYFAAXNXSRLFLVTHLNAQSDPTSCFDLLILNH

SEQ ID NO: 208916 - protein, 150 aa, Triticum aestivum
  unsure (1)..(150): unsure at all Xaa locations
  Clone ID: PAT_TA_103334.pep
NXXAKGXCPGGXCXXWRGXXSXRWRWGRXGACRGAXTALRPVGLLDLLXAQRRAFLAGRQXEHLVVVDVVPLLPHRRHGGTGRDSAKQERPSDAVACDYEALLGWLGQEVHTSRASRGWAAAVEAPSAVQGCRRDQGGAARRAKSQNRGG

SEQ ID NO: 208917 - protein, 87 aa, Triticum aestivum
  unsure (1)..(87): unsure at all Xaa locations
  Clone ID: PAT_TA_103335.pep
PGRGRRESVRSINESSNDGGRPQKEFVYQKDDSDRFRTPAKMNLQKDDNGVDVTSSXXPHLFTVTXXXXXXSXAXXXRLXXFFXLSL

SEQ ID NO: 208918 - protein, 205 aa, Triticum aestivum
  unsure (1)..(205): unsure at all Xaa locations
  Clone ID: PAT_TA_103336.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAXXLGXKQMICCCNKMDATTPSTRRPRYEEIVKXKSLSYLKKXGYQPLTXVPLXFPIFLGFEGPNN

SEQ ID NO: 208919 - protein, 175 aa, Triticum aestivum
  unsure (1)..(175): unsure at all Xaa locations
  Clone ID: PAT_TA_103337.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYXRIIGFDNMRQVQCVSXIAFKPPGCXESGKA

SEQ ID NO: 208920 - protein, 135 aa, Triticum aestivum
  Clone ID: PAT_TA_103338.pep
MEAMDVKYRPALYPNGSVKKLRQAAPVPPPPPAAVEAVPTYKECLKNHAAAIGAHAVDGCGEWMPVVELNTADPASYKCAACGCHRNFHRLVMVEGSRTPAPAGLLPAPPCPCPCPCRPPCSMAAATRARAGDAG

SEQ ID NO: 208921 - protein, 108 aa, Triticum aestivum
  unsure (1)..(108): unsure at all Xaa locations
  Clone ID: PAT_TA_103339.pep
GTSTPASSLGAAAGGACRNNXGPXXXXWEAAAWEASAVXHLQXXFLPEARLXRQGIRXAPXPSKMXTGSCGSRPSXXSPTWXARFPGDFEFSXPGXXXTXKXXXXXXQ

SEQ ID NO: 208922 - protein, 182 aa, Triticum aestivum
  unsure (1)..(182): unsure at all Xaa locations
  Clone ID: PAT_TA_103340.pep
ARARPECRRHHQRPTPSSSSRAPPPWLPSRVVRRPAPPPPTTQVTPPLPCLLSLXIFLSLLSRSSAPAPWMSSPRALLGDSNAATGPPPARSGAXPPGSALPPPPLPDPAPSNPPRPPPXVPIARPLPPRPVLEGDAPPAHPGQGPPPXRSLLHSPATSPSPLHCPPPQLMLLTNRDIFSWS

SEQ ID NO: 208923 - protein, 180 aa, Triticum aestivum
  unsure (1)..(180): unsure at all Xaa locations
  Clone ID: PAT_TA_103341.pep
LASMACINTLQSCSMFKGAKSKARRGRASGGTFECRASTFMDGSGLRLGLDENPDAIISGEWPENFSLLSYDDLRAYLQSQQQQQQQQPSHAGDQSLSSPLLMMLLLPADLQRGPLLREAMSTPVLMVTAEQALVEVEGHFSSCQASRLSTVPARCXGVRPSRAITLRGLHGPKXEKLQM

SEQ ID NO: 208924 - protein, 194 aa, Triticum aestivum
  unsure (1)..(194): unsure at all Xaa locations
  Clone ID: PAT_TA_103342.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKXGFIFREHNASPGYYDGRYWTMWKLPMFGCTDATQVINEVEEVKKEYPDAYVRIIGFDNMRQVQCVSFIAFKPPGCEESARPKQLTHDRPYIKCHCKFCQL

SEQ ID NO: 208925 - protein, 245 aa, Triticum aestivum
  unsure (1)..(245): unsure at all Xaa locations
  Clone ID: PAT_TA_103343.pep
MCGXAILSDIIPPPRRATGXNVWRADKKRRARPDAAAGRPRXVPEEEFQEEEGDAXXXADXXXXXXAEEXXXGXAKPLXVRRXGFFGDGLKATAAGDDDCASXYDXRMRKSQFRGXRXRLVXMGLCEIRDPRKGVHXWLVTYXSXEEAXXAYDVXXHRIPGKXXKVNFPXXSLPWXXINACXTXXXXPXXNTEXXSXLXXTMGXXXVNXCPXXXYXXNXXFXXXXNXXXVPXXXEXXGXFXEXXS

SEQ ID NO: 208926 - protein, 192 aa, Triticum aestivum
  unsure (1)..(192): unsure at all Xaa locations
  Clone ID: PAT_TA_103344.pep
GXKAQNSPFFASXXSXGLIXRXAFXSIFWXXPXHIXKGGLXPXFFLLNETKXPFVSFGMLHQPTLLASVCADAMVLQYMYVTATAGAVHAGAPMAAPRPCATCSTMGVSVSCKWSGGTADRDGSGWWIKRVRGVASLHVACELTSFPSRGRAAPWSATTRRCILFLVSKIILVAGKKKDHHRYISQLMAGEY

SEQ ID NO: 208927 - protein, 139 aa, Triticum aestivum
  unsure (1)..(139): unsure at all Xaa locations
  Clone ID: PAT_TA_103345.pep
HEVHWHVKANYKEYWRVKITVTNFNYGMNYSQWNLVAQHPNFNSLTSITSFNYTALNPYGLMNDTALLWGIRHYNDYXLTAGPDGYVQSELLFRKDPSTXTLRAGWAFPRRVYFNGDKCVTPPXDAYPWLXNXFTKINH

SEQ ID NO: 208928 - protein, 57 aa, Triticum aestivum
  unsure (1)..(57): unsure at all Xaa locations
  Clone ID: PAT_TA_103346.pep
XGXTSXRLVGGAXISIDSGRSGGPDEERSPRVADPGAPVAGDGIVGARGRRRLALVP

SEQ ID NO: 208929 - protein, 134 aa, Triticum aestivum
  unsure (1)..(134): unsure at all Xaa locations
  Clone ID: PAT_TA_103347.pep
VVXXKXCXXXVVXXQXXGXVXXFXXXFXXRPXXGRDXGMRXXLFLIGWXRSRXVSKGXRPWXGXLWXRWGGGAXXXTAAXAESGXGSAWSXRHLSWSRXGDKKPRAXFFGSTSVDLQAXELQXLFPXVXPKGXX

SEQ ID NO: 208930 - protein, 146 aa, Triticum aestivum
  unsure (1)..(146): unsure at all Xaa locations
  Clone ID: PAT_TA_103348.pep
ARAHTHTHTHTHTLVAPPFRVGSWNLLLLRSSRRRRAGGXRLSRAAPXXHXKXGPLXQXSLXVXXHXSRLXXHXAPKXXPXLVIXXTXTXFXFXTHYHHDXXSXXLXRXXXPLLCXCSXSFYSLKXXFXXXXXTXXSSFHXXLFXX

SEQ ID NO: 208931 - protein, 224 aa, Triticum aestivum
  unsure (1)..(224): unsure at all Xaa locations
  Clone ID: PAT_TA_103349.pep
MEQPTPRTTAVVPWLLLLCLVCRAPQARAQPDNNDFISIDCGLPGETGYRDNTTSLYYTTDAGFIDTNAGINHNISAQYINPSIPTSLHSVRSFPSGERNCYTLGSLVSGLKYLIRGQFLYGNYDGFNRLPIFDLYIGVNFWTTVNISSSDAAVYAEAIMVVPEDSVQVCLKNTDRGVPXISGLDVRPLTIKLYHWPTRHRPSXWLQGLTFGPTXDETIIRYPL

SEQ ID NO: 208932 - protein, 135 aa, Triticum aestivum
  unsure (1)..(135): unsure at all Xaa locations
  Clone ID: PAT_TA_103350.pep
GTRPALLVPSSPLPPSSPMSLPLFXLLASIASSPLXXXRPPPSCYLLLPPLRPVPAATQTLSPVSLDPHSNHIHSHPLLLTAAAPFLPSAPSSXLDPHHSADLQAKGDEEWQTRTTRERKKGDXYGGXTXXPCDL

SEQ ID NO: 208933 - protein, 215 aa, Triticum aestivum
  unsure (1)..(215): unsure at all Xaa locations
  Clone ID: PAT_TA_103351.pep
HEVEGIVSLGNTECLEFCISPPGTDPLGISIEIGQEFMAFSRAYPVAFLWLTTLMLEYHAFGHSDITDLISTCGRLRHLSLRFCRLLDLHSTLKIDVPCSELXELEFVGLLCTRIELVSVPKLXQVECKCWLFNNPPVRFGYVPELRGLILASKAKAWQEPFALNECLSTSAGARNLSTLTWFYQMNLDSTRTFEQRIIFKKPDWAAFSDLSGGN

SEQ ID NO: 208934 - protein, 120 aa, Triticum aestivum
  unsure (1)..(120): unsure at all Xaa locations
  Clone ID: PAT_TA_103352.pep
GTSXXQPXSSSPPSXPPAXPXXHNLRXPXPAXSGGCRRRAALSHXCXPRLRPPHQPDAXRSHETLAXARXLXAGPSRRLLPALSVLSRRSVAHRRSCSASLLPHRARTSLSPGGAXVRLR

SEQ ID NO: 208935 - protein, 180 aa, Triticum aestivum
  unsure (1)..(180): unsure at all Xaa locations
  Clone ID: PAT_TA_103353.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIXIGFXTCRQVQXVXIXXXNXRAXKESXXXLSIE

SEQ ID NO: 208936 - protein, 57 aa, Triticum aestivum
  unsure (1)..(57): unsure at all Xaa locations
  Clone ID: PAT_TA_103354.pep
PLPXXPXXRKXLXLAARPWPLXIGVLATXARKXXAMIVDXMSAAXESVVRWPSRPRA

SEQ ID NO: 208937 - protein, 175 aa, Triticum aestivum
  unsure (1)..(175): unsure at all Xaa locations
  Clone ID: PAT_TA_103355.pep
MVXVEMASXVXXDXXFQGLXTTXXLXDXRXXXXXXLSXVXXGXXIRCXXXXPXEGIXXXEXLXYLPPLXKEAXLKQXDYLXRXKWVPCXXFSKDXFVXREHNSXPGYYDGRYXTMXKLPMFXCTDATQVLNEVEEVXKEYPDAYXRVIGXDNMRQVQCXXFIXFXPPXXEEXGKX

SEQ ID NO: 208938 - protein, 123 aa, Triticum aestivum
  unsure (1)..(123): unsure at all Xaa locations
  Clone ID: PAT_TA_103356.pep
KXXXXKXXGERXXFXKXXXPXXPKXWXNXXPXXXFXSXXXEARIXXXQGEXSXTXEGXXLXRPXXXVRXTXXXXXXIRXERXLSXFFFFFFXFXFXXTRKGAFFTQQNKKAETEQTRIKLXNI

SEQ ID NO: 208939 - protein, 126 aa, Triticum aestivum
  unsure (1)..(126): unsure at all Xaa locations
  Clone ID: PAT_TA_103357.pep
PARNNPHKGTKLELARLQVDTXGSKDXXRAHTHTHTHTHSCRPTVQSWKXEPPXPPQQXAALGRRXPXXXXFXFGAXYXXXPFXXPSXXXXFXXLXXXCXXVXLXYYMXLXXCXXYYFXXXYXLIX

SEQ ID NO: 208940 - protein, 134 aa, Triticum aestivum
  unsure (1)..(134): unsure at all Xaa locations
  Clone ID: PAT_TA_103358.pep
ARVHLRSRSPPPPPAAARRASRXXXATSPPPSRPTAAAPTSPLPRPPCPPPRRRCRPSSRSTTASPPPTSCPTPPPPTCSPLPPPPRPAPGQAQAAARPHGTAPAARSRGGQGGGAENRGREDMAASTQLMFLL

SEQ ID NO: 208941 - protein, 156 aa, Triticum aestivum
  unsure (1)..(156): unsure at all Xaa locations
  Clone ID: PAT_TA_103359.pep
HESSGSCVSPREYYCYKLQIXDGEFNVLLFGKRLTQQYIVDMYIKIESISVVAGETRACMTGKRIVLPSKFIGGPRDMRRRYLDAMALVQRFGKPDLFITMTCNPQWEEITRELEPGQSPQDRPDLVAWVFKAKLEDLKDLLFKRNLFGXVLPSSL

SEQ ID NO: 208942 - protein, 109 aa, Triticum aestivum
  Clone ID: PAT_TA_103360.pep
YARSKLTLTKGNKSWSSRACRSTLVDPKNSARGEISSMIPSPFRHGDLQGLDLAAAARRRPVRPGGQGGPSIWSALTDPRYLGPEQTPYLTEPGDDTCSKILITYITFV

SEQ ID NO: 208943 - protein, 194 aa, Triticum aestivum
  unsure (1)..(194): unsure at all Xaa locations
  Clone ID: PAT_TA_103361.pep
MGGAASXLAAPIKHRRVERELDNKVAEALRERAKARTKTFRSVNSITMRXPRFKDGLKDXRDVFDHYDTDXNGTIDNEELRSCLSKLEVRMXEKEADDVHXYXDXDSRKGIQFQEFVVLICLMYLLXGPNVTPRGFRVLSRRNXNYXFXXLIDXFXXXNRDXDXMVTRKEXTXRMNXEXDRXRXPXXIXXXXFF

SEQ ID NO: 208944 - protein, 246 aa, Triticum aestivum
  unsure (1)..(246): unsure at all Xaa locations
  Clone ID: PAT_TA_103362.pep
ARGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLYPGGSXDPLGLAEDPEAFAELKVKEIKNXRLAMFXMFXXFXQAXVTGKGPLENXXEQLXRTXXKKTPGALXTXFXPXXVKTF

SEQ ID NO: 208945 - protein, 119 aa, Triticum aestivum
  unsure (1)..(119): unsure at all Xaa locations
  Clone ID: PAT_TA_103363.pep
ARAARVDAAVPPEEWASACAGADAVTMLVVAQLXDPMRRYEAVGAPSXVVIQAGRXXTGADGETRFKXXNMHVXGMRXKTDRRNVWDGERLHADRRWHWLCLCSARRGFGPYRITDVRV

SEQ ID NO: 208946 - protein, 269 aa, Triticum aestivum
  unsure (1)..(269): unsure at all Xaa locations
  Clone ID: PAT_TA_103364.pep
MGESRGSIFFFGTYRPPVPLDIFSCPADPPPSSAEDELLLTDDASYNQNGRPVPPAALKEILGFLGKKNPELASDCGATLEDVDTGHVTGMVFVSERDRGLETLHLALRRSTGGKVKVLSLLGDIYGLDDLSVRMEDSGCIAGGYMVDGVTVGHSLVYVSTKEEVKARRTPWTVVYRDRTFAERQEXSRLTSTRASTNLEPGPGSPVPGKGAGGPNSKKPKWGNGKNKKPKETGTIGKQWGGHLGPLGGPKPPKGNPPWAPGIFFSPGK

SEQ ID NO: 208947 - protein, 208 aa, Triticum aestivum
  unsure (1)..(208): unsure at all Xaa locations
  Clone ID: PAT_TA_103365.pep
GTSEGRREGGRRTIYDTCVKFXLXXLXXLLINXXXXXXRKIXLIXRTTXXXPXAXXFXXXCLXXXXDAXXXXDTTXIPVSLVLQGXHSDXPXSVPSTPXEEXHLVXQQQLXHDXTPDFNVXLGQDXTLXPDSLSLXALXXNDGFGASLFXPNHXSXMQHHAXPFVRDTLXTRAKFEFXAQEQAXSYYYGVPLQVTMSXNXLXPWXKTG

SEQ ID NO: 208948 - protein, 110 aa, Triticum aestivum
  unsure (1)..(110): unsure at all Xaa locations
  Clone ID: PAT_TA_103366.pep
MAVTRLAVAAALSSAPPSSRRGRAAPSSCRPLPAASCSRAPKSKALRATAAPADDAVDEEAPASSPPSDPGRGVENLEIIXXXPAGYTXXIYDAXXNLKXFVXEXYQXGG

SEQ ID NO: 208949 - protein, 123 aa, Triticum aestivum
  unsure (1)..(123): unsure at all Xaa locations
  Clone ID: PAT_TA_103367.pep
MAAQGLLSGRQLLGRPLQSSISRSSSSRKSAFVVRASSSPPAKQNDNRQLWFASKQSLTYLDGTLXGDFGFDPLGLSDPEGTGGFXEPRWLXYGEIFNGXTAMMGXXGMXAXEALXXXAXXPR

SEQ ID NO: 208950 - protein, 123 aa, Triticum aestivum
  unsure (1)..(123): unsure at all Xaa locations
  Clone ID: PAT_TA_103368.pep
MECNSVQMSHCAEGSETTIEIKIKTLDSQTYNLRVNKCVPXXLLXDKIATVTGVLSEQQRLICRGRVLKDDELLSXYHXEDGHTLHLVXRQPQPARNAGNELVYQIQMVARALCFACKFGPGE

SEQ ID NO: 208951 - protein, 78 aa, Triticum aestivum
  unsure (1)..(78): unsure at all Xaa locations
  Clone ID: PAT_TA_103369.pep
MAGVNTSVVGLKPAAAVPQSAXPATAKRVQVARQGPAAALXGWRASFRXRRFAVGREAXXRVPXKSKXNKEXNDKKRA

SEQ ID NO: 208952 - protein, 117 aa, Triticum aestivum
  Clone ID: PAT_TA_103370.pep
ATRKLLQHTASRYRMCLNTACLCPQFSKPFFCRPQFLKQCLVYFFFLLGGASTFLFYFKCLSECVHQSFSFSCRDPLTQRFILLSSRSTNHVPSILQLNVGCMWGNRTFGLLQMIVS

SEQ ID NO: 208953 - protein, 225 aa, Triticum aestivum
  unsure (1)..(225): unsure at all Xaa locations
  Clone ID: PAT_TA_103371.pep
PGGGAFFPKKGFPGGPANAGILGGLTQWPLPGPWGVGDPKNPGLNXLKSLELFXKGHENQNPLXXLQRPVCYXKSXKLXPCLFFGLCVQVYPSVXLXXELERSERTXYIAFNRMSQRTEFDFXXKEIQKSMCKRPVLFFLKDVWKDGNITRGSYIRSSERDDLKRKVFCFRSPPLXGIXEIQVXXSPLSKXWHXPRLCSAVKEINGTMFMFVRQCGRAFGSADLD

SEQ ID NO: 208954 - protein, 129 aa, Triticum aestivum
  unsure (1)..(129): unsure at all Xaa locations
  Clone ID: PAT_TA_103372.pep
XLXPXLSAAXXLTVGAHXKPGPLXNIAARPVAXAPPASQSLSKKPTARALQTSSSSAVQAVCSTSDRRHEHGVAGEESSSSQGRPSTQLLQPRHTLDVAEQPHGRAVRPAAPFPASPTASSICLNFARA

SEQ ID NO: 208955 - protein, 71 aa, Triticum aestivum
  unsure (1)..(71): unsure at all Xaa locations
  Clone ID: PAT_TA_103373.pep
MXAAXWXXXXXXFXALPRMPSGLTIMPAPSPAPLPEAQSLVLPGLGAAIAPAMELMAXPKKKISKYXRGLR

SEQ ID NO: 208956 - protein, 93 aa, Triticum aestivum
  unsure (1)..(93): unsure at all Xaa locations
  Clone ID: PAT_TA_103374.pep
XQYPXXAPLAAAVPAGVRRDGEGAAARASPRRRQRGAPDEGGRVAARREGERGSQRSGHHVHGTPLSFRRRAQAERAWLVRKEVWRSATRLVP

SEQ ID NO: 208957 - protein, 275 aa, Triticum aestivum
  unsure (1)..(275): unsure at all Xaa locations
  Clone ID: PAT_TA_103375.pep
REQKLELARLQVDTSGSKDSARGRLPPRLNTLAVFSSPTPNPFGPNKRVARSRLRPPPISISMDPALVDPAHLQALMLACAHSCAIRLSPPEAAARPEPVDIRKLRTAVAHSFLVVSVFCGTRFLEEDDGGDDRRFMGLELDLGLGRRGEQRLVGFGRAVSDVGLTASVHDVVVHPSVXRKGIGRKILEKITRVLHSRGIYDIXALCTXXEKAFFEXCGFXDDXMGATTMMYTXNLXEKAFYGWVGNLPMILHGFWVLSALKCNWKKLFQGNLPL

SEQ ID NO: 208958 - protein, 181 aa, Triticum aestivum
  unsure (1)..(181): unsure at all Xaa locations
  Clone ID: PAT_TA_103376.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSSYEYVSQGLKKYDFDNTMGGFYIAPAFMDKLVVHLFKNXMTLSNIQDPXFILGXWGGRVKXKIIXSAXLCFXQDGXFNXXH

SEQ ID NO: 208959 - protein, 164 aa, Triticum aestivum
  unsure (1)..(164): unsure at all Xaa locations
  Clone ID: PAT_TA_103377.pep
MAAATMALSSPAMAGTPVKASRAAPFGEGRITMRKTAGKPKVAASSSPWYGSDRVLYLGPLSGDPPSYLTGEFPGDYGWDTAGLSADPETXAKNRELEVIHCRWAMLGALGCVFPELLARNGVKXGEAXLVXGPASNLSTRGGPTYPNPPWWRQKQLIGLKGVM

SEQ ID NO: 208960 - protein, 123 aa, Triticum aestivum
  unsure (1)..(123): unsure at all Xaa locations
  Clone ID: PAT_TA_103378.pep
MAPTVMASSATSVAPFQGLKSTAGLPISRRSSSAGLSSVSNGGRIRCMQVCRICAFYSFXCGPIEGIKKVRDLSYLAPFFTEAXLEXVDYLXIRSSGCPGSXFKQXVGSAFREHKXXPPDTYD

SEQ ID NO: 208961 - protein, 58 aa, Triticum aestivum
  unsure (1)..(58): unsure at all Xaa locations
  Clone ID: PAT_TA_103379.pep
NPTASARSLSXVHLQRKGARSVSYYALFKGWLLLGKPPGCLCTPTSFITERSFRGLSW

SEQ ID NO: 208962 - protein, 187 aa, Triticum aestivum
  unsure (1)..(187): unsure at all Xaa locations
  Clone ID: PAT_TA_103380.pep
MSSSDQEDHDEDAPLVRDPAAPSSSSRRPSAXXSAVGEVPVSQSLIKAASNVCFSFFVLAVLAVTVVAVTYQPPDPWLQSXGXITTFLXRXLPNSXXXQPDDSLLPTXEDFPSPXAAPGPAXXPARXXEQAAPGRAXSTXAGGXXEXDAPXNXRTGVFARKGVNAKAFFXXHXXLXXXGPVXXPXXG

SEQ ID NO: 208963 - protein, 97 aa, Triticum aestivum
  Clone ID: PAT_TA_103381.pep
GTRLVSKAHVLYHKGLLIHTIMIISVSSQIRSLFHEVGWVLWPHDNFHLKYKIYKSVKLMSYNSCFVTVRTNFEIYIAIPTDQDMDYILKVHQCFVV

SEQ ID NO: 208964 - protein, 114 aa, Triticum aestivum
  unsure (1)..(114): unsure at all Xaa locations
  Clone ID: PAT_TA_103382.pep
XKXXSXXVXVXKXXPWSXXXXYGXSXSFXXPSXXSVAXLNSDAIHXXXXXASFXXRLCSXSSAXXVGLXRSXPPXXPSPRRXXSGSXXSXPGXXXRTFXKCSXXSAXXPXXLVP

SEQ ID NO: 208965 - protein, 175 aa, Triticum aestivum
  unsure (1)..(175): unsure at all Xaa locations
  Clone ID: PAT_TA_103383.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIXFKPPGCEESXKA

SEQ ID NO: 208966 - protein, 184 aa, Triticum aestivum
  unsure (1)..(184): unsure at all Xaa locations
  Clone ID: PAT_TA_103384.pep
MARSTRRSSMTMTMQQHYSSASYTESLALARARSTSSGATGRMNMNGMIMMPSASYTERERQGRSIYAEEMMTPAESFSELAMQVVPSGRYAASSQQLFQAAKMSLEEMAKIEEEQRYIEREMEKGVVYIMGENXVVARXHSXLXKKVIVNYXYXXLRKNXRQGXXMLXXPRKXLXKXGMSYXI

SEQ ID NO: 208967 - protein, 130 aa, Triticum aestivum
  unsure (1)..(130): unsure at all Xaa locations
  Clone ID: PAT_TA_103385.pep
HEPPPARGAALFVRIHTAACDRAASAALLRELLAHLGGAGDPEEEESAAVEAGLEDRIPQKDAWKPFWARGVDMVGYSINGLRTSTLPFEETGTARSTXMVRLAFGREETTRLLXACKENGVKLCSAWLR

SEQ ID NO: 208968 - protein, 142 aa, Triticum aestivum
  Clone ID: PAT_TA_103386.pep
FGWCWVRLGSLQYVVMFRLSVLLPAIAAWGAASPSIRSVSPFRLLDLLLCPDLVCIVSSGIGFVVCCLGLGSVWCFSSNGVIGLGSGFCEMPLSCFNCCGGRRALQRMRLADCCGLMLPFKFNLLLQLPTLTGGRLIGAPTA

SEQ ID NO: 208969 - protein, 233 aa, Triticum aestivum
  unsure (1)..(233): unsure at all Xaa locations
  Clone ID: PAT_TA_103387.pep
FASPYFVSIPLLRTNPCWYDDVTFVAADTSVVPPLIYAVMGTSREIAIGPVAVVSLLLSSMVQKVVDPAVDPVTYRTLVFTVTFLAGVFQVSFGLFRLGFLVDFLSHAAIVGFMGGAAIVIGLQQLKGXLGLFRFPTSTDVVAVAKGRLXXALHDPWHPGNFFIGXXXLIFILAHADLFGEGQKLFLACPSPWFRNSLQRRGLHPKPGKKTFPGTPPLPFKKFKPKIFLTKFP

SEQ ID NO: 208970 - protein, 216 aa, Triticum aestivum
  unsure (1)..(216): unsure at all Xaa locations
  Clone ID: PAT_TA_103388.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSXYEYVSQGLKKYDXDNTMGGFYXAPXAFMDKLDXHLXSKNXMTLXPNIXIPLILGXLGEGKGVXGKXFQCELVLXKXGXNPIXMSCXELXSGKXPXPSISGGLAQLIKERGKFFII

SEQ ID NO: 208971 - protein, 223 aa, Triticum aestivum
  Clone ID: PAT_TA_103389.pep
QSNDTSGKARLLGIWGMAGIGKSTLLRQVSKSRSEFISDGDDLIVLIVDTGSDYSVAKVQKCLIGLLGVTVAADVTEAGVALAISNRLRGMRFLVMFDDLSGPINLARIGIPDAPPASLKCQKVVFTTQKQAVCASMGADETIHMVCPSEIEAEKLFNHAVGADILKDKRISSLSQDAQDETQDAQQLLHVLQMVAIRGLSKLREVNLKTVGVSITSISISAV

SEQ ID NO: 208972 - protein, 106 aa, Triticum aestivum
  unsure (1)..(106): unsure at all Xaa locations
  Clone ID: PAT_TA_103390.pep
MAAQGLLSGRQLXGRPLQSSISRSSSSRKSPFVVRASSSPPAKQNDNRQLWFASKQSLTYLDGTLPGDFGFDPLGLSDPEGTGGFIEPRWLAYGEIFNGRTAMMGV

SEQ ID NO: 208973 - protein, 95 aa, Triticum aestivum
  unsure (1)..(95): unsure at all Xaa locations
  Clone ID: PAT_TA_103391.pep
MAAAFSSTVGAPASTPTNXXGKKXKKQVTSAVNYHGKSXKXNRFTXMAAENXDXKRNTDKWKGLAYXXFDDQQDITRGKGIXDXXXXAPTGXGTH

SEQ ID NO: 208974 - protein, 192 aa, Triticum aestivum
  unsure (1)..(192): unsure at all Xaa locations
  Clone ID: PAT_TA_103392.pep
MLRVAGRRLSSSLSWRPVATVGARGPLAGAGGPGRDDDDGSAYQRRFAIESPFFTAARGFSSAETLVPRNQDAGLAELPATVAALKNPNSKILYDQYNHERYPXGDPSKRAFAYFVLSGGRFXYASLLXLLVLKFVLSMSAXXDVLXLCXPXRLILSSIEPGSTLVGKRPLFPGLNLLGEFNFFWAPPSFLK

SEQ ID NO: 208975 - protein, 149 aa, Triticum aestivum
  unsure (1)..(149): unsure at all Xaa locations
  Clone ID: PAT_TA_103393.pep
MMACGSRSNEVVDEFEKLVIKMNPPRVTVDNTSDMTATLVKVDSANKYGTLLEVVQVLTDLKLTINRAYISSDGEWFMDVFHVVDEEGNKLYDGQVIDRIEQSLGAGSLSFRXTDRCVGVXXXPXAXXXVIEXIGXDRXGXLVGSPTKQ

SEQ ID NO: 208976 - protein, 169 aa, Triticum aestivum
  unsure (1)..(169): unsure at all Xaa locations
  Clone ID: PAT_TA_103394.pep
MAPTVMASSATXVAPFQGLKSTAGLPVSRRSNGASLGSVSNGGRIRCMQVWPIEGIKKFETLSYLPPLXTEALLKQVDYLIRSKWVPCLEFSKXGFIFREHNAXPGYYDGRYWTMWKLPMFGCTDATQVINEVEEVKKEYPDXYVRXXGFDNMRRCRXXTFIGFXPPXL

SEQ ID NO: 208977 - protein, 118 aa, Triticum aestivum
  Clone ID: PAT_TA_103395.pep
GTSIEKIVKDKSTDDDFIRMTFLVLLGTIIAPVSHEYVPKKYYALVQNIKLIRKFNWNAFTSRFCLSEIGKLVQDGHVRQWPQGNLALLQYLYWEKVQPITGPKYDPLALLPADELYK

SEQ ID NO: 208978 - protein, 99 aa, Triticum aestivum
  unsure (1)..(99): unsure at all Xaa locations
  Clone ID: PAT_TA_103396.pep
KKKKKKKNSRVLLERPRAHRFSTRVGYQVSVPNSPYSESYYNSLAVVLQRRDWENPGVTQLNRLAAHPPFASWRNSEEARTDRPXQQLRSLNGEWRSNF

SEQ ID NO: 208979 - protein, 218 aa, Triticum aestivum
  unsure (1)..(218): unsure at all Xaa locations
  Clone ID: PAT_TA_103397.pep
YWEYYPVNVGETTVRVLQQILEILRYTPSLEVKTXSNRSMKFRQQGNRPATYNLSSNAREQTAQASRKIGREVNRCNYQYAYLHHLPDLEPATTSSYITQASRMERGNWADYEGRTRTTRQHLPRIHEQQQTDDPRIHDDETHLDLELQDHNTSKNTRGDARDKGNQPRQPADEEKREEKSKSNGGIARNHHESPLRCRSSSLPRPYPNRMTQMKLVP

SEQ ID NO: 208980 - protein, 176 aa, Triticum aestivum; identical to SEQ ID NO: 181546
  unsure (1)..(176): unsure at all Xaa locations
  Clone ID: PAT_TA_103398.pep

SEQ ID NO: 208981 - protein, 210 aa, Triticum aestivum
  unsure (1)..(210): unsure at all Xaa locations
  Clone ID: PAT_TA_103399.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVXRIIGFDNMRXVQCVSFIAFKPPGCEGVRQRAKTATHDRPYIKCHLQVLQLLTLLLGFSFLHLIS

SEQ ID NO: 208982 - protein, 79 aa, Triticum aestivum
  unsure (1)..(79): unsure at all Xaa locations
  Clone ID: PAT_TA_103400.pep
TRTFRHGTGHGIGSYLNVHEGPHLISFRPSARNVPLQASMTGTDEPXYYEXGXLGIRWENGLIVXXADTKLIXGKRVFG

SEQ ID NO: 208983 - protein, 157 aa, Triticum aestivum
  unsure (1)..(157): unsure at all Xaa locations
  Clone ID: PAT_TA_103401.pep
HEVAFASLPAPPPTASSFALIPRVGFFFVWIDSPRRLLLGLPCFSXWNPRRRPALGFGSNPSRRSPWIQMYQMVFKMRKTNIYNRWMQMVFMMTKAHKNEAKLNNQKGTNHFNIFQEVFAMTQVPECSLGSCASLHTLPDCLXSGGTKLLRSLVTFS

SEQ ID NO: 208984 - protein, 90 aa, Triticum aestivum
  Clone ID: PAT_TA_103402.pep
LPEHTGITQTLFLELIGEGTHVKSLCCLLVQDMVQLIFLCSVHGLTGSFILSFILQLCAKISHCFNASGSSFFIQILLHYVRLSEFNLTN

SEQ ID NO: 208985 - protein, 153 aa, Triticum aestivum
  unsure (1)..(153): unsure at all Xaa locations
  Clone ID: PAT_TA_103403.pep
ARVLHSPRPDPTSRPWIPRRCRASSPSPSPSSSSCSPPPPRSPGRGTSSATATRPPSASAPEPAPRTPSTRRSPSSPAPSPSPPRAPSPPSSPTPPDPARSSSASPRCPRTPSASRXTRTTRXTPRPAATTSPTRALHLSKPKTRLPALSSDE

SEQ ID NO: 208986 - protein, 185 aa, Triticum aestivum
  unsure (1)..(185): unsure at all Xaa locations
  Clone ID: PAT_TA_103404.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQXCVSFIAFKPPGCXGVQGLNSLLTTGHI

SEQ ID NO: 208987 - protein, 113 aa, Triticum aestivum
  unsure (1)..(113): unsure at all Xaa locations
  Clone ID: PAT_TA_103405.pep
MAPTVMASSATSVAPFQGLKXXVGLPVSRRSNGASLGSVSNGGRIRCMQVWPXEGIMKFETLSYXPPXRXETLLKQXXYLIXRSKXVPXLXFXSXXXFILRXLXEXXXYXESS

SEQ ID NO: 208988 - protein, 205 aa, Triticum aestivum
  Clone ID: PAT_TA_103406.pep
ARAAAAASAPCIDELPITAKAFLDVSIGGEPAGRITVGLFGDAAPAGAARFLSLATGVGYRRKEFVKVVPGYVQHAGVVSYPVIPAVTDRLAAEMDAMRARCGAGGAMNAAGAVSIVVRDPSLPPPKPKLVARGGRLKIEEEQVGVVPNGTEFVIATRDSPELDASALVVGRVVAGMDVVGRIAARGHPSRDNTRVRPYFKGGRK

SEQ ID NO: 208989 - protein, 178 aa, Triticum aestivum
  unsure (1)..(178): unsure at all Xaa locations
  Clone ID: PAT_TA_103407.pep
MQIFVKTLTGKTITLEVESSDTIDNVKAKIQDKEGIPPDQQRLIFXGKQLEDGRTLADYNIQKESTLHLVLRLRGGMQIFVKTLTGKTITLEVESSDTIDNVKAKIQDKEGIPPDQQRLXFAGKHLEDGRTLAXDYNXQKEXSXLHFXLPSFGGGHAFFRNPSPGTIQLWRGRRWTPF

SEQ ID NO: 208990 - protein, 167 aa, Triticum aestivum
  unsure (1)..(167): unsure at all Xaa locations
  Clone ID: PAT_TA_103408.pep
MAAXAXHXXXSFLXTVPRXDDLVXXXXDFGXRXTMRRTVKSXPQXIWXGPDRPKXLGPFSEQTXLXXTGEIPGDYXXDTAGLXVDPKTFAKNXELEVIHSRWAMXGALXCVFXDSVQEXGXSFGEAVWFKDXXPNFFRXXAXKYLXNXNLXVTXRSIXXIWDHGHGL

SEQ ID NO: 208991 - protein, 241 aa, Triticum aestivum
  unsure (1)..(241): unsure at all Xaa locations
  Clone ID: PAT_TA_103409.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEIVDPLLXPGGSFDPLXLRPRNPRRPFAGSFGERRIKKRALMVSSMVGFCKGQTRARPL

SEQ ID NO: 208992 - protein, 232 aa, Triticum aestivum
  unsure (1)..(232): unsure at all Xaa locations
  Clone ID: PAT_TA_103410.pep
MAIRFQFALGGGSXVMYLXPEHGGSAXLXRDXKPSNIMLDGSFXARLGYFGLARFICDGRGSLTTGCSRGRSGYMXPEVRVCGKASVESDIYSFGVVLLEMACGRVPAVAVDDDDGVVIHLLQWVWESHGRGAILEAADARLDGKFDEKEMECVMVVGLWCGHPDPALRPSIRQAVSVLRLEVPPPSLPGKMPVATYMMRPEADESFGSSVVSHGGGSVDSGMTHSTRGKVE

SEQ ID NO: 208993 - protein, 175 aa, Triticum aestivum
  Clone ID: PAT_TA_103411.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQVRQLHRFKPPGCEESGKA

SEQ ID NO: 208994 - protein, 175 aa, Triticum aestivum; identical to SEQ ID NO: 115797
  Clone ID: PAT_TA_103412.pep

SEQ ID NO: 208995 - protein, 214 aa, Triticum aestivum
  unsure (1)..(214): unsure at all Xaa locations
  Clone ID: PAT_TA_103413.pep
MAPTVMAXXXTSVXPFQGLKXTAXLPVSRRSNGASXXSXSNXGRIRCMQVWXXEGIKKFETLSYLXPXNTEALLKQXDYLIXXKWVPCLEXSKVGFIFREHNASPGYYYGRYWTMWKLPMFXCTDATQVINEVEXXKKEXPDAYVRIIGFDNMRQVXXVSLIXFKPXGCEERGLKQNSPGQHIKVFAGFFDFWGCFLSHLFLVPKKNIGKGPFG

SEQ ID NO: 208996 - protein, 253 aa, Triticum aestivum
  unsure (1)..(253): unsure at all Xaa locations
  Clone ID: PAT_TA_103414.pep
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQXVSFIAFKPPGCEEVRQGPKQAHSRTGHILKVPLQLSTLTIAFGVFLSPFIFLNLGLMGPLFHPNIGEASYFMLGGFVYSPDIIIQYTLGKKKKKN

SEQ ID NO: 208997 - protein, 205 aa, Triticum aestivum
  unsure (1)..(205): unsure at all Xaa locations
  Clone ID: PAT_TA_103415.pep
MXAAFXSTXGAPXXTXTNFXXXKXXXQVTSAXNYHGXSXXAXRXTXXXXXNXXEKXNTXXWXGXAYXXXXDXXDXTXXKGIXDSXXXAPTGXGPTRPFLSSYEYISXQGLXKXDFYNXMXXXYXXXAFXDKLDGHLSKNFMTLPXIKIPLILGIWGGKGQRKSXXXEXVXPKMXXNPIMXSARTAXKVATPXEPXQLQNRPLRLS

SEQ ID NO: 208998 - protein, 205 aa, Triticum aestivum
  unsure (1)..(205): unsure at all Xaa locations
  Clone ID: PAT_TA_103416.pep
ARATASPEKTQRAMAAATMXLSSPAMAGTPXKAXRAXPFGEGRITMRKTAGKPKVXXYSSPWYGSDRVLYLGPLSGDPPSYLTGEFPGDYGWDTAGLSVDPXTFXKNRELEVIHCRWAMLXALXCVFPELLARNXDKFGEAVWFKXGSQIFXEGGLDYLGNPSLVHAQSXLAXWACQVXLMGAVEGATSVAXXPXGEKRTRFYPR

SEQ ID NO: 208999 - protein, 95 aa, Triticum aestivum
  Clone ID: PAT_TA_103417.pep
MRKKLDTRFPAPRIKKIMQADEDVGKIALAVPVLVSKALELFLQDLCDRTYNITVEKGVKTVSSSHLKQCIHSYDVYDFLKNVSSKVPDLGAPDF

SEQ ID NO: 209000 - protein, 271 aa, Triticum aestivum
  unsure (1)..(271): unsure at all Xaa locations
  Clone ID: PAT_TA_103418.pep
HEIDLVIEGTGVFVDRAGAGKHLEAGAKKVLITAPGKGDIPTYVCGVNADLYTHADTIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTLXEEVNQAFRDAAANELKGILDVCDEPLVSVDFRCXDVXFXIDAXLXMGHGRTWVVRVGTNNQVGVTSQKGVRTFANLQPNKLKRPDGGGNLALCEKTSKKFFPQPP

SEQ ID NO: 209001 - protein, 250 aa, Triticum aestivum
  unsure (1)..(250): unsure at all Xaa locations
  Clone ID: PAT_TA_103419.pep
HEAPRLLLPPRPPLPAPARASARHNGGGGRTAPELSGPTPRVVVVTSGKGGVGKTTTTANLAASLARLGLPVVAVDADAGLRNLDLLLGLENRVNLTAADVLAGDCRLDQALVRHRSLRGLHLLCLSKPRSKLPLAFGSKTLTWVADALRRGADPPAFXLIDCPAGVDAGFVTAIAPAEEXVLVTTPDITXLRDADRVAGLVGCDGIKDIKIXVNKCGRLVKGEDIXTLTAXXSVXCGKKDRKGARELLK

SEQ ID NO: 209002 - protein, 181 aa, Triticum aestivum
  unsure (1)..(181): unsure at all Xaa locations
  Clone ID: PAT_TA_103420.pep
KIILLPRGXKXGSXRPPNFXPHXXKKKSPXKXSXXWGRVLXGPLXYXGXLFSXKXLGXXIKKXNXLPFHCSKVGSXFTPXGXVXPFSLXPEGRVXXXVNXEYHXLXGXNGXRRXRINFSLNXESGXSIIWVGHXTPXNSEXVRDSAFCXLVDFLFLFTIFSVSTGSSIXRASLLPPXTXXS

SEQ ID NO: 209003 - protein, 175 aa, Triticum aestivum; identical to SEQ ID NO: 115797
  Clone ID: PAT_TA_103421.pep

SEQ ID NO: 209004 - protein, 74 aa, Triticum aestivum
  Clone ID: PAT_TA_103422.pep
ARGKALRDCSHDDDDDEARSYLMDMGTKALRRYFFLITFRSYVHCTSLHEVTFASWMEARPELGHLCDNLKLDR

SEQ ID NO: 209005 - protein, 159 aa, Triticum aestivum
  unsure (1)..(159): unsure at all Xaa locations
  Clone ID: PAT_TA_103423.pep
MATTAMALSPSSFAGKAVKDLPSSALFGEARVTMRKTAAKAKPVSSGSPWYGSDRVLYLGPLSGDPPSYLTGEFPGDYGWDTAGLSADPETFAKNRELEVIHCRWAMLGALXCVFPELLARNGVKFGEAXVVSRPXPRXFXEGGXXXXXNPXLPCARFF

SEQ ID NO: 209006 - protein, 114 aa, Triticum aestivum
  Clone ID: PAT_TA_103424.pep
MTIPPKPLLFALLGCLCFCSSVLAARELGDDLSITARHESWMLQYGRVYKDATEKAQRLKVFKANVGFIESFNAKNHKFYLGVNQFADLTNEEFKTTKANKGYKSRFERAPTGF

SEQ ID NO: 209007 - protein, 54 aa, Triticum aestivum
  Clone ID: PAT_TA_103425.pep
ARVAAKVKWMMDSDGGRVIRERTQAAMRQANEAMREGGESEATLASLVDAWVLA

SEQ ID NO: 209008 - protein, 79 aa, Triticum aestivum
  Clone ID: PAT_TA_103426.pep
TKLTSAKLQDRHDFRCESKLIFQTNTAIFHVTSSGKMIKCNKCCNFSIRRSVRNVSKLRSVTAESIHMLQIICLVFLQT

SEQ ID NO: 209009 - protein, 101 aa, Triticum aestivum
  Clone ID: PAT_TA_103427.pep
RPERAICSASTTLRFSFTVFFAVVVLASCTNNLPYGHRLLPYVPHPATAPHNANANFANAELLAMSRSRAHEIARITRLCSAATSLTRSRSRSRRDGCLCS

SEQ ID NO: 209010 - protein, 95 aa, Triticum aestivum
  Clone ID: PAT_TA_103428.pep
PSRHTISVNQCPKSIFEWSHNPAVLSGAGPNSYRLPPTHAGGKIYPCAERRISARHVHIAFRCQPSNHNAQNWASQLFRNPPTNVNALNRLKVGV

SEQ ID NO: 209011 - protein, 55 aa, Triticum aestivum
  Clone ID: PAT_TA_103429.pep
IAYTISYSLNFRETSIMLSCRSTINRTSAGLQKLKSYYDYAKTQQKKKICIEVLV

SEQ ID NO: 209012 - protein, 82 aa, Triticum aestivum
  Clone ID: PAT_TA_103430.pep
STRCLLHCCVLRGPILYARNNTAEQHVALLTKGTELCTVLHHNCVVVRDSDSVALTTQQRKFLLLLFLKKKKKKKKKKKKKK

SEQ ID NO: 209013 - protein, 107 aa, Triticum aestivum
  Clone ID: PAT_TA_103431.pep
NLAVFGPTVNTSICLKKKKKNSRGGPVPNSPYSESYYNSLAVVLQRRDWENPGVTQLNRLAAHPPFASWRNSEEARTDRPSQQLRSLNGEWQIVSVNILLKFALNFC

SEQ ID NO: 209014 - protein, 113 aa, Triticum aestivum
  Clone ID: PAT_TA_103432.pep
NNVHIAKILVTISKNIPVFTILVTIQTDVQNSKLCSHFQKVVLNLQSVWNLEICSSLQKMFLEFYSCSEKCSKFIFLFTISKIVRVVKKYSQFPKKIMYTTSWSFNFLFAFSK

SEQ ID NO: 209015 - protein, 105 aa, Triticum aestivum
  unsure (1)..(105): unsure at all Xaa locations
  Clone ID: PAT_TA_103433.pep
GFRDGAASLWGGGGTRRGAGGSARRRGSWGLVRWRHAPVGGGEAAHRRGVEGGGVGRRSAVGQASSNSARARRIWXRRSCSREGEGETSGRERERGVGRRERGAA

SEQ ID NO: 209016 - protein, 110 aa, Triticum aestivum; identical to SEQ ID NO: 128883
  unsure (1)..(110): unsure at all Xaa locations
  Clone ID: PAT_TA_103434.pep

SEQ ID NO: 209017 - protein, 118 aa, Triticum aestivum
  Clone ID: PAT_TA_103435.pep
MPQVQSHAQPQVEERPLPKKTQVNASLVEKPSEKKMKSRRCYLCREKGHVASSCTSGKLSNPIIIDDIYSLGKDKVGHVFAKFVGTQSGVKKRTIWVAKPIVTNLLGPNLVGDQQAQT

SEQ ID NO: 209018 - protein, 121 aa, Triticum aestivum
  Clone ID: PAT_TA_103436.pep
WGGPGRGEGRSCAPHAPRTEPAHGGGSAGWQPAMRRPRYVTSYGSPFVMFWHRSFIAHPQAMAVVSLMAARTACGSSRSMNTTAPRACRLPRYGSGRLTMEVWDPSSQHPLLEESAVRHAD

SEQ ID NO: 209019 - protein, 101 aa, Triticum aestivum
  unsure (1)..(101): unsure at all Xaa locations
  Clone ID: PAT_TA_103437.pep
MAPVKLYGATLSWNVTRCVAALEEAGVEYELVPINFGTGEHKSPDHLARNPFGQVPALQDGDLYVFESRAICKVCLPARTSQSLLXEGXIKESAMVDVLAQ

SEQ ID NO: 209020 - protein, 70 aa, Triticum aestivum
  unsure (1)..(70): unsure at all Xaa locations
  Clone ID: PAT_TA_103438.pep
MGKIKMPALFRRRSSSKSRSASPPPTPQEEEGTRPASGAGSPARSAEEEMERVFRKFDANGXGPDLAGNL

SEQ ID NO: 209021 - protein, 85 aa, Triticum aestivum
  Clone ID: PAT_TA_103439.pep
TLVPLPLSSTVPPRKGSGGSPPPGRSSPFPSVESIPTLSSCHGCRYCPRSFSLLVLLLDLVLRGNGGCIFRFLAKSRLELVGEGN

SEQ ID NO: 209022 - protein, 63 aa, Triticum aestivum
  Clone ID: PAT_TA_103440.pep
AKWAFLFICYLLFWRTGSHKSEMIRIYQAGAMPCQQRVATMHQREQYYSTWTCFKNYLFFCST

SEQ ID NO: 209023 - protein, 58 aa, Triticum aestivum
  Clone ID: PAT_TA_103441.pep
MERGSAKLYQKAEYLAVNVLLCLITDLFWVEWIVMSPLTPAYFSVCWTRFLPTFVADF

SEQ ID NO: 209024 - protein, 93 aa, Triticum aestivum
  unsure (1)..(93): unsure at all Xaa locations
  Clone ID: PAT_TA_103442.pep
MPKPSGYALVLNPTIVARRTCKFSQVLIHGGSNINILYRDTMTNLGLKPENLEPTRTIFHGIVPGLSCSRIGRVRLDVLFGESNHFXWEPIWV

SEQ ID NO: 209025 - protein, 109 aa, Triticum aestivum
  unsure (1)..(109): unsure at all Xaa locations
  Clone ID: PAT_TA_103443.pep
IRHEGGRCRRLGAGEAAAAAAEEAVLEAASVVLARPVAARRCSAVRRTAYELVPGNVDRRHISWHPAAVMLLPAIAPRVHGNDPCDQTSPTMHVYTRLLXSFWTEQLSS

SEQ ID NO: 209026 - protein, 74 aa, Triticum aestivum
  Clone ID: PAT_TA_103444.pep
KLLAQNQSAALNYWPFYLRFLMLLVMYQFCGQSTGKTLNLESYMSSFDALEIYEHCRPKIRGLHLIIGHFESWL

SEQ ID NO: 209027 - protein, 77 aa, Triticum aestivum
  Clone ID: PAT_TA_103445.pep
ARGSFGNVYKGQHTDGEWIAVKLLHNYIPGLEDEQFEKEYHNLANLQHNNIVRLVGYSHETRREFLPYNGDLVLADI

SEQ ID NO: 209028 - protein, 76 aa, Triticum aestivum
  Clone ID: PAT_TA_103446.pep
AAGGVGASAGGRVLLVLRVGGRRRRDVGLLLLARRRVSCCSARRWVACVTGIKQNNKLRIQEPNMVAPHWRFLRSC

SEQ ID NO: 209029 - protein, 77 aa, Triticum aestivum
  Clone ID: PAT_TA_103447.pep
ARARSKSSVVATRRAIEFMLGWFLDPLARGDYPESMKELVGNRLPQFTKKQSELVKDSFDFIGINYYTTNYAGSLPL

SEQ ID NO: 209030 - protein, 162 aa, Triticum aestivum
  Clone ID: PAT_TA_103448.pep
AREKNDFQADFHKVVNHMLTEDEFETTWGMLLDKYNLRKHAYMTQIYEIRTKWAKPYFRGVFCAKMTNKQRSESANHMLKTYMPPASPMHVFVRQYMRLQFDREREESYEEKRTMIGGAVRRTNLAIERHASKIYTRSMFDEFGTFLMEATTYNITEIEKMK

SEQ ID NO: 209031 - protein, 78 aa, Triticum aestivum
  Clone ID: PAT_TA_103449.pep
FERLIYYLSGEVLMTGRLAIGIDAHLHQQADINGGSIRCGFLKLYHVLVGHSLCNFNLGYQHIVPASLWIIICNLYLG

SEQ ID NO: 209032 - protein, 119 aa, Triticum aestivum
  unsure (1)..(119): unsure at all Xaa locations
  Clone ID: PAT_TA_103450.pep
MALRALDNTLPAAVADQRPKKAAKLFAVTRSPTGSGGNGKKRNDENSAPTPKPASPVAAAAEPAVEYVRSEDLLPVPAPKARAAGLLAGLDSKDWVKVCEALNDARXLAIHHPALLAPI

SEQ ID NO: 209033 - protein, 116 aa, Triticum aestivum
  Clone ID: PAT_TA_103451.pep
PWKTMAGIANIWRYFCKARISVRFALQLRGGRHILFWRDCSINGYSVAEFSPLVMEFIRLPWSVAGVHSASSVYRLLTIFTGADCTWRCWAPLTCKIIAWLACTISALDLIGTTCD

SEQ ID NO: 209034 - protein, 99 aa, Triticum aestivum
  unsure (1)..(99): unsure at all Xaa locations
  Clone ID: PAT_TA_103452.pep
ARGGXSGXMTATLGLNTIIAMLVASFYRYAALPITCLSSHPKLPCQPLTFDTFPTQTIVWLCYRFCSAPLIALLVAGEVEDFSMMDRILVGISQYLLYY

SEQ ID NO: 209035 - protein, 71 aa, Triticum aestivum
  Clone ID: PAT_TA_103453.pep
MLKLRGFCLSLDDFGSGYSNISYLRQMPLDIIKLDRQLISGLLNDSGSRIIARSIISMLKALDYQVLAEAR

SEQ ID NO: 209036 - protein, 97 aa, Triticum aestivum
  unsure (1)..(97): unsure at all Xaa locations
  Clone ID: PAT_TA_103454.pep
MWRLLIRDTWTYSWNSKDFTAINMYKXFIAGQCCFPAFLKIWRCVAMPRYRIFFWLLLHDRINTRCLLHRKVFYMSSQNCAICTLNADETIFGLSVC

SEQ ID NO: 209037 - protein, 90 aa, Triticum aestivum
  unsure (1)..(90): unsure at all Xaa locations
  Clone ID: PAT_TA_103455.pep
HIAVKFAELVTKIDRRSGKXXEALXXFLKNGDAGIXXMIPTXPMVVETXXTYPPLXXFXXRDMRQTXAVGVIKGVEKKDPTGAKVTKAAI

SEQ ID NO: 209038 - protein, 33 aa, Triticum aestivum
  Clone ID: PAT_TA_103456.pep
KQNRLQTDLYQIPIDCMQITDKNTITRFTDPRA

SEQ ID NO: 209039 - protein, 83 aa, Triticum aestivum
  unsure (1)..(83): unsure at all Xaa locations
  Clone ID: PAT_TA_103457.pep
RFPPRRAAPGLGLLRMGRAAHGRRSPMPPXFXIXPEPXCSGQXGGASXASXAXGGRVEASRPRLRLRRRRRRRARGGRRGGSC

SEQ ID NO: 209040 - protein, 43 aa, Triticum aestivum
  unsure (1)..(43): unsure at all Xaa locations
  Clone ID: PAT_TA_103458.pep
WLSHLEXLNRXDXXXYFIEQYMLVSRYTANXXAXFYGXRXVKP

SEQ ID NO: 209041 - protein, 92 aa, Triticum aestivum
  Clone ID: PAT_TA_103459.pep
FSLNSRSRSSWVPFACGSFSPCFHIIGSVWCWRGSLHEVWALDERPHFHRLRCRVWKGRQLGYSHCSSFSVCLICLHTSTWIHFYLTLFLMI

SEQ ID NO: 209042 - protein, 157 aa, Triticum aestivum
  Clone ID: PAT_TA_103460.pep
MDRLLLSRPPMPTPVHGAATAADGDLLELDVLWPASSAPGLLAALPDDEAKKKQKRAGGPAVRSAARAVPEKAALTPSSAARSAPVRIPSDAAARRGRWSHVVVGGDDGDAMVPPHEIVARRAAAHSSVLEGAGRTLKGRDLRRVRNTVLRRTGFLD

SEQ ID NO: 209043 - protein, 73 aa, Triticum aestivum
  Clone ID: PAT_TA_103461.pep
GTSSAIAAKKPQQRCGRRSGGRKKVRVMPVREEVEYGEDVLLNEKLNERTLGEFAVSPKSQEKMAAVAARSRL

SEQ ID NO: 209044 - protein, 84 aa, Triticum aestivum
  Clone ID: PAT_TA_103462.pep
QGQKMAREGEGEIWEGSQGRGSAGREQQQQQKLWQLSPSSHNQVVNFVACLIPCSAPSLSPPPSPLTKSTLFLSNTWSFTTSRA

SEQ ID NO: 209045 - protein, 116 aa, Triticum aestivum
  Clone ID: PAT_TA_103463.pep
GTRKVAPSEGQENAIKNLKARHELQDEKDCCGNFAIDGSDACHKNCLDSNHTSSPNCSMDDDGGALWDIFRREDVPKLETYLRKHSKEFRHIYCSPVEKTFNPLHDETFYLTEEHK

SEQ ID NO: 209046 - protein, 60 aa, Triticum aestivum
  unsure (1)..(60): unsure at all Xaa locations
  Clone ID: PAT_TA_103464.pep
GTSLQLSLSPPFPILDWQIVGVEERAVTTARRFTNPKAAHXEKMTWYXQRCEDVGGVWTC

SEQ ID NO: 209047 - protein, 86 aa, Triticum aestivum
  Clone ID: PAT_TA_103465.pep
VFVATGCWGSARSDIIQHRVLPKKKKKNSRGGPVPNSPYSESYYNSLAVVLQRRDWENPGVTQLNRLAAHPPFASWRNSEEARTDR

SEQ ID NO: 209048 - protein, 201 aa, Triticum aestivum
  Clone ID: PAT_TA_103466.pep
ARAWFPGSADGLSDYRDNIPASGSQIQNGGPAVTSDVVAKQNEWWAEIMNDDWRDILDATAADPQSKPAVNQPASSHGGEICNVASPPNSNSAAKQRMRWTPELHECFVDSVNKLGGSEKATPKGVLKLMKVDGLTIYHVKSHLQKYRTARYKPDLTEGTAEKRTTTEELTLDLKSSMDLTEALRLQMEVQKRLHEQLETQ

SEQ ID NO: 209049 - protein, 68 aa, Triticum aestivum
  unsure (1)..(68): unsure at all Xaa locations
  Clone ID: PAT_TA_103467.pep
QTPEDFATWQRIIRXDAIRANTDWALFSCNQAEISEEKALQCALSVGLKDYDHLQPYMVYHAARLVAL

SEQ ID NO: 209050 - protein, 151 aa, Triticum aestivum
  Clone ID: PAT_TA_103468.pep
MEAPDEEAGLGLPEGERLLEVTIISAQGLKPPSGLRRRLQAYAVAWVDTAHRLQTQPDRSGGPDPAWHERFLFRVHEAALAEDSRAAVTVEIYASPNGAWHIGGDSLIGSARFLLGDNCLLSRPVGSPAMFAVGVRRPSGRVHGLLNVAAS

SEQ ID NO: 209051 - protein, 100 aa, Triticum aestivum
  Clone ID: PAT_TA_103469.pep
PVQVHGLTTSTATTPPSSSSPGTLGMIVIYAMGAEWKGLPFQFSRVWTLYRSELGPHRQQRIQILWWPVRRISGEIVCEYNKRLRFDLHCMRKAGSGAPS

SEQ ID NO: 209052 - protein, 98 aa, Triticum aestivum
  unsure (1)..(98): unsure at all Xaa locations
  Clone ID: PAT_TA_103470.pep
REPSKAERRAIQEAXLAAKAAAKEAGLSGKSTGAASGANPATSKXAKPAKISQKKDVPHAPSTVASEKKVTERQPERDRKKDVPHPRMQFDDVHRVEK

SEQ ID NO: 209053 - protein, 102 aa, Triticum aestivum
  Clone ID: PAT_TA_103471.pep
HEPRSRSFSSSPPPSRPEPEPPPSRICRPSTRRPKSLAVRTHRGRSRGSRIGYVEEGGWCGGGDDGVGVGVACSGGARRKNQTAIFYCLTRPAVLSCYLFPT

SEQ ID NO: 209054 - protein, 54 aa, Triticum aestivum
  unsure (1)..(54): unsure at all Xaa locations
  Clone ID: PAT_TA_103472.pep
TSSERAVPLPAVEGSLXHDRPTVRGGRLYFVSAHEKPDGWFRSWAAVYTTDLGS

SEQ ID NO: 209055 - protein, 133 aa, Triticum aestivum
  Clone ID: PAT_TA_103473.pep
RSETVIFAKWEQHTRGVASKMMAKMGYREGMGLGVSGQGMLDPIPVKVLPAKQSLDHAVAATTGEDGRSIHRNKDKKRSRGGQRKRDRKFAELARAAKAEEAERSVFSFMNSQLVSQDATEGSSAAKARKESP

SEQ ID NO: 209056 - protein, 79 aa, Triticum aestivum
  Clone ID: PAT_TA_103474.pep
TSPLVHRLRLLRSAVVCSSSALLPCSRPRLAIPFAQPPLRGPAFAAASSPLLRSVGARFSLFSSMAAAASSASSIHDFT

SEQ ID NO: 209057 - protein, 41 aa, Triticum aestivum
  unsure (1)..(41): unsure at all Xaa locations
  Clone ID: PAT_TA_103475.pep
MLKKSGXLXSTTRLRXFWXLAPXXAXFFGSMSSSNGGGEGT

SEQ ID NO: 209058 - protein, 25 aa, Triticum aestivum
  Clone ID: PAT_TA_103476.pep
DQILPRMSVCIDSSKFLSKTVTTRA

SEQ ID NO: 209059 - protein, 105 aa, Triticum aestivum
  Clone ID: PAT_TA_103477.pep
HEVDVIKESLLEGYTNSFWTCSVSKLGYSGTAIISRVKPLSIKYGLGVPDHDTEGRIVTVEFDDFYLLTAYVPNSGDGLKRLTYRVTEWDPCLGNYMKELEKSKP

SEQ ID NO: 209060 - protein, 103 aa, Triticum aestivum
  Clone ID: PAT_TA_103478.pep
GTSIIAGPLIAETPVQAILGSFHNSAFLPNNAPRADIACYPNTQGAIANGSTLPSERSNPVYASRTSMEQNESSEVDVKPFVGLVNLNPEYASRTPVVQRESY

SEQ ID NO: 209061 - protein, 63 aa, Triticum aestivum
  unsure (1)..(63): unsure at all Xaa locations
  Clone ID: PAT_TA_103479.pep
VLVLCVGVGVVLVPRKCPGRRAMACPWLCTXDAELGHGQIEAVVLEGGGQRRSTEMGGELLVP

SEQ ID NO: 209062 - protein, 64 aa, Triticum aestivum
  Clone ID: PAT_TA_103480.pep
DFRNCYGTSPLILTARTPSSGSGVSARARGGVALGSGVETRAGSGFTAATSDDSRGGRAANLVP

SEQ ID NO: 209063 - protein, 76 aa, Triticum aestivum
  unsure (1)..(76): unsure at all Xaa locations
  Clone ID: PAT_TA_103481.pep
TSDNVGFNVKNVAVKDLKRGYVASNSKDDPAKEAANFTAQVIIMNHPGQISNGYAPXLDCHTSHIAVKFAEIQTKI

SEQ ID NO: 209064 - protein, 83 aa, Triticum aestivum
  Clone ID: PAT_TA_103482.pep
ARGKFPQMADPALEGRYPARGLYQALAVAAMCVQEQPTLRPLIGDVVTALSYLASQPYDPEVHGVHRPSRLTASGTPPRARNH

SEQ ID NO: 209065 - protein, 51 aa, Triticum aestivum
  Clone ID: PAT_TA_103483.pep
EFGTRIRMLYCAILRKSPKIMCALKVVKCLCKILTVHLRLSKQYMLVLVCG

SEQ ID NO: 209066 - protein, 98 aa, Triticum aestivum
  unsure (1)..(98): unsure at all Xaa locations
  Clone ID: PAT_TA_103484.pep
IRHENNGSTATDLCKQPHDAHKQGIYNIYRGAKQGWDEDDEEPLSRRKISVREKVDDILFELELHSLLKRLEAASPGSGKAIVEEALRSXGKXSDATE

SEQ ID NO: 209067 - protein, 85 aa, Triticum aestivum
  unsure (1)..(85): unsure at all Xaa locations
  Clone ID: PAT_TA_103485.pep
APLERARGALRGRXXRPRRVQLQHHRAGAPRVVGAXAHERRGPGPQPPGQGRRRPGGERPRHAKSVTPRWSEGSSPFAVTARAEF

SEQ ID NO: 209068 - protein, 77 aa, Triticum aestivum
  unsure (1)..(77): unsure at all Xaa locations
  Clone ID: PAT_TA_103486.pep
TAAAGLXLNRGVPGAGRKGRRGSRVWSSRASEQAPSSRPRNSRVYTSPSRVCTCVCSRVCTSCTVHVSVKTCCEIYM

SEQ ID NO: 209069 - protein, 80 aa, Triticum aestivum
  unsure (1)..(80): unsure at all Xaa locations
  Clone ID: PAT_TA_103487.pep
MVWSRMRTHGHHPSPRAGCCGALCGTKWYIAGGGSKKRRHPETWVFDVLESKWSVCVVPPNSSITTKKGFSMXPLDYXDK

SEQ ID NO: 209070 - protein, 128 aa, Triticum aestivum
  unsure (1)..(128): unsure at all Xaa locations
  Clone ID: PAT_TA_103488.pep
EFGTRDDGRITDSQGRTVSFTNCVIIMTSNIGSPLILDTLRNTTDSKDAVYEVMKKQVTEIARQTFRPEFLNRIDEYIVFQPLDSTEINRIVEIQLXRVKNRLLQQKDSPSVHTGRLVEHXGAXGFDP

SEQ ID NO: 209071 - protein, 87 aa, Triticum aestivum
  Clone ID: PAT_TA_103489.pep
PKTWWGMPFKPIPNTVRGTRCTQGALLGVPTRINFVQPQRLAVVHVRYYWPQFGPQYSRDLCVTPPNYTANRWVGEKLTNTVTLLHG

SEQ ID NO: 209072 - protein, 63 aa, Triticum aestivum
  unsure (1)..(63): unsure at all Xaa locations
  Clone ID: PAT_TA_103490.pep
XMLFSASLXEKTXIFPCYXRSYHXTMVXKHCNYCVSLGSGLRSPGRINEGPLSLPPIKSEVLY

SEQ ID NO: 209073 - protein, 136 aa, Triticum aestivum
  unsure (1)..(136): unsure at all Xaa locations
  Clone ID: PAT_TA_103491.pep
CYSPPPSVTXDAIFPCYQGPITPPPPVPPPPVPPSLSAFSHICNCPRALNRCNPCSNCYCPIFFNTSLLSEVTPVFIATSSALVLSSVTLIVALVIVIALVIVLVVVMMLLTIVLFLVTLFLTTQHFTQLVVMLAT

SEQ ID NO: 209074 - protein, 60 aa, Triticum aestivum
  unsure (1)..(60): unsure at all Xaa locations
  Clone ID: PAT_TA_103492.pep
PSTAVAAALXFXEFXGCFLXVFWFITETFFXGEELTPSTCYANVLRILITRRESSYEPHP

SEQ ID NO: 209075 - protein, 48 aa, Triticum aestivum
  Clone ID: PAT_TA_103493.pep
ARDFGSHKLYLFPAMTPYCDIYIYISSPCSLISIIQYVAFIQFGNKPC

SEQ ID NO: 209076 - protein, 29 aa, Triticum aestivum
  Clone ID: PAT_TA_103494.pep
KNKIFAVHFSLQRIHKSHHKHSKTVTKNY

SEQ ID NO: 209077 - protein, 43 aa, Triticum aestivum
  Clone ID: PAT_TA_103495.pep
ARGTIIQCWLGFNILLQKTMPLLMDLRYMFFSILLCNLVVLVA

SEQ ID NO: 209078 - protein, 107 aa, Triticum aestivum
  Clone ID: PAT_TA_103496.pep
LQLRGARAPGCTHRWAAEPACAAAASPLRRRLLLLFFLLLQLRCAAPTLTTSSPPPRCFSAVSAPRNSRGAPRWAAVPSTSLAFACCSMAARVLYRYAKGVCYLRLQ

SEQ ID NO: 209079 - protein, 128 aa, Triticum aestivum
  unsure (1)..(128): unsure at all Xaa locations
  Clone ID: PAT_TA_103497.pep
IIASASRFPNPNIFLTSFKGISRSNRAMAGSRRPGRGAKTPAAALKGRRIPVTAHYGTRRRRTGRHAAGNYGARRRCEEVGKLSRRRRLAPRLPPPLPGTRDPPAPRHRRDATCRHRARRQXVHNLVP

SEQ ID NO: 209080 - protein, 88 aa, Triticum aestivum
  Clone ID: PAT_TA_103498.pep
CSFLLFVFLYVLRCLLHLSIPKLCGVWARTTPGSVPARNSCCRFPCFSAEQEREMRCVANKSGLQGLSGEGEWKHWYIGGGEGQVVGN

SEQ ID NO: 209081 - protein, 105 aa, Triticum aestivum
  Clone ID: PAT_TA_103499.pep
QSQASLLTCVVAVFGVVSSFVVVFFSLFTKCSITDPNRLINPLPRYHPAPPPPSPPPDFPSPPPPDPFAPSAPAASSPDYPHASSAATLLNHRFHLSHSMHRYND

SEQ ID NO: 209082 - protein, 79 aa, Triticum aestivum
  unsure (1)..(79): unsure at all Xaa locations
  Clone ID: PAT_TA_103500.pep
KLPMLFSAXFCDXXRXFFPATXGPITWNRPAVNGLPAVXAQRSALGTYLGDSRPPRHHRRLNLHNSLTTIWQNKWLWDN

SEQ ID NO: 209083 - protein, 96 aa, Triticum aestivum
  unsure (1)..(96): unsure at all Xaa locations
  Clone ID: PAT_TA_103501.pep
MGKAARWLRGLLGGGGKKEQGKEHXRPATXTAPHGDRKRWSFCKSTRDSAEAEAAAAAAALSGNAAIARAAEAAWLKSLYNETEREQSKHAIAVAA

SEQ ID NO: 209084 - protein, 77 aa, Triticum aestivum
  unsure (1)..(77): unsure at all Xaa locations
  Clone ID: PAT_TA_103502.pep
NLSHSYSRCCLYCCFVLLLTFTEFSSSLSFPILFLITPLLLVPIIVVVVCLIPSSELTLTHPLVTXIDFHPLVDFTV

SEQ ID NO: 209085 - protein, 39 aa, Triticum aestivum
  unsure (1)..(39): unsure at all Xaa locations
  Clone ID: PAT_TA_103503.pep
STPRTSATIGXHDLXSRSGIIPQDPTLCQXAGNIHTRXX

SEQ ID NO: 209086 - protein, 115 aa, Triticum aestivum
  Clone ID: PAT_TA_103504.pep
GTRKLSDALVEDKLFQDEVACLIRAKHRNIVRLLGYCADTQGKITEYKGELIMAKVRARLLCFEYVSGGSLDMHLEDEFCGLEWHQRYIIIKGICHGLRHLHEEQKIIHMDLKPQ

SEQ ID NO: 209087 - protein, 111 aa, Triticum aestivum
  Clone ID: PAT_TA_103505.pep
LFKYELFLCTYGPLISAVAAAHRPAAHFQPRRAPPPAAAGEPADTVPALGPAASRASSSRSVASQQPRRPPWAPPRRPPPSPASPAAVAHAIGLGFVCVSRGGEWLRVRSC

SEQ ID NO: 209088 - protein, 114 aa, Triticum aestivum
  Clone ID: PAT_TA_103506.pep
SVGARVAVAALVAEAGGGGSPSAEYVLSDCIGSPVELHTLCRAPSLFSQDVARDHEQDHASGQLWWSPMQRVTPRAKRRTTCTCPPNCSPPRLVCSSEQPRSWNEKKPPELLVP

SEQ ID NO: 209089 - protein, 67 aa, Triticum aestivum
  Clone ID: PAT_TA_103507.pep
CGPIAGVRLGKCHCSCGWCHYSLQESIPWHIILLSCTLCLRICLIPLTLMFHTMVVVYCCNITTLIG

SEQ ID NO: 209090 - protein, 95 aa, Triticum aestivum
  unsure (1)..(95): unsure at all Xaa locations
  Clone ID: PAT_TA_103508.pep
RLAWGSGPIARPGGRRRPEAFGRAPGLEGGRPGSMGQGFGPGASHFGRLGTRPPSXRPVRPLARACPRGQDPTGPSAGPAGELTDREDGWLRGWK

SEQ ID NO: 209091 - protein, 110 aa, Triticum aestivum
  Clone ID: PAT_TA_103509.pep
QVPFLVGALAALYPPIKCVVVPHHLLTEEDPLAARKHHRLGGRRPRRPAAASPSQLAPLLPCTHPQVGGCSSITSSLRTGRRLPAPLSPSSETSGKILIHSIHLFFFSFT

SEQ ID NO: 209092 - protein, 106 aa, Triticum aestivum
  Clone ID: PAT_TA_103510.pep
EFGTSTRPPRSPWIRSFPRLRCSPTAISVRFNFGPGASRSLLVKLSESARFPLPPCWQPTVAMRPSLSSTITPPSRSCPCLQQMGRAPGHPCQPSSSSHLANKGLN

SEQ ID NO: 209093 - protein, 73 aa, Triticum aestivum
  Clone ID: PAT_TA_103511.pep
MECILLRIPSLGLCFKCGERWGREHTSSATVHLHVMEELMQLFGIDAAMSISRQALTGGVSSPRAFHLQAWLQ

SEQ ID NO: 209094 - protein, 79 aa, Triticum aestivum
  Clone ID: PAT_TA_103512.pep
MAAKGDGPAIGIDLGTTYSCVGVWQHDRVEIIANDQGNRTTPSYVAFTDSERLIGDAAKNQVAMNPINTVFDAKRLHWP

SEQ ID NO: 209095 - protein, 107 aa, Triticum aestivum
  Clone ID: PAT_TA_103513.pep
TLRTGSESRRSRRKRSAWIGLDSVRFFIAKGCTKARGFPYRQREESREPIQIRQRGAQRFAPLRGVLRWVPAEEKERDGGGAAETATRRGVGRDKGKGKWFWLVPNS

SEQ ID NO: 209096 - protein, 120 aa, Triticum aestivum
  unsure (1)..(120): unsure at all Xaa locations
  Clone ID: PAT_TA_103514.pep
NSARAPPPPIDALLCHRIRIRLRARAPLHPPSSPLPSARLHLRTSCRGRSASREQLSRSSRGPDPAQHYQDHHSTGGEESGHGGESAGDGGGPGGGTCGGSRSGVLQRSIPTXRAPRRAA

SEQ ID NO: 209097 - protein, 64 aa, Triticum aestivum
  Clone ID: PAT_TA_103515.pep
NSARDLLRLVLKEGTVVPRACKELFWKMCKILHLFYFRTDGFSSPKEMASAVNAVINEPLKLPS

SEQ ID NO: 209098 - protein, 104 aa, Triticum aestivum
  Clone ID: PAT_TA_103516.pep
VFISIAMILGDGLYNFVKVLVRTSVAFAAMVKKNSTIPVSDVGGAKATGEPVSFDEQRRTEQFMKDQIPKSVAYAGYAAVAAVSIATLPQIFPDLKWYYILVAY

SEQ ID NO: 209099 - protein, 113 aa, Triticum aestivum
  Clone ID: PAT_TA_103517.pep
GADRQISRRHGEIRPPPTARIQPSGHGRRASKLNSSIPSHTPIRQSKRGKKRAYDGGGSSGSGLVVRGSGAVGLGRRGLQRLALHHPSLASSVRSPSPAAPPCRLLGLVEASC

SEQ ID NO: 209100 - protein, 90 aa, Triticum aestivum
  Clone ID: PAT_TA_103518.pep
HEEMAAIHSAGERHDIEWSDTVNLATSAWWSRLLESVEGGEDDDGAAAAQQTNTVDAMGMHLSDECYGQDVSFPCMDIGEIEGWDAEWFS

SEQ ID NO: 209101 - protein, 61 aa, Triticum aestivum
  Clone ID: PAT_TA_103519.pep
VLPTRPAGRGHHRRRRRRRRRLRQIHQQQALAIPLERSRDGSTPHPPRPLAHIHVFPLPRA

SEQ ID NO: 209102 - protein, 80 aa, Triticum aestivum
  Clone ID: PAT_TA_103520.pep
ARAPSCRFLSPSTAARRRFLHHLLAAPPRPPQLRRCSPYHWMAVRSSTRDALPFSFPFFVCCTAILHNCLTIAAANWMIN

SEQ ID NO: 209103 - protein, 155 aa, Triticum aestivum
  Clone ID: PAT_TA_103521.pep
TSQGIHPHARRKQRRGRALSWRRPTARRLAPNPQIKSSLAAADGHGGSLRRGWQKAEGPFLPAEGAAEGGGRVPCGSGGRVPCGDGGSAAAWGRGRRSGRDSRQAPAAWSTYLGCCNRRLGFLLPQPALKETPKLARSRSHRLQPVRMISPLSLP

SEQ ID NO: 209104 - protein, 131 aa, Triticum aestivum
  unsure (1)..(131): unsure at all Xaa locations
  Clone ID: PAT_TA_103522.pep
ARAVASSPPTAPASPPSTAPPARSSSPTSSPARRPASPGPRWSTAASSSAAATSSPRRGAAPRSSTAASGTPTGPXRPTAATLRSRTGASSTAPSTGSSPPAGSSWLRSPRTTHWSCGCLGANSTRTLKRL

SEQ ID NO: 209105 - protein, 85 aa, Triticum aestivum
  Clone ID: PAT_TA_103523.pep
MKLIAAYLLAYLGGNSSPSAADVKNILDSVGAEADEEKLEFLLAELKGKDITEVIASGREKFAAVPSGGGAIAVGAPAAASGGGA

SEQ ID NO: 209106 - protein, 78 aa, Triticum aestivum
  Clone ID: PAT_TA_103524.pep
AKMMNVEAMGIIGNKLPPDVKICQSVSSIETTVAKPGLARACLSLKLVASKSPSTTKLGEMGRARIRTILSLIHRRCN

SEQ ID NO: 209107 - protein, 108 aa, Triticum aestivum
  unsure (1)..(108): unsure at all Xaa locations
  Clone ID: PAT_TA_103525.pep
ARAQLMLPYASHLFQVTEAVYKDPSRDESVTKAAVAALGDLADMLGXDTLISKDLFKIHPFHIELLSECLNSDNEVREIALSQGLITANRSRAFLTREIFSFLCCNEG

SEQ ID NO: 209108 - protein, 73 aa, Triticum aestivum
  unsure (1)..(73): unsure at all Xaa locations
  Clone ID: PAT_TA_103526.pep
IGIYSLXPRXTRKLGPQXXLLNGFMSNPPVNKPRPFRTKNSKNQYMVQFMAQLFPHDQKKIGCVSTNDNHYTN

SEQ ID NO: 209109 - protein, 105 aa, Triticum aestivum
  Clone ID: PAT_TA_103527.pep
SSVGLYQQQQAYYYKQGYMPFCRTMQTDLYYQYLIDNLGQLSASFYCSLGHTAVYVQLSQIRLCFLLLTATIVLKKTTIVLPEESGCMPIVLAAALSRHARLINS

SEQ ID NO: 209110 - protein, 65 aa, Triticum aestivum
  Clone ID: PAT_TA_103528.pep
MASSHTSSTSSAKVTMRASLASWSITAVYGPQSVADKFAFIQEIKQLKASMLPSWLLLGHFNLIC

SEQ ID NO: 209111 - protein, 37 aa, Triticum aestivum
  unsure (1)..(37): unsure at all Xaa locations
  Clone ID: PAT_TA_103529.pep
VAHMISXCMMHLHRRKGPSQLLAAPAFXMANLRSVLI

SEQ ID NO: 209112 - protein, 50 aa, Triticum aestivum
  unsure (1)..(50): unsure at all Xaa locations
  Clone ID: PAT_TA_103530.pep
SRDRRTLWDTLGDTRAGRRXDAFAHSTMPYTGTAATALALRXSLRTAQHL

SEQ ID NO: 209113 - protein, 135 aa, Triticum aestivum
  Clone ID: PAT_TA_103531.pep
VCSSYSLAVVRFFNNQQMPEPWSLLLAYRQGDGEDQGHYTVVVHRRRLPVSPRGCGSRQGGDPPAAEYGRGGGARRCSRWGRRGAAGSTCAGDERRLDRALGEAEARGRRSAAGGGRRRSVRWGVAGPQDAGRLV

SEQ ID NO: 209114 - protein, 95 aa, Triticum aestivum
  Clone ID: PAT_TA_103532.pep
ASTAARARSATVASAPSSTCTGHRLRSTVTFTSSRVSRGAGLSDSAATGWPSSASTAAGTCTELLMAGRDGERNQSRLIYVLVVSKGAREWSARA

SEQ ID NO: 209115 - protein, 62 aa, Triticum aestivum
  Clone ID: PAT_TA_103533.pep
TRFDLETLKWSVIGRMPFRIKTALAGYWDGWLYFTSGQRDRGPDNPTPKKVVGSVWRTKLHV

SEQ ID NO: 209116 - protein, 131 aa, Triticum aestivum
  unsure (1)..(131): unsure at all Xaa locations
  Clone ID: PAT_TA_103534.pep
GRGXGYPLTDWCLVPYTHQNLTWTQHAFNEKVADLRGVAVDAFSRLKSRWACLQKRTEVKLQDLPVVLGACCVLHNICEARGEAMPPELRVEVEDDLAVLDNPVRSDAAAKARDKIAHNLLHRGLAGTAFF

SEQ ID NO: 209117 - protein, 97 aa, Triticum aestivum
  Clone ID: PAT_TA_103535.pep
TGRGCYHLTSGSVGGGAARRRSALLRCGIPPRLVSSPPFAIREAAGVVQGQGGDVKEKRRRRLSVDGSREEVESGAGREEGAGGGSGGGSGLLVPNS

SEQ ID NO: 209118 - protein, 69 aa, Triticum aestivum
  unsure (1)..(69): unsure at all Xaa locations
  Clone ID: PAT_TA_103536.pep
APXLVSCDASLHXQLXGXVPKXYAWVXXTXXCFPSHXGSLAXXXXXXLXMKAVXXALIYXHDPLQVFSC

SEQ ID NO: 209119 - protein, 75 aa, Triticum aestivum
  Clone ID: PAT_TA_103537.pep
MKFGSIYEEYLRAEQDKYLAKCSHVEYKRLKKVLKRCRLDRSLQADGTNGDQQEDRSDDSSDACDCNSCTCMLSL

SEQ ID NO: 209120 - protein, 45 aa, Triticum aestivum
  Clone ID: PAT_TA_103538.pep
MLQGLLKQGHYEERSRGGPVPNSPYSESYYNSLAVVLQRRDWENP

SEQ ID NO: 209121 - protein, 95 aa, Triticum aestivum
  Clone ID: PAT_TA_103539.pep
ARASFNPMKNSISKRVEKSTMKLVVDADTDKVLGAAMCGPDAAEIMQGIAVALKAGATKATFDSTVGIHPSAAEEFVTMRTLTRRVSPPSKPKTN

SEQ ID NO: 209122 - protein, 48 aa, Triticum aestivum
  Clone ID: PAT_TA_103540.pep
MVKAVAVLTGSEGVKGTIFFTQEGDGPTTVTGSVTGLKEGLHGFMCTL

SEQ ID NO: 209123 - protein, 68 aa, Triticum aestivum
  Clone ID: PAT_TA_103541.pep
AWRRKKHATNSTTIFEKKAKLHRAIMPENIRAPTLRLGKSGPFNIRGVSPVSVRRLLICPPGQPHPHI

SEQ ID NO: 209124 - protein, 95 aa, Triticum aestivum
  unsure (1)..(95): unsure at all Xaa locations
  Clone ID: PAT_TA_103542.pep
HEMQFATNHVGHFLLTHLVLDTMKKTSRESNVEGRIVIVASEGHRVXYKEGIRFAKINDEQGYGTLAAYGQSKLANILHAGELARRFKEEGVNIT

SEQ ID NO: 209125 - protein, 151 aa, Triticum aestivum
  unsure (1)..(151): unsure at all Xaa locations
  Clone ID: PAT_TA_103543.pep
RPTSSSTVGHGRPAPTPSRSATAGCCSLAPGTARARGHVAVVDRLRSLVELRRTTGLPRVTASGGAAGGARIVLALPTRAALQAAALPIKDLEGQRGGAVIIKVDREGALSAANPRDLNPAAGHEDLAGGXRFNLCSGRRSVAVGMLQPRA

SEQ ID NO: 209126 - protein, 136 aa, Triticum aestivum; identical to SEQ ID NO: 106789
  Clone ID: PAT_TA_103544.pep

SEQ ID NO: 209127 - protein, 173 aa, Triticum aestivum
  Clone ID: PAT_TA_103545.pep
ARGQNNDMGTIKGSSKHDSVVKSVAKQDDGSSSAQHREMQNLIQKAKGARKFSETPRFSNSNKEGSLLKHDAVLELANRNSGIGPPTIPDMKKNKVKGARKFTEQPRSGNSNQVDPSVSSHFDGTSSHIRDLTTSQAAKQTVTSQKDQIAARKRQREDVESLLSSALISSKKP

SEQ ID NO: 209128 - protein, 104 aa, Triticum aestivum
  unsure (1)..(104): unsure at all Xaa locations
  Clone ID: PAT_TA_103546.pep
KKLRCQTTREQNKRPRRTVVTVHFRTLHPPIHPNYRIESQITAPYKTNVPLQRICTDDGGDRPPCLSTVRTGLLWFASNLIGCRRATAAWLRRHGXRWRRSCRI

SEQ ID NO: 209129 - protein, 85 aa, Triticum aestivum
  Clone ID: PAT_TA_103547.pep
EFGTRSKEGCGSAPLPHEHVITKVCQLTGTQLSIISCRMPMLKIIFSCSKAVLNQVYDFKSLTRMIMLKIAMQPSHVVITKSLSR

SEQ ID NO: 209130 - protein, 151 aa, Triticum aestivum
  unsure (1)..(151): unsure at all Xaa locations
  Clone ID: PAT_TA_103548.pep
MACYAALLHQPPASPSPCTSGRAGSCRVRPPPLLQRRAPPLSARARISPRCSYAAAGGSAGAGAGEQPAAALRRVLETPGAHQAPACYDALSARLVERAGFRACFTSGFSISAARLGLPDVGLISYGEMIDQGRLITESXVSIPVIGDADN

SEQ ID NO: 209131 - protein, 114 aa, Triticum aestivum
  Clone ID: PAT_TA_103549.pep
AAAAAVTPTLSCRVHVSHTVSTGDSARPLRVKHSINSPWTSCHCQCEIKQTHAWKYCICPDENNNNSLKCIYCNNLYTNGITRIKFHLGNIANSNALPCTKVPADVMDEIVEYL

SEQ ID NO: 209132 - protein, 67 aa, Triticum aestivum
  Clone ID: PAT_TA_103550.pep
LRSYTSIHGRCSGERIHIGNPSRGRDNWLVCVNISRDTNHCQVWWEKKQPIVFSLLQWALTRPVYLA

SEQ ID NO: 209133 - protein, 129 aa, Triticum aestivum
  Clone ID: PAT_TA_103551.pep
SDELLWAAAWLFQATDDRRYLDYLANNADAMGGTGWSTAMFSWDIKYAGVQVLAAKILLQGRAGAHAAVLQRYRQKADFFVCASLGKQGYGNVKRTPGGLLYHMQWNNLQYVTSGSFLLAAYSDSLAAA

SEQ ID NO: 209134 - protein, 175 aa, Triticum aestivum
  unsure (1)..(175): unsure at all Xaa locations
  Clone ID: PAT_TA_103552.pep
MKKFLVLALIVIAATTTAAEPFTAFRIASEPQHPSSPEQQPTLQPQEHPVPHQKLNPCRDALLHQCSPVADMSFLRSQVVQHSSCLVMWEQCCQQLKAIPKQSRCEAIHNVVHAIILQQQKQLVQGTSTQPQQQQQQGQQEHGQGSSQPQHQQQQXQLDQGWIVAIGTWVIHTVP

SEQ ID NO: 209135 - protein, 83 aa, Triticum aestivum
  Clone ID: PAT_TA_103553.pep
CAPVGSHAALAVKTHFHRQPTRLGRSLAPGRIKHSPTGKRGWLLSHSYAERNLVLPGRDKPEVAKSTVTKSGVSQETVESNNA

SEQ ID NO: 209136 - protein, 72 aa, Triticum aestivum
  Clone ID: PAT_TA_103554.pep
LIVPVDRVTKGANVLWSATSNMGPLPRMDHMHVHGEINIKIISPVSWYLKETMHGENSRGSCASCYCHRRRT

SEQ ID NO: 209137 - protein, 92 aa, Triticum aestivum
  Clone ID: PAT_TA_103555.pep
YLAAEVLELAGNAAKDNKKTRIIPRHLLLAVRNDQELGRLLAGVTIAHGGVIPNINSVLLPKKSPAAAEKEAKSPKKKTSTKSPKKKVAAKE

SEQ ID NO: 209138 - protein, 75 aa, Triticum aestivum
  Clone ID: PAT_TA_103556.pep
FYMMIIAAICWGIWTLRNKVTFDNHIVRSPLEAVFTACSFLLYWAGLLKEEGGAKLQAGVKRLAHAGAALADRSL

SEQ ID NO: 209139 - protein, 196 aa, Triticum aestivum
  Clone ID: PAT_TA_103557.pep
MKKFLVLALIVVAATTTAAEPFTAFRTAWEPHHPSSPEQQPTPQPQEQPVPHQKLNPCRDALLQQCSPVADMSFLRSQVVQHSSCLVMWEQCCQQLKAIPKQSRCEAIHNVVHAIVLQQQQQLVQGISTQPQQQQQQGQQQQGQGSSQPQQQTQLDQGWIAVIGTWVIQTIPAMCDVHVPPYCYTTISPSIDVTTG

SEQ ID NO: 209140 - protein, 151 aa, Triticum aestivum
  Clone ID: PAT_TA_103558.pep
QQILQQQLIPCMDVVLQQHNIVHGRSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 209141 - protein, 163 aa, Triticum aestivum
  Clone ID: PAT_TA_103559.pep
FSSRSSPSRSLVYGSKRYLLLFLFRFAESPNPVLSSLFWPSSYRLAMVEDPLCFLLLMADRCVRFLCVGVSCGASTALPSPSSGASPAGKLWSISLTRPWTERRLSPRPSARPLGSCLAGSTRPTALVFRPACGRAARNPGGGRFATPTTALPSVGGGLQAEI

SEQ ID NO: 209142 - protein, 139 aa, Triticum aestivum
  Clone ID: PAT_TA_103560.pep
VPPSVTSSQQGSYYPGQASPQQSGQGQQPGQEQQPGQGQQDQQPGQRQQGYYPTSPQQPGQGQQLGQGQPGYYPTSQQPEQKQHEGQGQQSGQGQQGYYPTSPQQSGQGQQPGQRRPRCYPTSPRQPRQWQQPGQGRQP

SEQ ID NO: 209143 - protein, 206 aa, Triticum aestivum
  Clone ID: PAT_TA_103561.pep
HAVIRFGRVKLEKPVFWSGRDDVDEESLKLKPRHARLQNMTYSSKMEVEVHIQIYSMEKSDKSKTEKDPFGHKRVLMDETHVVNIGRLPVMVNSNLCWLRELRESDCLYDSGGYFLIRGMEKIFIAQEQRCLTRIWIADRPVWTVSYLSEIKRRRIYVKLIDSTKNNDFSGSKIISISFLYANLPIWLMFFALGVSSDKEAFDMID

SEQ ID NO: 209144 - protein, 111 aa, Triticum aestivum
  Clone ID: PAT_TA_103562.pep
HTDIFHRDITIFTRGANSGVNPLQRVAHPVPPFLCDESHRHVCLPLVRPFLAVPIQATRLEFKGSLTIGKSKTLSIKETVLLNAEDISSQWFKHEDEDCYTRLSLSIRWAR

SEQ ID NO: 209145 - protein, 61 aa, Triticum aestivum
  unsure (1)..(61): unsure at all Xaa locations
  Clone ID: PAT_TA_103563.pep
GGTGKTTFANRHLTGEXDKKYEPTIGVEVHPLDLTTNCGKIRIYCWDTAGQEKLGGLRDGY

SEQ ID NO: 209146 - protein, 106 aa, Triticum aestivum
  Clone ID: PAT_TA_103564.pep
QFMNGKLRPDFIISCHQLQSSRVRSITSDLSMATAGASALVTQISSLGTGFTGAAPPLAPPWLPLPSIDPIFFTPEDFAALPSRSAQLRPSEFAGSTQHRLASAEL

SEQ ID NO: 209147 - protein, 123 aa, Triticum aestivum
  Clone ID: PAT_TA_103565.pep
PAWSQQPGWVTAHGRAGGRNVALVFKGGAIMGSGRQYLGRAWNEQATVVFFQVNMAGIVVPQGWDKWTPGQDVPQVTFAEVGCSGPGSGTAGRVPWEKHMSYAEVQRFVDIRFIDDGWLSNQP

SEQ ID NO: 209148 - protein, 70 aa, Triticum aestivum
  Clone ID: PAT_TA_103566.pep
KEKLCRSTKPQTMHKHIHIYVWFTCGNDKSCDTSTTHVQTSSGLEADYIWLIVDTYLEAKYPNYCYDSAY

SEQ ID NO: 209149 - protein, 165 aa, Triticum aestivum
  Clone ID: PAT_TA_103567.pep
PPQQLQQRIFWGIPALLKRYYPSVTCPQQVSYYPGQASPQRPGQGQQPGQGQQGYYPTSPQQPGQWQQPEQGQPRYYPTSPQQSGQLQQPAQGQQPGQGQQGQQPGQGQPGYYPTSSQLQPGQLQQPAQGQQGQQPGQAQQGQQPGQGQQPGQGQQGQQPGQGQQ

SEQ ID NO: 209150 - protein, 201 aa, Triticum aestivum; identical to SEQ ID NO: 135715
  Clone ID: PAT_TA_103568.pep

SEQ ID NO: 209151 - protein, 126 aa, Triticum aestivum
  Clone ID: PAT_TA_103569.pep
KMTILVIMFLVLLTIEEPSSGEQLGRQKFIGGGASPLSPGRGGKALAPSTGTDRGDDNLAPVLPLRHDCKETKAYGPPCRDVHPVIVCELYCTGLHFNGGRCRGPSPNDFVIALRVEGIACEKENK

SEQ ID NO: 209152 - protein, 103 aa, Triticum aestivum
  Clone ID: PAT_TA_103570.pep
MSTVTRAYLDQRLAAAKRCSREAAVAGAKAAAVATVAAAVPTLASVRMLPWAKAHINPTGQALIISTVAGMAYFIVADKTILSMARKHSFDEAPDHLKNTSFH

SEQ ID NO: 209153 - protein, 151 aa, Triticum aestivum
  Clone ID: PAT_TA_103571.pep
MECGGDGGGMDALPDGVVQAILSRLSSARDVAACAGVSRCWRHCVPFLPALYFPRSAFDVARRGGVACADDAIGRMVQAAARLQELVIYCPFSAAQLPRWLAARSASLRVLELRVDSAAAAGSGSGHLDCVAVARNLEELRLWGLTMTREP

SEQ ID NO: 209154 - protein, 104 aa, Triticum aestivum
  Clone ID: PAT_TA_103572.pep
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEAAMENP

SEQ ID NO: 209155 - protein, 150 aa, Triticum aestivum
  Clone ID: PAT_TA_103573.pep
SLDLDLLLQLQGLEMHLPPHAGDELFEFLVHLLHVVSAPGLCFLPHRVLLSSASLVMQTRDPIRHHGNLIASTMVKVVEAVGRSLFLRGIDLLERGIFPLRRSRQRLPAPHSRRGRLSASMFTLEPTFVGAGRASRRTGRPSLGLRPCLG

SEQ ID NO: 209156 - protein, 114 aa, Triticum aestivum
  Clone ID: PAT_TA_103574.pep
MKIFIDTGCSQEICRRPFTCPNLHGARQIILRLRCLFLRALARRAPQKSPHYFLKQSEIFSNFKQRGANFNNIDSNYSYKCLEPKSSIRTTWNHINLTCKLKNMVTYAAQICKE

SEQ ID NO: 209157 - protein, 164 aa, Triticum aestivum; identical to SEQ ID NO: 182739
  Clone ID: PAT_TA_103575.pep

SEQ ID NO: 209158 - protein, 84 aa, Triticum aestivum
  Clone ID: PAT_TA_103576.pep
RVHPCAHNNLLMENVTADSIYLAFSCFGGTSAVVALAWVSTGSTALASAFLVSISLCICICPRITWSISFICFSSFLHCMSVKI

SEQ ID NO: 209159 - protein, 136 aa, Triticum aestivum
  Clone ID: PAT_TA_103577.pep
SIAHGSSQVLQQSTYQLVQQLCCQQLWQIPEQSRCQAIHNVVHAIILHQQQQQQQQQQQQPLSQVSFQQPQQQYPSGQGSFQPSQQNPQAQGSVQPQQLPQFEEIRNLALETLPAMCNVYIPPYCTIAPVGFFGTN

SEQ ID NO: 209160 - protein, 133 aa, Triticum aestivum
  Clone ID: PAT_TA_103578.pep
VSLFVPAPVGAVPNERNLSVPPALVDAAPNRCSLSGPLPSPTGAQLVRGAVSTESGSTDGEQFAGSAYSLDRNADHASASRTSKSNFDEESSEWDDLGDGVTEKGTKSVNDGHPHINPVHGQQHDPMDVLQKL

SEQ ID NO: 209161 - protein, 101 aa, Triticum aestivum
  unsure (1)..(101): unsure at all Xaa locations
  Clone ID: PAT_TA_103579.pep
KGKKKANNSVKTNKIYIFXAMKQVHLNIGISSKTMSIMKSFISAILEKLSAESAKLARYTKKPTITSREIQTSVRLVLPGELAKHAVSXEGTKAVTKFTSA

SEQ ID NO: 209162 - protein, 99 aa, Triticum aestivum
  Clone ID: PAT_TA_103580.pep
TQSGWAFAVTTGTSINNLLELVQKLLPYQQGRSSARASLGYKDAANAAKGSIPASKWTTQVNNSTKAKQTMAYNTSHRLGFVVGEAHHLRARPSCIAGA

SEQ ID NO: 209163 - protein, 95 aa, Triticum aestivum
  Clone ID: PAT_TA_103581.pep
HNVVHAIILHQQQQQQQQQPLSQVCFQQSQQQYPSGQGSFQPSQQNPQAQGSVQPQQLPQFEEIRNLALETLPAMCNVYIPPYCTIAPVGIFGTN

SEQ ID NO: 209164 - protein, 110 aa, Triticum aestivum
  Clone ID: PAT_TA_103582.pep
METRRPAVSAVSVGAVVLILVWSPAAAVASGGWMDAHATFYGDETGAETMQGACGYGNLFEQGYGLDTTALSVALFSDGWSCGGCYEIQCHGDPHCKPGGAQVTVTATNL

SEQ ID NO: 209165 - protein, 58 aa, Triticum aestivum
  Clone ID: PAT_TA_103583.pep
FRLPLGRPYSPTTRSNHYAISTPSVSLVGVPSCKLTGFPHPVVFVMPKEVAVRSIYMI

SEQ ID NO: 209166 - protein, 83 aa, Triticum aestivum
  Clone ID: PAT_TA_103584.pep
QQQQQQQPLSQVCFQQSQQQYPSGQGSFQPSQQNPQAQGSVQPQQLPQFEEIRNLALETLPAMCNVYIPPYCTIAPVGIFGTN

SEQ ID NO: 209167 - protein, 59 aa, Triticum aestivum
  Clone ID: PAT_TA_103585.pep
ACKPARVMQLNTYCRSGQATLDCRSGLATLDCRLITSERCLLKAHIYGDGAQHLEVWIS

SEQ ID NO: 209168 - protein, 126 aa, Triticum aestivum
  Clone ID: PAT_TA_103586.pep
MPPAFHEQYDIHRSGNSFARGNLSRSCFGANVNGGSDLLNLSSHRAPGHILPPQGIQGKLNNFQQSLSANPFVPRFGGMAYKSHDERATLRLALQDISQPKSEANPPDGLLSVPLLRHQKIALSWM

SEQ ID NO: 209169 - protein, 167 aa, Triticum aestivum; identical to SEQ ID NO: 180142
  Clone ID: PAT_TA_103587.pep

SEQ ID NO: 209170 - protein, 85 aa, Triticum aestivum
  Clone ID: PAT_TA_103588.pep
QQQQQQQQQPLSQVCFQQSQQQYPSGQGSFQPSQQNPQAQGSVQPQQLPQFEEIRNLALETLPAMCNVYIPPYCTIAPVGIFGTN

SEQ ID NO: 209171 - protein, 63 aa, Triticum aestivum
  Clone ID: PAT_TA_103589.pep
FGFLHDSACHIIFSPLQRPNHGLRKRCFIYLVLELFSSQLVRRCQMARWCNMEGCRHCTLQVA

SEQ ID NO: 209172 - protein, 43 aa, Triticum aestivum
  unsure (1)..(43): unsure at all Xaa locations
  Clone ID: PAT_TA_103590.pep
AMVSNTLLNMLTSPVGFADTRXGQVRFPDISTAILHNICHFFY

SEQ ID NO: 209173 - protein, 93 aa, Triticum aestivum
  unsure (1)..(93): unsure at all Xaa locations
  Clone ID: PAT_TA_103591.pep
AGSRRTARATGPPPPPRRPPPSARRVAPPLGAPAPSAPCLSPSSTPGVVAATSAVSAAXASPWAPAPARHCWREPPCPPPDGTAAASAAAAAA

SEQ ID NO: 209174 - protein, 159 aa, Triticum aestivum
  Clone ID: PAT_TA_103592.pep
QQQQQQILQQILQQQLIPCMDVVLQQHNIVHGRSQVLQQSTYQLLRELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 209175 - protein, 91 aa, Triticum aestivum
  Clone ID: PAT_TA_103593.pep
WMSFFLLYCIVIISLFLLSFLLACPMFKPTIPLFAENGKGDEVTDDSFCRTPCVRHRLEIVVAGARSPANAMVLVVVEVRSVVTLFPAWST

SEQ ID NO: 209176 - protein, 81 aa, Triticum aestivum
  Clone ID: PAT_TA_103594.pep
EVGAQNGRVGAVPPRPDQGDAPLQVARFRRRQRPRRSPGGREVRSPAGARIGCFLSVPVVMIHGYRWLVHPVTLSRPGPSG

SEQ ID NO: 209177 - protein, 117 aa, Triticum aestivum
  Clone ID: PAT_TA_103595.pep
MLLLPSLRSSLRSSWPRGGVRSETVLVAAQPSWRIVGRWFDWSAPIGWWGLACGRNPCRFVRLRCGDTGGCHYPFLEGVGSSYPPTSLRVLGETLGLVRAAASSASHPFLEVLLSSR

SEQ ID NO: 209178 - protein, 140 aa, Triticum aestivum
  Clone ID: PAT_TA_103596.pep
PRLLPPARRGPRRRRRQGRGSCCGSRPVDGEPVSGTSWPPSAGEEAGSGRRPPGSRRRGMGSRGRRRRSLHRGRGRGRCRGSAETSPNGPAGGALAHQRRRRTAPEWAAGSAGPWRPTGGLRRRRRQHVESSWEALRCVC

SEQ ID NO: 209179 - protein, 135 aa, Triticum aestivum
  Clone ID: PAT_TA_103597.pep
MHLLLCCTFLLAFAAPATTAASAPAPAPTPAKQTMTWDVEYIMWAPDCQQRVMIGINGKFPGPNITARAGETLSITVNNKLHTEGLVIHWHGMRQVGTPWADGTASISQCAVSPGDSFTYEFVADKPGTYFYHGH

SEQ ID NO: 209180 - protein, 36 aa, Triticum aestivum
  Clone ID: PAT_TA_103598.pep
HQRDREGSSVADTKDIAMAKLMCLCFIILTIVVAVS

SEQ ID NO: 209181 - protein, 136 aa, Triticum aestivum
  Clone ID: PAT_TA_103599.pep
SRMTYRCRSAASGLPPLASPWLRSSDSLGLASSCIIVVAIVQPPRASRTTAFVGGLGPRTAGSEGEPRGGTDFDLRGCRGRSGFVPEIQRRGDHRGCVGRGLEAPRSNVVLLLSLFGNHGSAADVVRRRRSGAGRA

SEQ ID NO: 209182 - protein, 85 aa, Triticum aestivum
  Clone ID: PAT_TA_103600.pep
QQQQPQQLGQCVSQPQQQSQQQLGQQPQQQQLAQGTFLQPHQIAQLEVMTSIALSILPAMCSVNVPLYRTTTSVPFGVGTVAGAY

SEQ ID NO: 209183 - protein, 132 aa, Triticum aestivum
  Clone ID: PAT_TA_103601.pep
AGSPSTTTNTTTAARPPSCATPRCISTATRCPPRRSRRPGAAAQPIMTGGYGEFDQTGGPGLRAKEGRPLGRWSLGRGRRARGDRRQEGLSGWRRKGRRRQRWRESRSAGGGLALEPGGRDEVSRERDAHPW

SEQ ID NO: 209184 - protein, 100 aa, Triticum aestivum
  Clone ID: PAT_TA_103602.pep
LASSLDLLMAILRRSRNALCLVALVIMATCTVLSSANGPPGTINCMPPTGSCDPAHCTKFCAPNYHGHCAVGGIGAPSCCCYNPTSASVGVAHPAAPSHA

SEQ ID NO: 209185 - protein, 170 aa, Triticum aestivum
  Clone ID: PAT_TA_103603.pep
RHELSRPPVSAHLLRLRRRRTNRGSSDSSDQERRAGRKSTYAGGDEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVF

SEQ ID NO: 209186 - protein, 45 aa, Triticum aestivum
  Clone ID: PAT_TA_103604.pep
VPLDYRILRWRWRELRMPSWSSCVRVHLMIGLRAWLIEEPATGSI

SEQ ID NO: 209187 - protein, 48 aa, Triticum aestivum
  Clone ID: PAT_TA_103605.pep
LHTEHRHAAHDTGMKPKNRRTWGRPWSPRRRRAWRALRGGQRGRRCGS

SEQ ID NO: 209188 - protein, 90 aa, Triticum aestivum
  Clone ID: PAT_TA_103606.pep
VIFRVFYLTQTHGMPIHDHYLQPLFLLLPLFLTLLLIGNAKISFLPLLRHCCSRSRAPLRTQSESESSSSVDMPFRPPTRFSDFFFLTLY

SEQ ID NO: 209189 - protein, 101 aa, Triticum aestivum
  Clone ID: PAT_TA_103607.pep
SRCQAIHNVVHAIILHQQQRQQQPSSQVSLQQPQQQYPSGQGFFQPSQQNPQAQGSVQPQQLPQFEEIRNLALQTLPRMCNVYIPPYCSTTIAPFGIFGTN

SEQ ID NO: 209190 - protein, 180 aa, Triticum aestivum
  Clone ID: PAT_TA_103608.pep
MSTDIVVLVAVIILIGVFSMQHFGTDKVGWLFAPIVLMWFILIGSVGALNIHKHGSSVLKAYNPVYIYRYFRRNGNSSNTWTVLGGIMLSITGTEALFADLCHFPVLAIQIAFTFIVFPCLLLAYTGQAAYIISNKQHVNDAFYRSIPDAIYWPAFVIATAAAIIASQATISATYSIIKQ

SEQ ID NO: 209191 - protein, 62 aa, Triticum aestivum
  unsure (1)..(62): unsure at all Xaa locations
  Clone ID: PAT_TA_103609.pep
MAGKGKEEEVYVAXIDXGTTXTRFIIYDRHASPVASHQLEFKQHYPEAGWVEHDPMEIMESV

SEQ ID NO: 209192 - protein, 78 aa, Triticum aestivum
  Clone ID: PAT_TA_103610.pep
ILPQSDCQVMQQQCCQQLAQIPQQFQCAAIHSVAHSIIMQQEQQQGVPILRPLFQLAQGLGIIQPQQPGPPSTYHMPT

SEQ ID NO: 209193 - protein, 155 aa, Triticum aestivum
  unsure (1)..(155): unsure at all Xaa locations
  Clone ID: PAT_TA_103611.pep
QIIQQILQQQLIPCMDVVLQQHXNIVHGKSQVLQQSTYQLLQELCCQHLWQIPEQSQCQAIHNVVHAIILHQQQKQQQQPSSQVSFQQPLQQYPLGQGSFRPSQQNPQAQGSVQPQQLPQFEEIRNLALQTLPAMCNVYIPPYCTIAPFGIFGTN

SEQ ID NO: 209194 - protein, 132 aa, Triticum aestivum
  Clone ID: PAT_TA_103612.pep
TTAGSTRQIITVRRTQKLTSAAHATNQIERACPAILLLLALAPALPCLPPAPARRWTSSPRRHRLLLCCYPHRTHLPRTRTRSIVGPRPVLRRTHGTGRRRWAARALSRQCNPALEPGARRRPAASEPAPEL

SEQ ID NO: 209195 - protein, 80 aa, Triticum aestivum
  Clone ID: PAT_TA_103613.pep
PRGSPPPSSPPHGHLSPLTISTDRLLSSHRRATPRHWWWCAARRPQQRRAAVAAGTATSAWSGWSQALKIHQPPQARPPR

SEQ ID NO: 209196 - protein, 209 aa, Triticum aestivum
  unsure (1)..(209): unsure at all Xaa locations
  Clone ID: PAT_TA_103614.pep
RLGRERAEWLRLHYPFGLRARRGPGERVVMLSGSQSHPCAGDGGDHMLLRFLKNKVDYARLHGIELLYNTALLQPRMVAYWAKIPVVRAAMLAHPEAEWXWWLDADAVITDMDFAPPLATRYKEYNLVVHGWDGXVYEARSWVGLNAGVFLIRNCQWSLDFMDAWASMGPASPEYARWGKTLKATLSDKPDAESDDQSALAYLLLKNPK

SEQ ID NO: 209197 - protein, 102 aa, Triticum aestivum
  Clone ID: PAT_TA_103615.pep
QIDGKIPLFSERQKEQPRNSRNPHYAQQILVPHAHASLKTLPNPSRSPPSSKSSKPPEKSQRENRRDSNRQQEPAPPAARTFGCCRRHRRRRRLRLRLRRGA

SEQ ID NO: 209198 - protein, 63 aa, Triticum aestivum
  Clone ID: PAT_TA_103616.pep
DSTRRGGAAIPLRTYVHYVIQNKTILNSTTILYSDTTFEDTRATPYITDGCQYIDECLQPVVY

SEQ ID NO: 209199 - protein, 113 aa, Triticum aestivum
  unsure (1)..(113): unsure at all Xaa locations
  Clone ID: PAT_TA_103617.pep
WYLTHYAVEIGRKKKAAAAAKKEAAEGQEAEVAAAATEEAKKSNNVQRKLEKRXQGRTLDSHIEEQFSGGRLLACISSCPGQCGRADGYILEGTELEFYMRKLQKKKGKGATA

SEQ ID NO: 209200 - protein, 160 aa, Triticum aestivum
  Clone ID: PAT_TA_103618.pep
SRQLKPNEENYPTHDLELAEVHDLLTWRHLLLGRKVDIFTDHKSLKYIFTQPNLNLRQTRWVEMIQEYNPSIEYTPGKANVITDALSKKSYCNSLILKPFQPDLCEAFRKLNHQVVPQGFLANLQVSPTLEDQIREAQLLDAMVKKVKNGIAKSQPKYKC

SEQ ID NO: 209201 - protein, 45 aa, Triticum aestivum
  unsure (1)..(45): unsure at all Xaa locations
  Clone ID: PAT_TA_103619.pep
AETQDSTKIWDIKSKHIVQDLRPKVPVSTKHMLXCTCLSWRADGS

SEQ ID NO: 209202 - protein, 220 aa, Triticum aestivum
  Clone ID: PAT_TA_103620.pep
TSAAAVMDELRRPPEFDHMFTDEAWASMTQDTRRRIVDISCRVVEEPTQEERRMHQLIAGPVFTDAAAVAEVLDFADRHHREAEREDWEAVLQGRHYADECADDDEDGKTMTKTTTAQTVDARPPKQTLSRDIQKSKAFLWTRYHQLHLLHRPSPARPGPMRYASCEFGGDDRCPHNPVPMLQFLDVMVELYTKSYCFVKFMRDNMLQSNNIEVYGVIAV

SEQ ID NO: 209203 - protein, 114 aa, Triticum aestivum
  Clone ID: PAT_TA_103621.pep
ARAYDEAARLMSGPAARTNFPSTNGVAAAAGGGLSATLRAKLEKCCMATAPPVQNVEATKAARTGGGAARRNRVEDVVKRVDEEEECIEEMIRELTHYGSVEIVAPSACSSSVV

SEQ ID NO: 209204 - protein, 195 aa, Triticum aestivum
  Clone ID: PAT_TA_103622.pep
QQGQQPGQGQQPGQGQPWYYPTSPQESGQGQQPGQWQQPGQGQPGYYLTSPLQLGQGQQGYYPTSLQQPGQGQQPGQWQQSGQGQHWYYPTSPQLSGQGQRPGQWLQPGQGQQGYYPTSPQQPGQGQQLGQWLQPGQGQQGYYPTSLQQTGQGQQSGQGQQGYYSSYHVSVEHQAASLKVAKAQQLAAQLPAMCR

SEQ ID NO: 209205 - protein, 115 aa, Triticum aestivum
  unsure (1)..(115): unsure at all Xaa locations
  Clone ID: PAT_TA_103623.pep
GRVVNGGGKVCFNFRDTGTCHFGDRCAFPHAAPSGHAIRLTGDQKVLTSPGPXYAAPGTARAYPYPPVIPPAARDRLAQMTEENGGKKPNRLMLMSQRKIGGIYGDWPEQKEQEE

SEQ ID NO: 209206 - protein, 128 aa, Triticum aestivum
  unsure (1)..(128): unsure at all Xaa locations
  Clone ID: PAT_TA_103624.pep
RAVRVPVPQLQPQNPSKQHPQEQVPLVQQQQFLRQQQSFPPQRPYPQAQPFSSQQPYLQLQPFSXPELPYLQAQPFRPQRPCAQPQPQYWEPQQPISQRQQQQQQQLQQQQQQQQQQQQRQQQQQQQQ

SEQ ID NO: 209207 - protein, 62 aa, Triticum aestivum
  Clone ID: PAT_TA_103625.pep
MRMFSKACSLVISSLPRWYSSAPAIRGQPSWIPRVTKKWLGKPLMYGIGTLLVMPLKTIHGV

SEQ ID NO: 209208 - protein, 63 aa, Triticum aestivum
  Clone ID: PAT_TA_103626.pep
NPAFGDRPVKDAARHLLFHRAMGLTPSGDAHWRALRRLAAAHLFCPRRVAASAPYRSSIGTRM

SEQ ID NO: 209209 - protein, 129 aa, Triticum aestivum
  unsure (1)..(129): unsure at all Xaa locations
  Clone ID: PAT_TA_103627.pep
HKLLQQSTYQLVQQLGCQKLWQIPEQSRCQAIHNVDHAIILHHHQQQQQQQQQPMTQVSFQQPQQQYTXGQGSFQPSQQNPQAQGSVQPQQLPQFEEIRNLALETLPAMCNVYIPPYCTIAQVGIFGTN

SEQ ID NO: 209210 - protein, 89 aa, Triticum aestivum
  Clone ID: PAT_TA_103628.pep
GIGAGSGGNYSAPGVLPGCLASGLLVPDQDVRRPHRLHPRSYRCHHPIPPPLSPFLRHSPLRLLRVLGYVFSGPWEVEERWAAAAIRAC

SEQ ID NO: 209211 - protein, 120 aa, Triticum aestivum
  Clone ID: PAT_TA_103629.pep
RQALPHEALRFLGDCDAALGVWGAGGVGKTTVLRRVRDVCGRVAPFFDHVLLLAASRDCTVAKLQKEVVAVLGLRDAPTEQAQAAGILSFLRDKSFLLLLDGVWERLDLERVGFPHPLGV

SEQ ID NO: 209212 - protein, 142 aa, Triticum aestivum
  Clone ID: PAT_TA_103630.pep
MKTLLILTIIAVALTTTTANIQVDPSGQVQWPQQQQPFPQPQQPFSQQPQQIFPQPQQTFPHQPQQAFPQPQQTFPHQPQQQFPQPQQPQQPFPQQPQQQFPQPQQPQQPFPQQPQQQFPQPQQPQQPFPQPQQPPLPFPRQ

SEQ ID NO: 209213 - protein, 58 aa, Triticum aestivum
  Clone ID: PAT_TA_103631.pep
DAHKECSTAKSLRSAPDAMLFSKSTRSLASFSPTSRCWTSTSFPSLGALLTAVQRTWC

SEQ ID NO: 209214 - protein, 120 aa, Triticum aestivum
  Clone ID: PAT_TA_103632.pep
FENLQVSGTALFFSLIGTGVSMTRTMIPKKLPFLSLCLSRPAVRRTALSPRLLSHTGRSSSRPMWPHSAPELLAASERAGGDLITRVDGPNPSVSSSPISSSSRATCGSTGGFRSAWLTC

SEQ ID NO: 209215 - protein, 51 aa, Triticum aestivum
  Clone ID: PAT_TA_103633.pep
EETRGVLKIFLENVIRDAVTYTEHASKKTVTAMDVVYALKRQGRTLYGFGG

SEQ ID NO: 209216 - protein, 58 aa, Triticum aestivum
  Clone ID: PAT_TA_103634.pep
TRHIYGIANEHACLNTKRAAHRTITGGPTMRHRPLARTLTEDVPLAAVPLPPLGRTTG

SEQ ID NO: 209217 - protein, 166 aa, Triticum aestivum
  Clone ID: PAT_TA_103635.pep
LLIVTILAMATTIATANMQVDPGYQVQWPQQQPFPQPQQPFCQQPQQTIPQPHQTFHHQPQQTYPHQPQQQFPQTQQPQQPFPQPQQTFPQQPQLPFPQQPQQPFPQPQQPQQQFPQSQQPQQPFPQPQQQFLRPQLPQQSFPQPQQPVIQLSLQQRMNPCKNFLL

SEQ ID NO: 209218 - protein, 162 aa, Triticum aestivum
  Clone ID: PAT_TA_103636.pep
MKTLLILTLLAMAITIATANMQVDPSGQVQWPQQQPFLQPHQPFSQQPQQIFPQPQQTFPHQPQQQFPQPQQPQQQFLQPRQPFPQQPQQPYPQQPQQPFPQTQQPQQPFPQSKQPQQPFPQPQQPQQSFPQQQPSLIQQSLQQQLNPCKNFLLQQCKPVSL

SEQ ID NO: 209219 - protein, 72 aa, Triticum aestivum
  Clone ID: PAT_TA_103637.pep
MASKSNCVLLLAAVLLYIFAAVAVIGDEDCTPWMSTLITPLPSCRDYVEQQACRIETPGSAYLGNQHCCGEL

SEQ ID NO: 209220 - protein, 87 aa, Triticum aestivum
  Clone ID: PAT_TA_103638.pep
TAYQHHELCTSRPNSSSQGYHNPHIRSILHCILRRMKCGVSTTILHMKLSPHSQSCQCGGGVGEVKEKGRHKCTPADESHCNSSPQP

SEQ ID NO: 209221 - protein, 87 aa, Triticum aestivum
  Clone ID: PAT_TA_103639.pep
HQQQQQQQQQQPLSQVSFQQPQQQYPSGQGFFQPSQQNPQAQGSFQPQQLPQFEAIRNLALQTLPAMCNVYIPPYCTIAPVGIFGTN

SEQ ID NO: 209222 - protein, 83 aa, Triticum aestivum
  unsure (1)..(83): unsure at all Xaa locations
  Clone ID: PAT_TA_103640.pep
SGYYPTSAQHPGQLQQSTQEQQLGQEQQDQQSGQGRQGQQSGQRQQDQQSRQGQQPGXRQPTYYSTSPQLLGQGQPRYYPTSP

SEQ ID NO: 209223 - protein, 96 aa, Triticum aestivum
  Clone ID: PAT_TA_103641.pep
QLVLEVHSHSPRGTHCLHALRRHSIKMQPLHCQEASLVADLPNGPKNPNHPFSLQMVPHSPSTPSDQLTYAQTLPHLRHPGEQHPLLAYTESNTCM

SEQ ID NO: 209224 - protein, 97 aa, Triticum aestivum
  Clone ID: PAT_TA_103642.pep
ARRARRGRRRRRPPRRRAPRRRRGSCGTRGASYTAGGTPPRSPAPLPDRPHPRRRRRRLHRAPPRIAAGRASGWRLGKAFKIGERAGGNGGGAGRGG

SEQ ID NO: 209225 - protein, 103 aa, Triticum aestivum; identical to SEQ ID NO: 107316
  Clone ID: PAT_TA_103643.pep

SEQ ID NO: 209226 - protein, 113 aa, Triticum aestivum
  Clone ID: PAT_TA_103644.pep
MRTCNILLVVLAALTIVYPATSAGEYWSPIENVNEPHVQDIGRWTVVEHVKQVHDGLKFSKVTGGGEQNVAGVKYHLVVDTVNHDDKHGRYEVVLIKDNTSNMRRIISFSPTS

SEQ ID NO: 209227 - protein, 160 aa, Triticum aestivum
  Clone ID: PAT_TA_103645.pep
QPTVYLIRSPPSTAEEERVRGGAALSNFCLHTTYAPSSVRVVGGGYRAPEVASTPWACSCWSSSWQVPDARVRAPATYVLLLFFHETAPGFDQIPPNSPRSRPSGFCGILVQLSASTRSTLRGFGAIPRCDFLMGPGLIEAKGFGRPFTMAGTCAETVDE

SEQ ID NO: 209228 - protein, 27 aa, Triticum aestivum
  Clone ID: PAT_TA_103646.pep
ARRKTVTAMDVVYALKRQGRTLYGFGG

SEQ ID NO: 209229 - protein, 36 aa, Triticum aestivum
  Clone ID: PAT_TA_103647.pep
ISFSIHIESMKLSWRYKFICLKQTQINNFNHCLNHT

SEQ ID NO: 209230 - protein, 56 aa, Triticum aestivum
  unsure (1)..(56): unsure at all Xaa locations
  Clone ID: PAT_TA_103648.pep
FWGLLIFMLVATTMAVXCGARNHNSGPWSWCDPATGYNVSALTGCRAMEKLHCVGS

SEQ ID NO: 209231 - protein, 183 aa, Triticum aestivum
  Clone ID: PAT_TA_103649.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIQTIPAMCDVHVPPY

SEQ ID NO: 209232 - protein, 102 aa, Triticum aestivum
  Clone ID: PAT_TA_103650.pep
APVLDCHTSHIAVKFAELVTKIDRRSGKEIEAAPKFLKNGDAGIVKMIPTKPMVVETFATYPPLGRFAVRDMRQTVAVGVIKGVEKKDPTGAKVTKAAIKKK

SEQ ID NO: 209233 - protein, 78 aa, Triticum aestivum
  Clone ID: PAT_TA_103651.pep
PRMLDTELPNEFDRGECLLRTNPPCSPTNLKEFDGTKMGAIHAHLHLVRPPLSCSVLSTLALGDAHCQCALMVVAHGP

SEQ ID NO: 209234 - protein, 40 aa, Triticum aestivum
  Clone ID: PAT_TA_103652.pep
EAIRSLVLQTLPTMCNVYVPPECSIIRAPFASIVAGIGGQ

SEQ ID NO: 209235 - protein, 64 aa, Triticum aestivum
  Clone ID: PAT_TA_103653.pep
CGTTVAVNPCFVDSCRHTTLAAKNLPLPFKLSKLYKNLYLVFVFSPYKIVHSISTIILTANCEV

SEQ ID NO: 209236 - protein, 51 aa, Triticum aestivum
  Clone ID: PAT_TA_103654.pep
ISGCLQYALFISVVHNVMLYMCNYLPCSTFHKSSFKHTNRNAYICLLLSLL

SEQ ID NO: 209237 - protein, 33 aa, Triticum aestivum
  unsure (1)..(33): unsure at all Xaa locations
  Clone ID: PAT_TA_103655.pep
RRWILMLVVVKLSQXHLSLRMEDLLRILWFYLR

SEQ ID NO: 209238 - protein, 59 aa, Triticum aestivum
  Clone ID: PAT_TA_103656.pep
RNPRYPAPAAVPTREPCVRPAAASRPSRARRAARAAARISPSRCRSARTSPPRSPCRCR

SEQ ID NO: 209239 - protein, 33 aa, Triticum aestivum
  Clone ID: PAT_TA_103657.pep
TAGRVRPQSAMPAPPSSTSSPAGARELVTTNVI

SEQ ID NO: 209240 - protein, 60 aa, Triticum aestivum
  Clone ID: PAT_TA_103658.pep
AAMVVLLSVTVAESATVEYQFEVATMNVTRLCGCKSLVVVFLQFPGPSVWAREGDLVVVR

SEQ ID NO: 209241 - protein, 55 aa, Triticum aestivum
  Clone ID: PAT_TA_103659.pep
EQVAVGGGIEYEDEASASNITTDAAELPPPPPVYAPMEWMLARPSVGWLVDYPDR

SEQ ID NO: 209242 - protein, 70 aa, Triticum aestivum
  Clone ID: PAT_TA_103660.pep
MARMALLAVFAVLAALAVAEMASGAVTCGDVTSAIAPCMSYATGNASAPSAGCCGGVRTLNGKAFTSADR

SEQ ID NO: 209243 - protein, 62 aa, Triticum aestivum
  Clone ID: PAT_TA_103661.pep
MINLLTKTAIQPCRRFRFKQLRRNHSRVSVNPSVLVKTTSTSNPVASVSAASHMFRCIAEQW

SEQ ID NO: 209244 - protein, 97 aa, Triticum aestivum
  unsure (1)..(97): unsure at all Xaa locations
  Clone ID: PAT_TA_103662.pep
VSLKPKVFLCSCTPAAIGESGASKPPGPDEAAPERRADEPARTDGAGNTPPPPFLEVTCRSSGEVRRFAAGTTARXALHAVNRKLAPGAPAALHVEA

SEQ ID NO: 209245 - protein, 100 aa, Triticum aestivum
  Clone ID: PAT_TA_103663.pep
STGRDSGRSNSAIVGGDGDDALVTSVSRTVTLVHSTEARPRKLLATRTKLSATSLPGGGIDGIQSTATRPPESLSCSFSGRSITTTARTITATASTVTTD

SEQ ID NO: 209246 - protein, 114 aa, Triticum aestivum
  Clone ID: PAT_TA_103664.pep
ANMTLRCMQALVRVQARVRDQRLRLSQESLSAAGAAACGSSKSSYSVDTSAFWDSKYTQEYAERRSRSRDGSSFAAEDWDDRPRTIEEIQAMLQTRKDAALKRERALSYAFSHQ

SEQ ID NO: 209247 - protein, 49 aa, Triticum aestivum
  Clone ID: PAT_TA_103665.pep
SARLTPARAVDMLKLARLCDARRLYLRCARLAAKDFSAVERSDGWRFAR

SEQ ID NO: 209248 - protein, 56 aa, Triticum aestivum
  Clone ID: PAT_TA_103666.pep
LHDALDCWGESSNGQAELSGQVSGDGESSSSYWSGILGMVVTSELPPSHPHPPAFL

SEQ ID NO: 209249 - protein, 86 aa, Triticum aestivum
  Clone ID: PAT_TA_103667.pep
SMSLGALLKKLVLSWGQLLTWLIFQYHNGPLRSFLEAKFFSRKYKLLSRAGTAELSFPSIRTGCYTMHVRCSTKQWLQNNMSASLP

SEQ ID NO: 209250 - protein, 171 aa, Triticum aestivum
  Clone ID: PAT_TA_103668.pep
SRFCYACSYTPCSSPLLQTAVASRRCTAAPLQLRRSSLRRRRRALHRNFRHGRRVLHRSIRCHRRRCNEARPGLQWSAAGVVGAPPGLHWSFVDGSVQRRSGSMQRRWRLSREALGVALERSPSAPLQLRRSARQPLDVAFWCCYGALVMAALRCCGDMRCCEIEARGLVE

SEQ ID NO: 209251 - protein, 175 aa, Triticum aestivum
  Clone ID: PAT_TA_103669.pep
MTIESTFKLAFDEDQQIVADKWIHIFRALSDERGPWSASPFPNNLVTYWKHDKTEDKWRRRMKLKRNYKFDERICQPLSTKSTNENTAPSVDPFVSAKIPEKMKRFLLKGVRGITGDVGSESCEDNNDTSEPSQNKPSENQVSSDAANSADSSDYPTSSVQNRKEQSSTGGDNDY

SEQ ID NO: 209252 - protein, 85 aa, Triticum aestivum
  unsure (1)..(85): unsure at all Xaa locations
  Clone ID: PAT_TA_103670.pep
LAAALDSTRPPIPGGEPRQGVVTLRQYTPDSGAKRSLTSRFAAAQLNRTATLDAFGLAAYDAVWMAARAIDEFLEEGXNVTFSAD

SEQ ID NO: 209253 - protein, 77 aa, Triticum aestivum
  Clone ID: PAT_TA_103671.pep
FAHSTTHQMDHLTLMRSPFRLLLSLHLLLSLFNPLAVADLASESQALLDFASAVYRGNKLNWGQGTPPCSWHGVKCS

SEQ ID NO: 209254 - protein, 170 aa, Triticum aestivum
  Clone ID: PAT_TA_103672.pep
TIGYSLLRSSGRSDPAMQNANAIDGSKIRTGESNAIDCIQAKDHSTGRTEIASCLRVAEVAQVRVAAAESSIQTAYLSVNDKVELDVKYADELGYTFSEALGVAPVKIETNYPDVLSIVMPRDVNGTYGAHQRFVLQARSHGTALVRLHINHPSRKSDFIMVSVGARMYP

SEQ ID NO: 209255 - protein, 130 aa, Triticum aestivum
  Clone ID: PAT_TA_103673.pep
MAATAAEEPQEPRRGVDGELSGLDPGPGSCEAAPAREPVPTEMPAAAEAESSSMRKLGRLFRLTEVHLWDDFYVKPHDWRATETVGCTGSQTAKTRNKAAKQTDEDHSFVEDMELASLMGSLGLPVSFST

SEQ ID NO: 209256 - protein, 102 aa, Triticum aestivum
  Clone ID: PAT_TA_103674.pep
LHQTTSFLGTAPRSDDLVRIVGDFGGRITMRRTVKSAPQSIWYRPDRPKYLGPFSEQTPSYLTGELPGDYGWDTVGLSADPETFAKNRELEVIHSRWAMLGA

SEQ ID NO: 209257 - protein, 200 aa, Triticum aestivum
  Clone ID: PAT_TA_103675.pep
MADLVVGLAKSVVEGALTKAQAAIGEEAQLRESAQRDLVFITGEFEMMHSFLNVATAERVENKVVMTWVRQVRELAYDVEDCIEFVVHLDPKTGWWWRMLPPWCIGLPPSQLSLDEAVGEIEQLKARVNDVSTRNSRYNLISDSGSKAAVMQHHMPAPGASLGAPAFNMLAESRDTARKQQGLGDLTQLITNKDNTDPHL

SEQ ID NO: 209258 - protein, 134 aa, Triticum aestivum
  Clone ID: PAT_TA_103676.pep
VGSHREVYKVGALNAALAEFISTLIFVFAGQGSGMAFSKLSPDGAATPAGLISAAIAHAFALFVAESVGANISGGHVNPAVTFGAFMGGNITLLRCLLYWIAHVLGSTDGCFLLRFYTGGLPTGTFGLIGIGAW

SEQ ID NO: 209259 - protein, 77 aa, Triticum aestivum
  Clone ID: PAT_TA_103677.pep
RKAMGKKRRPVGKTSSRWQGRAGHQPPCLVGRPVNAMALEVGRMDGMVLVVRGGDGRGWRRRWMDGAAAGGGWCGGA

SEQ ID NO: 209260 - protein, 194 aa, Triticum aestivum
  unsure (1)..(194): unsure at all Xaa locations
  Clone ID: PAT_TA_103678.pep
YQLLGLADYINEKLXXKKTDNSCEAELTRKDVIKCIQAQKIRFRGLNLSGLDLSKLDLSEVDFSYACIERTNFSCANLHKAKFRLVEAAHSTFEQANLHECELTGANLQEAVLDRANVQSANLQDACLMGCSFIETDVRSAHLQNANLTGADLNGANLEGANLKGAKLSGANLQGANLQRAYLREVDLRETDLT

SEQ ID NO: 209261 - protein, 41 aa, Triticum aestivum
  Clone ID: PAT_TA_103679.pep
ARAALYLASDEARYVNGHNLVVDGGFTVGKLIHTPDPVTSE

SEQ ID NO: 209262 - protein, 65 aa, Triticum aestivum
  Clone ID: PAT_TA_103680.pep
QPPWTLIHLDQFNHLAEEQTTVMACSRHLEAVGREGGEDSTTAELVLHRMRGKDPGAGPRADQGA

SEQ ID NO: 209263 - protein, 217 aa, Triticum aestivum
  Clone ID: PAT_TA_103681.pep
MAQAAHVVMLTSSGAGHVLPVSELAKRLAVRHGFTVTIVTYASLSTPGHSSPLASLPPGVSVAALPEVSISDLPADAHLVTRILTVINRALPQLRDLLRSLLGLPAGITAFMTDMLCPAALAVSKEMGLPGYVFYTSSLMSLLSLLYTPELSRTTTCECRDLPEPVMLPGCVPLHGADLVEPVQNRSDPVYELMVDLGLNYLLAEGFIVNTMDALEH

SEQ ID NO: 209264 - protein, 192 aa, Triticum aestivum
  Clone ID: PAT_TA_103682.pep
RLWEIGSANCIKVFPHSNFVTCVQFNPTNDNCFITGSIDGKVRVWDITRCSVVDWADVRDIVTAVCYRPDGKGAVVGTITGNCRFYDASDNLLRLETQIALSGKKSSLKRITNFQFCPNNPSKLMVTSADSKIRMLDGTNVIQNYSGLRSGSCQMSASFTPDGEHIVSASEDSNIYVWNRDNQDDSVWRQAK

SEQ ID NO: 209265 - protein, 87 aa, Triticum aestivum
  Clone ID: PAT_TA_103683.pep
MAPQQKVVVKVSSMSDERVKQKAMETVADIYGIDSIAADHKDQKMTVIGDMDSVVIAKKLRKFGRIDILSVGPAKEEKKDDKKGEKK

SEQ ID NO: 209266 - protein, 183 aa, Triticum aestivum
  Clone ID: PAT_TA_103684.pep
MAGSGASDDEVVLEIEHCIRVFKSGRVERYFGSDPVPASTDAGTGVASKDRTISPDVAVRLYLPPLATEGVDGKKLPVLVYFHGGGFVLHTAFNAVFHAYLSSLAARARAIVVSVDYRLAPEHPLPAAYDDSWQALRWVASHAPGGAGEEPWLADHGDFSRLSLGGESAGANIAHHLAMRAGA

SEQ ID NO: 209267 - protein, 125 aa, Triticum aestivum
  Clone ID: PAT_TA_103685.pep
MGEDDIVHKHRHFVDRVNTCQTCVLLSRGHLFLRPQVLEAGLNRHDIFNLDRFRERLLHGVILPRGIGKLKALHSLGVVNGSGRNGNVTVKEFGELTQLRKLKVGGLSYRNINELWSAIAGHNST

SEQ ID NO: 209268 - protein, 180 aa, Triticum aestivum
  Clone ID: PAT_TA_103686.pep
MAAGLLLPQAARLCFCVWAVAVLSLAGSSAAVNGTSAVSEAVVVDARAAVAETDSAFVCATLDWWPPEKCDYGTCAWGRAGLLNLDLSSKILQNAVKAFSPLRLRLGGSLQDLVVYGTGDTGAPCSPFTKNTSAMFGFTQGCLPMHRWDELNAFFQKSGAQIVFGLNALNGRVPMPDGSM

SEQ ID NO: 209269 - protein, 137 aa, Triticum aestivum
  Clone ID: PAT_TA_103687.pep
MAPKVAVAKKGDAKAHAAKVAKAVKSGSIKKTAKKIRTSVTFHRPKTLSKARDPKYPRISTPGRNKLDQYQILKYPLTTESAMKKIEDNNTLVFIVDLKADKKKIKAAVKKMYDIQAKKVNTLIMPDGKKKAYVKLT

SEQ ID NO: 209270 - protein, 63 aa, Triticum aestivum
  Clone ID: PAT_TA_103688.pep
DLLLRWIQIGSNGKPVSHCFRFISTIAGKHLYDLITNQEKAGQQRPVVKGTVVACIGHDVRCC

SEQ ID NO: 209271 - protein, 50 aa, Triticum aestivum
  Clone ID: PAT_TA_103689.pep
ASSATTVAPFQGLKSTAGLPVSRRSSGSLGSVSNGGRIRCMQVCRGTKLI

SEQ ID NO: 209272 - protein, 62 aa, Triticum aestivum
  Clone ID: PAT_TA_103690.pep
HRRRTSSRRRCRCPWPGWPLRERCGLLGPVPGWLWQSFSDVSLLDYPPVYGACIFLPVVHPS

SEQ ID NO: 209273 - protein, 105 aa, Triticum aestivum
  Clone ID: PAT_TA_103691.pep
RVAVAHRRHCYLLALGLVRLRLLLLGPCLALLQGITDTAQQLGQLILLLHLRWLRDDFLLVCLEDAEDVVQRLPVRQVPVHFVLERLEQLLHYSLHIIAALLRHG

SEQ ID NO: 209274 - protein, 89 aa, Triticum aestivum
  unsure (1)..(89): unsure at all Xaa locations
  Clone ID: PAT_TA_103692.pep
MRSERGKSFGLVAAPLGTGARREGYTYDFFPXRALSPILFSLDYGPNLCEMKKNGASVAREVNLPGHTGASLHVFWALMFVRGTTLGKA

SEQ ID NO: 209275 - protein, 53 aa, Triticum aestivum
  Clone ID: PAT_TA_103693.pep
LCWRPRPSMSQPSHPYPLRPPTRRLSSAASVGAAGAADAPRPMRPSCARWRGG

SEQ ID NO: 209276 - protein, 76 aa, Triticum aestivum
  Clone ID: PAT_TA_103694.pep
HGFTLPSNSLPPWSAGEMDLARRVETQARWPDGSNVRPLTRSISTTTPDGKQHGGDRAGAGDSHGGRRASVCACSS

SEQ ID NO: 209277 - protein, 175 aa, Triticum aestivum
  unsure (1)..(175): unsure at all Xaa locations
  Clone ID: PAT_TA_103695.pep
MAPTVMASSATSVXPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 209278 - protein, 158 aa, Triticum aestivum
  Clone ID: PAT_TA_103696.pep
MEIVVGASEATMKSLLRKLGGLLAHEYALIRGVRGDIQYINDEMTSMQAFLGDLSSTIPQGHDRRMKDWMEQIRDVTYDIEDCVDDFAHRLSHDPGGEVCCAFVISKVYEFWTWQSRRDIASSIAELKVRAQQIGERRTRYGVDNPKSGSGESSAVAT

SEQ ID NO: 209279 - protein, 108 aa, Triticum aestivum
  unsure (1)..(108): unsure at all Xaa locations
  Clone ID: PAT_TA_103697.pep
MGRLAVTAAVAAWAIPIAALVDSIAPDPYMDEIFHVPHAQDYCRGYFLTWDPMITTPPGLXYLAFLFAGAWAIKVPEAFDPLCTTALVQSTNVIMAMVCGVLVHDLLL

SEQ ID NO: 209280 - protein, 121 aa, Triticum aestivum
  Clone ID: PAT_TA_103698.pep
MCNSNVKTAGVAQIDGRPVLQPAGNRVAAPEGAKPLKKSLQKSLSMPASYDNAAAAAATACTAAPKSTGAGEFARAAAATPYLLPPTPAKAAGAKAAGGRTAASTGADKSRKQAPRKSGAV

SEQ ID NO: 209281 - protein, 76 aa, Triticum aestivum
  Clone ID: PAT_TA_103699.pep
RNYIYNIAFFQLKGEVYSVKCSLMLIWRLKNSMTPLTIRTLMKRICRRHRCICGRTFKESCVMLRSMFRHIMLLFL

SEQ ID NO: 209282 - protein, 178 aa, Triticum aestivum
  Clone ID: PAT_TA_103700.pep
HTSGHSGSVVPDKNGESPVLEHGHPEWLQDVWKLVTSNHEATGESIDAIVDGVRRALDEGPVRGNGDASDLLYDRAKVEELIGNLIDKITSTIRVSAEDDAARSESLLYAKPELCARLEYLVHVCHDVLQRKARLEDFIDEVCLVLEYIMSIYFSNQVRSDTVDGNENDFHAHVEPDV

SEQ ID NO: 209283 - protein, 189 aa, Triticum aestivum
  Clone ID: PAT_TA_103701.pep
MASLVPGVLLKLLQHMNSDVKVAGEHRSSLLQVVSIVPALAGSDLFTNQGFYLKVSDSSHATYVSLPEDQHDLILSDTIQLGQFIHVDRLEAATPVPILRGVRPVPGRHACVGTPEDLVMTSSSKFLGEKKAQPPANGSKDAGALSLEKEQSKLEKLNASVKSNGMESKKPQLTKSNSSLSKQALASLF

SEQ ID NO: 209284 - protein, 113 aa, Triticum aestivum
  Clone ID: PAT_TA_103702.pep
VGGDVSRSWAVLATGCDRGWGCGRTITTTTADPPLIVEIYGCNDVLEAELLALCYGISLAIQWSMLPLDIESYCLQAVQMIVGGSSNKSKYVFIVKEIISTMEERSSCITHSR

SEQ ID NO: 209285 - protein, 148 aa, Triticum aestivum
  Clone ID: PAT_TA_103703.pep
MRPSSRILAARHLLRSSRFQPSTAAAASSVFRRLDGTNGPPVPKPLRNPHLGEPGPNCRVFPGSSAPFAHVNCLLPDSTYPPHCARPLRDLRGHAFSTAANSVTVGKPADDNVHKDAPKKDIDDQIADAQILRNLWKYLMLNDSPDFR

SEQ ID NO: 209286 - protein, 51 aa, Triticum aestivum
  Clone ID: PAT_TA_103704.pep
SLDLAGVNFLRLLKVVGSAMPGLHGLTYECQPLRLRGQGASIISSTIPSRT

SEQ ID NO: 209287 - protein, 59 aa, Triticum aestivum
  unsure (1)..(59): unsure at all Xaa locations
  Clone ID: PAT_TA_103705.pep
DDRHXYYALGRYNAAKNTWTPVDVDADLGIGLRYDWGKFYACKTFYDPAKKRRVLWGWG

SEQ ID NO: 209288 - protein, 104 aa, Triticum aestivum
  Clone ID: PAT_TA_103706.pep
PPPFVPSPPPLHAFAAALAHQSRRPPSDDPLQETPPTPFRTSRRSRPGSDAVPLQKPHATADPSPEKSRLLRWAIERGSKGVTFTCGRKGPLHRRREPCAGGAL

SEQ ID NO: 209289 - protein, 58 aa, Triticum aestivum
  Clone ID: PAT_TA_103707.pep
HARPVVGGQRGVHGRAAPREHAGHVGHETGLTGYRRAHRRRRRPERFGWRAGTAPWFT

SEQ ID NO: 209290 - protein, 168 aa, Triticum aestivum
  Clone ID: PAT_TA_103708.pep
MAMMGSTAAVLLALVVVASPLLLAASQPVGAPPAAPATNNSRLEKAYVALQALKNAITDDPKNLTKNWCGPDVCSYYSVYCATAPDDPCARTVASVDLNHGDLAGTLPEELGLLSDLAVFHLNSNRFCGALPDALRSLHLLHEIDVSNNQLTGNFPSQILCLPNVQYV

SEQ ID NO: 209291 - protein, 98 aa, Triticum aestivum
  Clone ID: PAT_TA_103709.pep
RPCPSSSTTPRRREREASPPATTVVPPSSLLLRASPTARRPGALFFLFIPSGSPLPTAARNQDPIPSPPVHSSPAASEIQPDPPSSMATAGDAPAPAS

SEQ ID NO: 209292 - protein, 83 aa, Triticum aestivum
  Clone ID: PAT_TA_103710.pep
KTPHAPTFFSPSHSPPSPHLTNPHQLPPPSTYLRRRRLGLSSRNASSPTPPHPHWTASPLTSAPPGAPPSPPQSPRRPRIQVR

SEQ ID NO: 209293 - protein, 141 aa, Triticum aestivum
  Clone ID: PAT_TA_103711.pep
LVLFRIEGEHKLPPTTLSPGDMVCVRTCNSRGEGATSCMQGFLYNLGEDGCSITVALESRHGDPTFSRLFGKSVRIDRIQGLADALTYERNLEALMLLQRNGLLKSNASIDVVATLFGDSKDVMKMEQNCLIDWGESSVPD

SEQ ID NO: 209294 - protein, 107 aa, Triticum aestivum
  unsure (1)..(107): unsure at all Xaa locations
  Clone ID: PAT_TA_103712.pep
QAAAVRSLFSADNPFRRKESAPEEPPRAPPPTPASAAVPTPARKPPKRPQAEAEAEPAVPSRRKRSEEDGEGPAARRKRKRDQVEAGYXRRTLGAAPADEEQRPRPV

SEQ ID NO: 209295 - protein, 174 aa, Triticum aestivum
  Clone ID: PAT_TA_103713.pep
MAPAVMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 209296 - protein, 111 aa, Triticum aestivum
  Clone ID: PAT_TA_103714.pep
YPKKSPPAVSFHLYDEFREMSLSNFCAVCRIPYEGELEEPHREDVGGFVNTIAVEEPKKGSEAKVSSIHFPVLRYFAIFASRCLIGHGNSGNLSVPDIIILQHVLLGDNTF

SEQ ID NO: 209297 - protein, 80 aa, Triticum aestivum
  Clone ID: PAT_TA_103715.pep
TAHLPRPFLPSFIQFHMDASQAFLIKCTSSFFTEEEYKCTNETQFLFKANVFLKKKENHGQTYKCLPEEKCKCLTLNALS

SEQ ID NO: 209298 - protein, 116 aa, Triticum aestivum
  Clone ID: PAT_TA_103716.pep
ERQGKCAMATAEIAAKRLIGNGLRRKDGQPFTGYPVVGFQGKMQTSGSCARPPASSPLTACAWDPRFKGLFFYESTAIFSPARFRSFVLDVKKLRDLNPDGMCGVDVYNGLLVRFV

SEQ ID NO: 209299 - protein, 129 aa, Triticum aestivum
  Clone ID: PAT_TA_103717.pep
SVWRPSRGTAPKSRAPSRLLIADYSCLLVFIYNIFFVLQGVLCTIFSKLSLKEAVRTSAVSRKWRYLWTVCPKLSFDGSTICGNNRYGKQVYALAFIRIVNRVLAQCRGKLFEELAIKIDLNRMFVEHL

SEQ ID NO: 209300 - protein, 105 aa, Triticum aestivum
  unsure (1)..(105): unsure at all Xaa locations
  Clone ID: PAT_TA_103718.pep
MRPAAAAAASVLQAPRRALGGVSFVAARCASSSSSSVAFAAAATSYDHVSFVKEIAVTDPPEHLNSLLNVLHARGEKIVSPGAXRGLIPLVVPLSESPQGYLTFL

SEQ ID NO: 209301 - protein, 133 aa, Triticum aestivum
  unsure (1)..(133): unsure at all Xaa locations
  Clone ID: PAT_TA_103719.pep
LLAAGHAVTVLTVGDEGSDKMKKPPFSRFSELTSAGAKTVWGDPADVGAAVGGATFDVVLENIGKDLDAVKPVADWAKSAGVGQFLFISSAGIYLQTDEPPHVEGDAVKESAGHVXVEKYIAAEFGSWASFRP

SEQ ID NO: 209302 - protein, 151 aa, Triticum aestivum
  Clone ID: PAT_TA_103720.pep
TATSNGARPSPPVAPPRLLRRAVAGLVAVRVQAAPVGAFPPQTFAAAPTTVKSPPQASAASPSQVSAAPPTFSAASPSQVSAAPPMAVAASAPQVSAAPPTTVAASAPQVSAAPPTVAASAPQAAAAAPPTVAASPQLAAASAPTKSFAAA

SEQ ID NO: 209303 - protein, 146 aa, Triticum aestivum
  Clone ID: PAT_TA_103721.pep
MKGPDGWWKEESSSKTGLRHTTDLVQIKDGLLSKGQLPDGWRKEVRPRKDGTKSDPVQIKDGLLSKGQLPDGWRKEVRPRKDGTKSDPYYTDPVSGYEFRSLKDVQRYIESGDISKCNVRPKKRTAQGACITQNQDYTGRSSEYAR

SEQ ID NO: 209304 - protein, 127 aa, Triticum aestivum
  Clone ID: PAT_TA_103722.pep
MAASTTMALSSPAIKLAGASYALGGGRVTMRKAAPKAAASNSPWYGPDRVLYLGPLSGEPPSYLSGEFPGDYGWDTAGLSADPETFAKNRELEVIHCRWAMLGALGCVFPELLARNGVKFGEAVWFK

SEQ ID NO: 209305 - protein, 90 aa, Triticum aestivum
  Clone ID: PAT_TA_103723.pep
MASKSALVGNRCVAGSQSPCGAGMRCASCSPLAGAPAPPLRSSSSARPPPPHWWAIGRAAGAASGYAAPAAGAPWDRSRRAVPGCFIIYY

SEQ ID NO: 209306 - protein, 59 aa, Triticum aestivum
  Clone ID: PAT_TA_103724.pep
PAVLLLLLALLIVPRGGDGAAVFSGYTFKGQGEAEAFEEALLRQACFNVTSSSSGAGRG

SEQ ID NO: 209307 - protein, 173 aa, Triticum aestivum
  Clone ID: PAT_TA_103725.pep
TAYHAASCLRPSCRRRSPLSLYVANATLCPRVVPSFPQGSRKPKEAAMRSAQPPESWADLAGAVSSHPSLRAGMKNLSGLGRTSIWTMRASRARSHRSSLSASIHEESIHIMLRHLKLSKDATMQRKNLSSVLLALVERHQRTNGYMLMATHIEAGDQLSKFIVYTRKAGDQL

SEQ ID NO: 209308 - protein, 49 aa, Triticum aestivum
  Clone ID: PAT_TA_103726.pep
MYVCRCFVDKVPITEYRNSDKPNRFFPIMKPMYVFSSIWNADDWATRGG

SEQ ID NO: 209309 - protein, 169 aa, Triticum aestivum
  Clone ID: PAT_TA_103727.pep
PRRRHAVRRLREAGAIVVGKTNLDEFGMGSTTEGSGFQVTTNPWDDSRVPGGSSGGSASAVSARQCVVSLGSDTGGSVRQPASFCGVVGLKPTYGRVSRFGLMAYASSLDVVGCFGSSVFDTATILSVIAGHDKMDSTSSSHDVPDYRSDLASLSLLESKPLNSVRIGI

SEQ ID NO: 209310 - protein, 118 aa, Triticum aestivum
  Clone ID: PAT_TA_103728.pep
PAGIGAGTECPSKKRALHYGAGPPCPPSPSSSPAIKEEGVMVWSRPASGRGSRLGDGLHARHGAPPSIVMACRADRNQPQGCLVLDPAAPRPLSVRSGAGCHGEFVMACRSQPQGRVR

SEQ ID NO: 209311 - protein, 49 aa, Triticum aestivum
  Clone ID: PAT_TA_103729.pep
ARQHRHRDHRRRQEEDWSRPRRRRGDGHGWLGDHSPQPPDRRKVDPDRT

SEQ ID NO: 209312 - protein, 173 aa, Triticum aestivum; identical to SEQ ID NO: 182615
  Clone ID: PAT_TA_103730.pep

SEQ ID NO: 209313 - protein, 40 aa, Triticum aestivum
  Clone ID: PAT_TA_103731.pep
FFFFFFGVNMNIIAVLHSNSIDTHFLQHQHDAQDSITSTK

SEQ ID NO: 209314 - protein, 134 aa, Triticum aestivum
  Clone ID: PAT_TA_103732.pep
MSPVRIVESAYVGVPETAAPPPGPIRFTAMEALWVVFPVLQHVLLYEAGDDMPPFDAILQSLRSSLAATLGSFAPLAGKLVHLEETGDVGISCSASDGVRFVVAECDADIRRLAGDEEHDLRVLEALVPEVDMD

SEQ ID NO: 209315 - protein, 204 aa, Triticum aestivum
  Clone ID: PAT_TA_103733.pep
SCSEVFTDATVQEHFDVKCWVSVSSSSNKMELAAEILRSVLPAWDGSADKMLDFKMLQSELRRALTSKRYLIVLDDVCNITDETWMDMLAPLQSADTGSRIMATSRMDTMPHIFRASQLYTVNPLKSEDCWTLLKEHALPSDPGNVYQELHPIGKQIAEKINGSPLAAKLVGGLLGDTRSTIHWMNIMEKGLQDNAVFSALCLS

SEQ ID NO: 209316 - protein, 97 aa, Triticum aestivum
  Clone ID: PAT_TA_103734.pep
MEAALVSAATGALKPVLAKLGALAGDEYKRFKGVRDDIKSLTRELTAMDAFLLKMSEEEDPDVQDKVWMNEVRELCWPSPDAEYFQRQATTTTDKAH

SEQ ID NO: 209317 - protein, 59 aa, Triticum aestivum
  Clone ID: PAT_TA_103735.pep
RRGRGRPAMADTVLSMARSMLGGAISGLGSPAVRQKSLVRHQHGRLCRRRRDEPPHGRA

SEQ ID NO: 209318 - protein, 168 aa, Triticum aestivum
  Clone ID: PAT_TA_103736.pep
DFVGGRFGRDGEFYYQSRRERAPQTSEDALYGVFGEGDSDYDSEEDEASRRRRRRKRRMDDSEPDLTRPVQFVSKGISAPKPEEDEEQQRPGLGQAASSSGTAAAAASEEDAEEDQDPYIDLPTGFGQRIAEGARARREEKERQQESAKRRRSAFGAGFEPGKPAPPP

SEQ ID NO: 209319 - protein, 143 aa, Triticum aestivum
  Clone ID: PAT_TA_103737.pep
MGPAASRLHPARPAAPLSPVSSVEKTKGAAAAADEVQLEGMPSEFYYEEWQANQRERTNEWHAYGQKEEADEEAKSSEYREIGMRMKAYPQEEVCKARVLVSSFIRAGEDVENVIENAAERGELTELVLMVIWNRLDVARRDD

SEQ ID NO: 209320 - protein, 163 aa, Triticum aestivum
  Clone ID: PAT_TA_103738.pep
MCGDVDDSVSQSSIDFAGRANWLRAAVLGANDGLVSTASLMLGVSAVKPEARAMVVSGFAGLLAGACSMAIGEYVSVCSQRDMEIAELDQAGKRGGEEEKALPSPAQAAAASALAFSVGALLPLLAAGFIVGYNLRVAVVVVVATLALAAFGCVGAVLGRAPV

SEQ ID NO: 209321 - protein, 50 aa, Triticum aestivum
  unsure (1)..(50): unsure at all Xaa locations
  Clone ID: PAT_TA_103739.pep
THATRTRWIEKGTEFXRLSTRSLPPPPPPPMQPEPGGLRKAQNFLGYLAA

SEQ ID NO: 209322 - protein, 159 aa, Triticum aestivum
  Clone ID: PAT_TA_103740.pep
NAALNDELFFSVANHTLTVVEVDAVYVKPFTVKTLIISPGQTTNVLLTAKPFYPKANFYMLAAPYSTIRPGTFDNTTVAGILEYQKPGSPSMSSFDKDLPLFKPVLPRFNDTGFVTNFTSKLRSLATPQYPAAVPRSVDKRFFFTVGLGTLPCPANTTC

SEQ ID NO: 209323 - protein, 200 aa, Triticum aestivum
  unsure (1)..(200): unsure at all Xaa locations
  Clone ID: PAT_TA_103741.pep
QGISNQFCFPSESRETFEITNSFQNQFESNLVGSISQICDTFMSQGVSCVPESSLAVGGVSASVSSDDLLSSMVFNGLSTFNNDGVCTTPMTALEDSNHARNLMSGSQKCMEDVVGETCEAYAESFGRNEQESCSTTGYQLMDECSRADSIWLLSGKKTSDSCKVERVQDTWNRLRRCXACTSCETNHNRTASGALNLLG

SEQ ID NO: 209324 - protein, 213 aa, Triticum aestivum
  unsure (1)..(213): unsure at all Xaa locations
  Clone ID: PAT_TA_103742.pep
HXPQGSFQPCNLSENGPEEYSGAKDGLLDHIDHLYDDEMRSSGNISTEVNSWLSAFEQGIHPRVMSDDELSGDGWLSFLRIAISHLGGLSQPRFLEEQITCQDQVTGHRVWIKLQQRSGWSVKLEATRHHLFDALQDAAMLAVITMRQHFPCEFRGTPFEVLPVEPGQRSRQLDDGAAVVRGGAMAXAFTGIDHHDVQXLLAVGFMSLXHERS

SEQ ID NO: 209325 - protein, 213 aa, Triticum aestivum
  unsure (1)..(213): unsure at all Xaa locations
  Clone ID: PAT_TA_103743.pep
QQPQQPFPQPQQTFPQQPQLPFPQQPQQPFPQLTSELSHGNRICGSEGAVTAETTHSTDVNLYRNVFITSFGEVPGLILSAAIVDKFGRKLSMSSMLYVSCLCIAPLMFAQTESLTTIFLFGARICISASFIVLHIYAPEIYPTAVRATGVGFASSIARFGGILCPLVAVGLVHACHQTAGIAVVITVMLVSAVAVSXFPWRQAGRKLXEPHC

SEQ ID NO: 209326 - protein, 153 aa, Triticum aestivum
  unsure (1)..(153): unsure at all Xaa locations
  Clone ID: PAT_TA_103744.pep
TDPXTGHTQGXFXLXXLTXXXXXSXKWNXRXFWXWKKXITXNGNFGXXNXKDXRXXIXSPXPWGXCXLLVFFWXPDEXNGVKRWXXDQEFKLKTIRXFTXIEXDSYVXGHLMXVTDGIVYLAHCYDGYTEVXXXPILLSXKQGXLKKSGNINT

SEQ ID NO: 209327 - protein, 199 aa, Triticum aestivum
  unsure (1)..(199): unsure at all Xaa locations
  Clone ID: PAT_TA_103745.pep
MKTFLILALLAIVATTATTAVRVPVPQLQPQNPSQQQPQEQVPLVQQQQFLGQQQPFPPQLPYSQPQPFRPQQPYPQPQPQYSQPQQPISQQQQQQQQQQQQQQQQQQILQQILQQQLIPCMDVVLQQHNIAHGRSQVLQQSTYQLLQELCCQHLWQIPEQSQCQAIHNGGHAIILHQQQKQQQQPLSQVFFNKLXQQY

SEQ ID NO: 209328 - protein, 287 aa, Triticum aestivum
  unsure (1)..(287): unsure at all Xaa locations
  Clone ID: PAT_TA_103746.pep
REQKLELHRGGGRSRTSGSPGLQDSARDKHQQQPQEQVPLVQQQQFLGQQQPFPPQQPYPQPQPFPSQQPYLQLQPFPQPQLPYSQPQPFRPQQPYPQPQPQYSQPQQPISQQQQQQQQQQQQQQQEQQILQQILQQQLIPCMDVVLQQHNIAHGRSQVLQQSTYQLLQELCCQHLWQIPEQSQCQAIHNXXHAIILHQQQKQQQQPSSQFFFQQPLQQYXLXXGFFRAXXSKNPQAQGXVQAXQLAQFEEIRNLXLQTLPGMXNGYNPSYWTIGPFGXFGTYLGRK

SEQ ID NO: 209329 - protein, 256 aa, Triticum aestivum
  unsure (1)..(256): unsure at all Xaa locations
  Clone ID: PAT_TA_103747.pep
MKTLLILTILAMAITIGTANIQVDPSGQVQWLQQQLVPQLQQPLSQQPQQTFPQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQQPQQPFPQTQQPQQPFPQLQQPQQPFPXPQQQLPQPQQPXQSFPQQQRAFIQPSLQQQLXNPCRNXXLXQCQTXVIGXQSFWGNKLGPQSEWPNECGEQKACQQLTRIP

SEQ ID NO: 209330 - protein, 227 aa, Triticum aestivum
  unsure (1)..(227): unsure at all Xaa locations
  Clone ID: PAT_TA_103748.pep
MKTFLILAILAIVATTATTAVRVPVPQLQPQNPSQQQPQEQVPLVQQQQFPGQQQQFPPQQPYPQPQPFPSQQPYPQPQSFPQPQPFPPQLPYPQPQPFPPQQPYPQPQPQYPQPQQPXXXXXAQPPPPPPPPPPPPPXPHXFHXXCNTXXXVXXXXXNSHIHXXLKYXAKXPAVVQLCCQQLCRPPXSRXXXIQXXHAIIXIATHHDTXQPXSQFLQEXRTIGSLI

SEQ ID NO: 209331 - protein, 334 aa, Triticum aestivum
  unsure (1)..(334): unsure at all Xaa locations
  Clone ID: PAT_TA_103749.pep
XXIIXXPWIPSXXWXKXNPXTXTXNXXGPGXQTKXXIXFXFSXKXPPPXXXGRGVLIXXXXXXXAHXXKSXXXLTXXSXQNHXHXXXIXLXIPXFKXXXXXXXLPTXFXXYLTNPXINXNYXXXYXQNTXXNXXXXLITPXXYHXXHIYXXIHXSHXXTXXTHXXXTPXPXQXXXTXPXXTXHXHXTXXTXXXTXXNXXXLXXXXSXXXXXXSXTXTHXIXXTXTTXTXHHTXXQXHXYXXXXXXHXTHTXHXXXXXXXHXHTXXXPSXHXLPXXXTXXXXXTXQXXXTXTPSHXTLXTNXSXKXQXXXXXKXYXXXXXITXXTXITHIXHIXT

SEQ ID NO: 209332 - protein, 193 aa, Triticum aestivum
  unsure (1)..(193): unsure at all Xaa locations
  Clone ID: PAT_TA_103750.pep
MKTFLILALLAIVATTATTAVRVPVPQLQPQNPSQQQPQEQVPLVQQQQFPGQQQQFPPQQPYPQPQPFPSQQPYLQLQPFPQPQPFPPQLPYPQPQSFPPQQPYPQPQPQYSQPQQPISQQQQXQQQQQQQQQQQQEQQXLQQILXQQQLIPCMDXXLQQHNLAHGKITRFCNKSTYPGVCXNWWLRHPMKN

SEQ ID NO: 209333 - protein, 178 aa, Triticum aestivum
  Clone ID: PAT_TA_103751.pep
YDFTIGRIGYRAPPRVFFFFFFLNTESTQLYSQSHKDQIYYDTRKRMFNKTERSISQKKYTSSRHRHPIQTSTPAKAGRHDRLLHQPRPEHGHQRERHQGKGGCRSGAGRRAARVRRGSGRRRRRHEVLRPRGGEGRGRNCRHEQHGDPGSHRIHSLARWSELGTTRSRRVICVCWCR

SEQ ID NO: 209334 - protein, 118 aa, Triticum aestivum
  unsure (1)..(118): unsure at all Xaa locations
  Clone ID: PAT_TA_103752.pep
CXXRXCXXGLRWRXXXDRMXMTVXCIXLXXDXPIXLXEXYLSXIXXIXDLXXTVXKAXXDSVFXKKXXXXXSXGGALVPKXPPIXXXXLXXDXXXQFXQPYXIGEKPXXXPXIXXYLX

SEQ ID NO: 209335 - protein, 213 aa, Triticum aestivum
  unsure (1)..(213): unsure at all Xaa locations
  Clone ID: PAT_TA_103753.pep
TRFAQXPQQQFPQPQQPQQPFPQQPQQQFPQPQQPQQPFPQPQQPQLPFPQQPQQPFPQPQQPQQPFPQLQQPQQPLPQPQQPQQPFPQQQQPLIQPYLQQQMNPCKNYXLQQCNPVSLVSSXVSMILPRSDCXVMRQQCCQQLAQIPXQLQCAXIHGVVHSIXMQQXEQQQXQXQQQQGXQIMRPLFXAWSKVRXXIXPXNQXNXEVIRPLX

SEQ ID NO: 209336 - protein, 207 aa, Triticum aestivum
  unsure (1)..(207): unsure at all Xaa locations
  Clone ID: PAT_TA_103754.pep
NRHQKXFLILALLAIVATTATTAVRVPVPQLQPQNPSQQHPQEQVPLVQQQQFLGQQQSFPPQQPYPQPQPFPSQQPYLQLQPFPQPQLPYLQPQPFRPQQPYPQPQPQYSQPQQPIXQQQQQQQSPQQQQFPQQQFPQQQQFPQTTNKYPNNQPIPGKQSPQTTAIFPTNKFPPTNNLPATTNPQPQPKYPQTTNQIPTTHNFPQQ

SEQ ID NO: 209337 - protein, 104 aa, Triticum aestivum
  unsure (1)..(104): unsure at all Xaa locations
  Clone ID: PAT_TA_103755.pep
RXIXXXXXXXLNXLXLXXHILXXQSXXXLDYRXFPLXXXAXXXLLXDNVILXIXVYDXXTLAXXSWXAYPXMIXXXNPRRKXXXIYPXFXMYIXXGFLIXAIXP

SEQ ID NO: 209338 - protein, 133 aa, Triticum aestivum
  unsure (1)..(133): unsure at all Xaa locations
  Clone ID: PAT_TA_103756.pep
NLELVDPPGCRNAAASSVTASSQSLASFPRRHPPRKGGCLAAAATAGAAPAASAATAAAGARCSPTWRPPPAPPPWSCPPPSTRGAPXXXSRRPXRPAAATXTPASAAPXCGCSXCXLXTEXAPXRPXRQAPR

SEQ ID NO: 209339 - protein, 188 aa, Triticum aestivum
  unsure (1)..(188): unsure at all Xaa locations
  Clone ID: PAT_TA_103757.pep
MKKFLVLALIVVAATTTAAEPFTAFRSAWEPQHPSSPEHQPTPQPQEHPVPHQKLNPCRDALLQQXSPXADMSFLRSQVVQHSSCLVMWEQCCQQLKAIPKQSRCEAIHNVVHAIILQQQQQLVQATSTQPQQQQQQGXQQQQGLXSSQPQQQTQLDQGWIXVIRDMXFRPXRAMCXVHVSPYXYTPY

SEQ ID NO: 209340 - protein, 214 aa, Triticum aestivum
  unsure (1)..(214): unsure at all Xaa locations
  Clone ID: PAT_TA_103758.pep
GRGWQPPXSQQQPILPQQPPFSQQQQLVLPQQPPFSQQQQPVLPPQQSPFPQQQQHQQLVQQQIPVVQPSILQQLNPCKLFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQXGQQPXQQQLAXGTFXLQPHQIAQLEXMTSIXLRILXPTMCX

SEQ ID NO: 209341 - protein, 214 aa, Triticum aestivum
  unsure (1)..(214): unsure at all Xaa locations
  Clone ID: PAT_TA_103759.pep
XPXQXQPQEQVPLVQQQQFLGQQQPFPPQQPYPQPQPFPSQQPYLQLQPFSQPQLPYSQPQPFRPQQPYPQPQPQYSQPQQPISQQQQQQQQQQQQQQQQQEQQILQQILQQQLTPCMDVEXQXHTIAXRGRSQVWHQSXNQLLXXWGCKXLWQIPEKLQCQAIHNVXHAIILHXHQXHXNTYXARVSXQKXLAPYPLGQGFFRPFKQNPKARA

SEQ ID NO: 209342 - protein, 200 aa, Triticum aestivum
  unsure (1)..(200): unsure at all Xaa locations
  Clone ID: PAT_TA_103760.pep
MKTFLILALLAIVATTATTAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQILQQILQQQLIPCRDVXLQQHNIAHASSQVLQQSSYQQLQQLCCQQLXQXPEQSRXQAIHNGGHAIILXHHXQQPPQ

SEQ ID NO: 209343 - protein, 195 aa, Triticum aestivum
  unsure (1)..(195): unsure at all Xaa locations
  Clone ID: PAT_TA_103761.pep
MKTLLILTILAMAITIGTANIQVDPSGQVQWLQQQLVPQLQQPLSQQPQQTFPQPQQTFPHQPQQQVPQPQQPQQPFLQPQQPFPQQPQQPFPQTQQPQQPFPQQPQQPFPQTQQPQQPFPQQPQQPFPQTQQPQQPFPQLQQPQQPFPXPQQQLPQPQQPXQSFPQQQRAFIQPSLQQQLNPCKNXLLQQCKPA

SEQ ID NO: 209344 - protein, 213 aa, Triticum aestivum
  unsure (1)..(213): unsure at all Xaa locations
  Clone ID: PAT_TA_103762.pep
PFRFSRXXSXSXXLPXATMHSXXSXAAILXNPHLTHLPRSSHXATEHHERRPTVSPFMPPPXPHLASTPLACDTGADLHQEPATPMPSPTPIPGAXGPLXRXLLASPXXTGATADCCQAPSRPSSSLLRPPCRHAAALPTSTYPSSRLXTRXLAXXLCIEQQQLRASGSIHPKSXATXPKNADXARILIXQXRAPCLLLAMDTLSNERTPXTE

SEQ ID NO: 209345 - protein, 159 aa, Triticum aestivum
  unsure (1)..(159): unsure at all Xaa locations
  Clone ID: PAT_TA_103763.pep
TLSSSPSSTHRAVESSQRQRSKYHFFYQTVLAMEIPGASSWRSIAMSLASLLKRFRGIPQSPKGCLYNPKSTGVGIVSAIMEPTAACQCIVGPHIHANAREILEVTLPNLCWSNKRPFRPAILPCXLCRCWVGSGTIYMFKVSNRMXKXALSLSIQENG

SEQ ID NO: 209346 - protein, 203 aa, Triticum aestivum
  unsure (1)..(203): unsure at all Xaa locations
  Clone ID: PAT_TA_103764.pep
MKTFLVFALLAVAATSAIAQMETRCIPGLERPWQQQPLPPQQTFPQQPLFSQQQQLFPQQPSFSQQQPPFWQQQPPFSQQQPILPQQPPFSQQQQLVLPQQPPFSQQQQPVLPPQQSPFPQQQQHQQLXQQQIPVVQPSILQQXLNPCKLFLQQQCSPVAMPQRXARXQMLXXXSCHXVCNNNCCQXFAGNPQXSXYGGNPGY

SEQ ID NO: 209347 - protein, 101 aa, Triticum aestivum
  Clone ID: PAT_TA_103765.pep
INRFITEETSFSLRELVSRGGPVPNSPYSESYYNSLAVVLQRRDWENPGVTQLNRLAAHPPFASWRNSEEARTDRPSQQLRSLNGEWQIVSVNILKFALNF

SEQ ID NO: 209348 - protein, 178 aa, Triticum aestivum
  unsure (1)..(178): unsure at all Xaa locations
  Clone ID: PAT_TA_103766.pep
MRECISIHIGQAGIQVGNACWELYCLEHGIQPDGQMPGDKTVGGGDDAFNTFFSETGAGKACPRAVFXVDLEPTXVIDEVRTGAYXQLFHPXQXSVAKEESSQHFARGIYTIXGKEMVESWAXPIKEXFKTIELXFKGFLDFNVXGRGNLXFGLGXSFFLXRFFVDFWKXSPLGSRGP

SEQ ID NO: 209349 - protein, 144 aa, Triticum aestivum
  unsure (1)..(144): unsure at all Xaa locations
  Clone ID: PAT_TA_103767.pep
ENVSXXNQSNEXQLXGSFQLSDVXPXHLFXXIXSXKQGXKRXKGXXXFGKGPXXGXNXXXXXHHXIHNAXXHXQVXXSCGXHXXGXXXNXQLXMVXQLLXVANKQPXGPXMXDGXRGFXMGXGXXSSAYCTVELLTHCYXVMLI

SEQ ID NO: 209350 - protein, 196 aa, Triticum aestivum
  unsure (1)..(196): unsure at all Xaa locations
  Clone ID: PAT_TA_103768.pep
MKTFLVFALLAVAATSAIAQMETRCIPGLERPWQQQPLPPQQTFPQQPLFSQQQQQLFPQQPSFSQQQPPFWQQQPPFSQQQPILPQQPPFSQQQQLVLPXQPPFSQXQQPVLPXQQSPFPQQQQHQQLVQQQIPXXQAIHFASKLNPCKLFLQQQCKPXVAMXQRLARSQMVASRASCHVMATNQWWASCRKIPK

SEQ ID NO: 209351 - protein, 150 aa, Triticum aestivum
  unsure (1)..(150): unsure at all Xaa locations
  Clone ID: PAT_TA_103769.pep
LRGSQRLVQARPSSRLALVCSVIAVSSAGASLQFAVAVARAIQFSHYGLTPPRCSKLHRIQHRPHLPPGRRDASPQESTPAALSSSVATPRSTALYNTRRDAFPHSLPWLLQRRRRRQEXGRARRYGGRQWIRRERERERERERERDWCR

SEQ ID NO: 209352 - protein, 178 aa, Triticum aestivum
  unsure (1)..(178): unsure at all Xaa locations
  Clone ID: PAT_TA_103770.pep
MXTFLXXALLAIVXTSAIAQMENSHIPGLERPXQXQPLPPQQTLSHHQQQQPIQQQPQPFSQXQPCSQQQQQPLSXQXQPPFSQQQPPFSXQQXQPLXXQQQPPFSQQQPPFSQQQXQLVLPQQQIPFXHPXILXQLNPCKVXXQQQCXPVAMPQSLARVANXLQQXXCHVMQPTMFA

SEQ ID NO: 209353 - protein, 175 aa, Triticum aestivum
  unsure (1)..(175): unsure at all Xaa locations
  Clone ID: PAT_TA_103771.pep
IRHQHQRVLTASQSLASFPRRHPPRKGGCLAAAATAGAAPAASAATAXAGARCSPTWRPPPAPXPWSCPPPSTRGAPAGSRRPGRPXAATAPPASAAPRAAAPAAAATEPXPRRPAGXGEHXDXEDKQASTITTSXPPPIVSPATCASMRAENKTTDRVSVCPCRVCSTSNLVFF

SEQ ID NO: 209354 - protein, 163 aa, Triticum aestivum
  Clone ID: PAT_TA_103772.pep
GIRHQAKVNEAAYKLELPSGSQVHPVFHVSQLRHCLRPGTNSSTTLPQLADIPAVPVAVLQHRWRKKNGAMIEQVLIRWSNQAVLGDTWEDKLALQARFPGAEAWGQASSQGGGDVSAPTPEPRLDADEPGPAGTDSLRLSAAQRPNRAKKPNERYTGPEWTQ

SEQ ID NO: 209355 - protein, 212 aa, Triticum aestivum
  unsure (1)..(212): unsure at all Xaa locations
  Clone ID: PAT_TA_103773.pep
GIRHXPXGGRXXXPXGXXQXGXXXAXTGRDXXXXXTXTXXXXXQFXXXRIKXFXKXXPXXXXXXXXXXQSTIXXXXFITXXXRILXXXXXNXXQXXNXXNTPXFXXSXXXXYHSXXNXQXXXRXXHXXDYXXCXXXXXIHKXLTPXPXXXIXXXXXXXPXXXXXXXXTXXXKRXIXXXSXNXXXPXKXPTKXKCTPXXNXKPYILXXNNXXS

SEQ ID NO: 209356 - protein, 213 aa, Triticum aestivum
  unsure (1)..(213): unsure at all Xaa locations
  Clone ID: PAT_TA_103774.pep
IRHEPQXTFPQPQXTFPHQPQQQVPQPQQPQQPFLQPQQPFPQQPQQPFPQTQQPQQPFPXQPQQPFPQTQQPQQPFPQQPQQPFPQTQQPQQPFPQLQQPQQPFPQPQQQLPQPQQPQQSFPQQQRPFIQPSLQQQLNPCKNILLQQCKPASLVSSLWSIIWPQSDCQVMRXQCCQQLAQIPKQLQXAAIHXVXHSIIHAAXRXQXQHNKGC

SEQ ID NO: 209357 - protein, 119 aa, Triticum aestivum
  unsure (1)..(119): unsure at all Xaa locations
  Clone ID: PAT_TA_103775.pep
NIXGXXXXXGFKKPRXGXXLEMXPXMFXXGXNFFXXXXXXKAASTPLVFXKHXXXTPXFFXNXXXPXXXSSKKXLLXXXXTXLNPVCDLXXEXXFYXTXXSPKCXRYXYVXSXTSXLCN

SEQ ID NO: 209358 - protein, 214 aa, Triticum aestivum
  unsure (1)..(214): unsure at all Xaa locations
  Clone ID: PAT_TA_103776.pep
AGFGTDYXSLRQPGQWQQPGQGQQPGQGQQGQQPGQGQQSGQGQQGYYPTSPQQSGQGQQLGQGQPGYYPTSPQQSGQGQQSGQGQQGYYPTSPQQSGQGQQPGQGQSGYFPTSRQQSGQGQQPGQGKQPGQGQQGYYPTSPQQSGQGQQLGQGQPGYYPTSPQQSGQGQQSGQGQQGYYPTSPQQSGQGQQPGQGQSGYFPTXRQQSXQGAAT

SEQ ID NO: 209359 - protein, 197 aa, Triticum aestivum
  unsure (1)..(197): unsure at all Xaa locations
  Clone ID: PAT_TA_103777.pep
VEGKGGEKGGGGXRKKXXXXKKXKKKXKXKINRKKKXKKKKXKXKXXIEKXXXXKKKKNKKKXEXXXXXGKKXQKKXXKKEXKKXKKXXXXXXGKELKKXKKKEXXKKKXXKNXXKKNXKXKXKKKXKKKXKKKXXKEXKKXNXKXKXXKKXXRNXDNXKSXYXRRRREXQNHKRKRPKLGHXNLPHLPSSTSRIPA

SEQ ID NO: 209360 - protein, 191 aa, Triticum aestivum
  unsure (1)..(191): unsure at all Xaa locations
  Clone ID: PAT_TA_103778.pep
SARAGLSGQLQKAFVTGVPALKRSELQAACEDFSNVIGCLSDYMMYKGTLSSGVEIAVISTTKKSGKEWSKHCEARFRKKITSLSRVNHKNFVNLLGYCQEEQPFTRMMVFEYAPNGTLFDHLHVREDGHLDWPTRLXVAVGIAYCLEHMHQLXPXXILKTLDTXTVYXTXXXXXXIADXXXXSIPTRAPF

SEQ ID NO: 209361 - protein, 180 aa, Triticum aestivum
  Clone ID: PAT_TA_103779.pep
EFTSFDEKNNAVTVSGPFDPDKLCRKLCCEAGRVIKEMHVNGKEQKADKDGGGGEKQKAPKDGGKAEKDGGKAEKPKDGGGKAEKPKDGGGKADKEKPKDAAAAKPEKKVKFDDAPPATDAKPGKAMPPLPPGMSMAPRPAPGEDEAPAFSTPRAASPLGLMMAPRAVAPSPPLTPSPPS

SEQ ID NO: 209362 - protein, 107 aa, Triticum aestivum
  unsure (1)..(107): unsure at all Xaa locations
  Clone ID: PAT_TA_103780.pep
RVQWVFVSCPXVGKATYAGRLSRLHGVPHINTGALLRKPPLQRAATISPTHRAPPPSAPAVGQPPAVERRHRLPSSHRDPPGSKNPSIQSSPRFLNRTYRPAYFRDG

SEQ ID NO: 209363 - protein, 154 aa, Triticum aestivum
  unsure (1)..(154): unsure at all Xaa locations
  Clone ID: PAT_TA_103781.pep
MAPKAAEKKPVAAAEKTPAGKKPKAEKRAPASKEAGGEGKTRGRKKGSKAKKGVETYKIYIFKVLKQVHPDIGISSKAMSIMNSFINDIFEKLAGESAKLARYNKKPTITXREIQTSVXLXLPGXLAKHAXXXGTKAVTKFTXSALFHELMAWY

SEQ ID NO: 209364 - protein, 181 aa, Triticum aestivum
  unsure (1)..(181): unsure at all Xaa locations
  Clone ID: PAT_TA_103782.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHAXLAFTLGVKQXICCXNKMDATTSKYXSKAXYEKIVKEXSLYLXK

SEQ ID NO: 209365 - protein, 121 aa, Triticum aestivum
  unsure (1)..(121): unsure at all Xaa locations
  Clone ID: PAT_TA_103783.pep
PGDSGLAPDPPLHAHPPPSPPXLPPPLWPPSSSPADTALGAPPAPSASTPTTSPRPTPLHRADRAPPSSSVTGASPTNCSPSSAPVPRRAFLLLHGEPLVKNSLPSRCFHARNNCFHYHRS

SEQ ID NO: 209366 - protein, 190 aa, Triticum aestivum
  unsure (1)..(190): unsure at all Xaa locations
  Clone ID: PAT_TA_103784.pep
EFGRLQPQQAFPQQPQQPFPQTQQPQQPFPQQPQQPFPQTQQPQQPFPQQPQQPFPQQPQQPFPQTQQPQQPFPQQPQQPFPQTQQPQQPFPQFQQPHQPFPQPQQQFPQPQQPQQSFPQQQRPFIQAISXQRLNPCKNILLQQCXPASLXSSLWXIIXPQXDCQVMPXQCXXELXTFXNXXRHPIHQLL

SEQ ID NO: 209367 - protein, 90 aa, Triticum aestivum
  unsure (1)..(90): unsure at all Xaa locations
  Clone ID: PAT_TA_103785.pep
FIGLVECKRTDRVCRIVEHEWPLWMEIADCCVHQALFRFRLQIVALKLIWLCQNLSDFDSIVRMVYSVLANFLRHHYVSSVKHXIWIKEA

SEQ ID NO: 209368 - protein, 205 aa, Triticum aestivum
  unsure (1)..(205): unsure at all Xaa locations
  Clone ID: PAT_TA_103786.pep
NSAPAFGXLFLDSPLGTGFSAAPSPALIPTNQTAVAAHILAALQSFFDASPPSFRRRPFFLSGESYAGKYVPAAGAHIFAANPTLPAGRRVNLRGVAIGNGLTHPVAQVATHADSAYFTGLINARQRGELEALQAEAVALTKAARWREASDARGRVLDWLQNATGLATLYDYAKQXAVRRRXAVGKFXQXRXEVKAXAWARAPGR

SEQ ID NO: 209369 - protein, 187 aa, Triticum aestivum
  unsure (1)..(187): unsure at all Xaa locations
  Clone ID: PAT_TA_103787.pep
MKTLLILTILAMATTIATANMQVDPSSRVQWPQEQPSPQSQQPFSQQPQQIFPQPQQTFPHQPQQAFPQPQQTFPHRPQQQFPQPQQPQQPFPQPQQPQLPFPQQPQQPFPQPQQPQQPFPQSQQPQQAFPQPQQQFPQPQQPQQSFPQQQQXMIQSFLQQQMNPCKNFLLQQCNPVXSLVSSLXSI

SEQ ID NO: 209370 - protein, 178 aa, Triticum aestivum
  unsure (1)..(178): unsure at all Xaa locations
  Clone ID: PAT_TA_103788.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGXTIRYPDPLXIKANDTIKLDLETNXIVDFHQVST

SEQ ID NO: 209371 - protein, 151 aa, Triticum aestivum
  unsure (1)..(151): unsure at all Xaa locations
  Clone ID: PAT_TA_103789.pep
MVRAGPSSLLYLLVVTALVGQYPTGSLRVATAQTVAAPVPVRVGVIMDWSTKASSAVSLRRRTGIQMAVEDYYAAHPESAARVELRFSDSKGEVVXAAXAALDLIKNDQVQAIIGPKTSAEAEFVAHLGSGAHVPRALLLCTFPVFPRKTP

SEQ ID NO: 209372 - protein, 163 aa, Triticum aestivum
  unsure (1)..(163): unsure at all Xaa locations
  Clone ID: PAT_TA_103790.pep
RDPLXLMPGKVWASSXSTXKDMLVKRIGXPLLDDNIMGIXNAKAIEDRAHLFFEXNFNFXGLXILAKLNWXTXXXRFHGXXXXQTXGKXFGHPIXFLXXSFPXCLGKFGIXRXWKKPXXGXXGYLFNMGXXNLAQXSFXGXXFKXKXFXWXKNPXXKKXFXKX

SEQ ID NO: 209373 - protein, 153 aa, Triticum aestivum
  unsure (1)..(153): unsure at all Xaa locations
  Clone ID: PAT_TA_103791.pep
EPGKQVRSAVXIKNIXKXHVAXKFQTTAPKSCFMRPPGGILAPXETIIATVFKFVXHPENNEKPLDQXCKXKFKIVSLKVKGLEGGPGTQFAYSESYYNSLAVVLQRDWENPAVTQLNRFAAHPPFAAGVIAKRPAPIGLPTVAPEWRMANCK

SEQ ID NO: 209374 - protein, 325 aa, Triticum aestivum
  unsure (1)..(325): unsure at all Xaa locations
  Clone ID: PAT_TA_103792.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLXLVLRLRGGMQIFVKTXTGKTITLEVESSDTIDNVKAKIQDKEGISPDQQRLIFAGKQLEDGRTLXDYNIQKESTLXFVLRLXGGMQXFXEKPLPGRTITXGGXKLPKXXXNXKGQNPGQRXAXSPDQXXXEXLLXNXXEGWAEPXXXYNFXKGPPTLGLGGPKEKPGTLGKNAPGGPPKFL

SEQ ID NO: 209375 - protein, 247 aa, Triticum aestivum
  unsure (1)..(247): unsure at all Xaa locations
  Clone ID: PAT_TA_103793.pep
XAXTXLXLTLXXSXXLYIAMXMPXXSAGXLILXXYXHIXIXPQSTXTXMXFXILSEXLXLSLCXXXXXVLXFXFAHSLSXFFDFFXXFLXFVXXNFAHXXXXLSXXXXXXXXXXXLXLXXXXXPXXLFXXXXXXXXXHFXXFXXXXXXFXFXXXXXLXFXXXXXXXXXXXXFXXXXXFXXXXXXXXXXXXXXXXFXXFXXPXXXFXXXXXXFXXXXXXXXXXXLXXXXXXXFXXXXXXXXXXXXXXP

SEQ ID NO: 209376 - protein, 80 aa, Triticum aestivum
  Clone ID: PAT_TA_103794.pep
MSGSSSRGGDDAAWSAKENKLFEEALAYHGEGTPDRWLKVSRAMGGTKTADEVRRHYEILVDDINLIESGRVPFPKYKDN

SEQ ID NO: 209377 - protein, 157 aa, Triticum aestivum
  unsure (1)..(157): unsure at all Xaa locations
  Clone ID: PAT_TA_103795.pep
XSIXTFXIXNSXNXPXXIXXXXTXXXIXFXXSXIXXXTXXXXNLTLLXXXXFYRXYLHXIXYNXHXLXXXXPXXXYXXXXXXXSXXXSYXXXXXPYXXXSXHXXSHTXHLXXXXIYYXSSXXINTXHNIXLTIXLYXKXLXIXYTXXXYXXXXXXHX

SEQ ID NO: 209378 - protein, 298 aa, Triticum aestivum
  unsure (1)..(298): unsure at all Xaa locations
  Clone ID: PAT_TA_103796.pep
XXXXXXFFXXXGXFXXXXXXXXXXXXXXGXXXXXXXXXXXXXXXXXXXXXXXXXSXXXXXFXXXXXKXPXXXKXXXXXXXXXPFXXXXXXRGXXQXIXXPKXXXXXXXNXPXXLGXNXXPSXRRSTXPWXPXFPXVXPRIXFFXXRXXXVAXEALSSXXXLXTAXXXAXGSXASCRPCXXRRRRXPAXGRVRAXXXXRVPVEXVXLHPPXRRRYYLXVPPRVSVXEPXPERHCLSAALSAVVRLXLAXLAPSTRASGTSRRRALPRRRSPIPRRNPSCGFPRRRARVGARTRRPRPPR

SEQ ID NO: 209379 - protein, 191 aa, Triticum aestivum
  Clone ID: PAT_TA_103797.pep
TRFDFLVKRLPGTPSARLCDLQPGDLVPVGGSVVGRGFEVTRIADARDVLVFATGSGISPIRSLIESGFGENEKIDVSLFYGVRNLQRMAYQERFSDWESRGIKIIPVLSRPDEQWTGQRGYVQNAFSRAKKVINPSSTGAILCGHKQMTEEITRALVADGMPKDQILTNFLSSTPFLPFLAVHLLYHPQI

SEQ ID NO: 209380 - protein, 133 aa, Triticum aestivum
  unsure (1)..(133): unsure at all Xaa locations
  Clone ID: PAT_TA_103798.pep
XXXKXKKXGXKXPGGXNXKIAXXAPXGXXGQRXPXXKXXGVTXXXXSYRGPPENLXXNLXXGXPXXGXXEXXXTPTPXFPXXXHXFXQSNKGFXGXXFFXTEGPXXLXKXXPFXXXGRLRVXCXFXXXXIXXG

SEQ ID NO: 209381 - protein, 261 aa, Triticum aestivum
  unsure (1)..(261): unsure at all Xaa locations
  Clone ID: PAT_TA_103799.pep
MNSAPDLSQEAQYKSTMXTFLILALLAIVATTATIAVRVPVPQLQPQNPSQQQPQEQVPLVQQQQFPGQQQPFPPQQPYPQPQPFPSQQPYLQLQPFPQPQLPYPQPQLPYPQPQLPYPQPQPFRPQQPYPQSQPQYSQPQQPISQQQQQQQQQQQKQQQQQQQQQILQQILQQQLIPCRDVVLQQHSIAYGSSQVLQQSTYQLVQQLCCQXQLWQIPEQSRCQAIHNVXVHAIILDQQQQPTTTTTTKKQPLSQVFXQQA

SEQ ID NO: 209382 - protein, 213 aa, Triticum aestivum
  unsure (1)..(213): unsure at all Xaa locations
  Clone ID: PAT_TA_103800.pep
XLGXXPXGGAXXLASGGXSXXPPXXGXFFXXXXXLSGXXAPXXGXVSGGSRGXXAALXWXXXXXRLXGXVVXXLXXAXWLVXGVXXFLXAWXRSWXLXCGWXXSLLRRXXXRXXPXPRCAXXXGPCVFXXLLASXVAXXVXXRXXXRRAAXRGXXRAXPPWGGXSGXRXXPLXXXVGXVVPLXXXGLXCXLXXWWGXGGRPXXXXXPPXLVPX

SEQ ID NO: 209383 - protein, 169 aa, Triticum aestivum
  unsure (1)..(169): unsure at all Xaa locations
  Clone ID: PAT_TA_103801.pep
AXISKXXGXLXXDCKXVHXXVCXASVXXTQTXXCXLHXXXVLSQFXAXXXNXRXXHVXFEXLVPTHXKPLXLTKSDXXSIKXXPPXSIXXXILXXXXXXXFXXESXPXXXYXXXHCFXXKLCXHITTXSXDXXPSRIMXPXKLISXXARFFQXXLLXXIXXHVSFLINF

SEQ ID NO: 209384 - protein, 176 aa, Triticum aestivum
  unsure (1)..(176): unsure at all Xaa locations
  Clone ID: PAT_TA_103802.pep
LLMVCXXSXLLADEXTLTTEXPNXDXXGXXXXXXXAXLXXEXPXXXXXXXGXGCXSXXLXFXDNRXFXXXNXXXXXXNKXGXXNXSKXDXWXPTYXXXXXLXMGXGMXPXXTXXGKKXTXYXXVQPLXXXXXRXLXXXXFXXPXXXXXCHLIXTNXGXTXFIIXKTXQLLXXXXXY

SEQ ID NO: 209385 - protein, 248 aa, Triticum aestivum
  unsure (1)..(248): unsure at all Xaa locations
  Clone ID: PAT_TA_103803.pep
WIPRAAGIRHEVESSDTSDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDXRXXADYNIQKESTLHLXLRLKGXMQIFXKTLXTXKXIXXEGGGTQFAL

SEQ ID NO: 209386 - protein, 148 aa, Triticum aestivum
  unsure (1)..(148): unsure at all Xaa locations
  Clone ID: PAT_TA_103804.pep
MSWQTYVDDHLCCEIDGQXLTSAXILXHDGSXWXXSXNXXQXKPDXXAGIIKDXEEXGHXAPTGLXXXRHKXMFIQXXPVXDILFKEXHRXEXLSINXXLXSDXGXYDEXXXSXQWIFLFFFFPLFKWVFPSFIQWIFIPFPFVLLFP

SEQ ID NO: 209387 - protein, 177 aa, Triticum aestivum
  unsure (1)..(177): unsure at all Xaa locations
  Clone ID: PAT_TA_103805.pep
FPXIXXXEGXTCVLXXEXGXXXXXXXAPXXCAIXXXXXMFXXIXXDXXXXMXXXRGFQXXXAXIXSXXPXVVAXPXFXXXXXAXXXGVLRSXLXXSSSLXSXGAXRXXXXXPXXXPXXXXRXNXXVLXGXVAXTFXXXKNXXRXPKXLAARGDPTSSRPXXPXVELQLLFPFSKGXX

SEQ ID NO: 209388 - protein, 162 aa, Triticum aestivum
  unsure (1)..(162): unsure at all Xaa locations
  Clone ID: PAT_TA_103806.pep
IAPMHSKHSTNNYALGLKDNHADSKNAKAYLIRLTSKKQNGYQVLNIMHVYSQTHVLNLFTLPVKHTVGLRRRSTLPSALQQHRCLLYCSSPRASAQTAPRPSSTIHASRAPSTPSKPRAYSSSAGADRASLPRPPDPPPQNQTSAAPTTGHCRGXXHEAAS

SEQ ID NO: 209389 - protein, 212 aa, Triticum aestivum
  unsure (1)..(212): unsure at all Xaa locations
  Clone ID: PAT_TA_103807.pep
GLQESAPAQPQLPYSQPQPFRPQQPYPQPQPQYSQPQQPISQQQQQQQQQQQQQQQQQEQQILQQILQQQLIPCMDVVLQQHNLAHGRSQVLQQSTYQLLQELCCQHLWQIPEQSQCQAXHNXXHAIILHXQQKQQQQLXSQXFFQQXXXQYSFGQXFFXAXSXTXKXKXFVQTXKXXXIXXIRGLXLXXLSGMXCXGYIXXYWALXPXGXF

SEQ ID NO: 209390 - protein, 149 aa, Triticum aestivum
  Clone ID: PAT_TA_103808.pep
REQKLELHRGGGRSRTSGSPGLQEFGTRFLLEGIRKDTRQMIEEQEAVRGRLFTIQDVMQSTVRAWLQKPVSDEQVQVRKLELQQLVSMFQHEAETHAKVREGVLRSDLPPRAADLIYDNVRKLGRYFSFEAKCEPALQGYHLVSLCTL

SEQ ID NO: 209391 - protein, 158 aa, Triticum aestivum
  unsure (1)..(158): unsure at all Xaa locations
  Clone ID: PAT_TA_103809.pep
WIPRAAGIRHEPQXPQQPFPQQPQQQFPQPQQPQQPFPQQPQQQFPQPQQPQQPFPQPQQPQLPFPXQPQQPFPSXQPQQPFSQVQEPQQPLXXAQKPEQPFPXEQXXXXXXXLPQXVNPXKDXLLXQXXPXXMGAFLGXMXLAXXXXRXXXTVATNS

SEQ ID NO: 209392 - protein, 163 aa, Triticum aestivum
  unsure (1)..(163): unsure at all Xaa locations
  Clone ID: PAT_TA_103810.pep
MRECISIHIGQAGIQVGNACXELYCXEHXIQPDGQTFXDKTXGGGDDAFNTFFSETGAGKXXPRAXFXDLEPTVXXXXXTXGXPGSFFNPXXFIKXKGGPXXKNFXRGKIWEIVFLGWHFKNPKFGFFFLKIFFPFLFLSCFFFFSFFKKFKILLKFFFLIWY

SEQ ID NO: 209393 - protein, 182 aa, Triticum aestivum
  unsure (1)..(182): unsure at all Xaa locations
  Clone ID: PAT_TA_103811.pep
QALLHLMCXGKLTPTTESTLLVDMLMAADKFEVVSCMKLCSQGLIDLPMTLESAVRCLDLPCTIPLAAAIKEAAKTFFAETYKEFLSTKFQDELMRVPLAGIRAILSRNHLGIVSEGAVYEFMLRWACSQYSNSEERHKILSSRLLPLVPRVLSMNDSILIDHPSGIINFTIKREKCYGLFR

SEQ ID NO: 209394 - protein, 136 aa, Triticum aestivum
  unsure (1)..(136): unsure at all Xaa locations
  Clone ID: PAT_TA_103812.pep
XXXFIXXKXXXXTXXXQXXRXXXSKXWEXXKNGXXXVXXLTXXXFFXXXXXVXEXRFVKSXWXVXGYXRPKXRHXXGAXVENXPXIXIECSGCVSSXVXQERQXMLXSNSRXXSNAHSPWWRHRTAGRRPQXRRCT

SEQ ID NO: 209395 - protein, 191 aa, Triticum aestivum
  unsure (1)..(191): unsure at all Xaa locations
  Clone ID: PAT_TA_103813.pep
MKTFLILALLAIVATTATIAVRVPVPQLQPQNPSQQQPQEQVPLVQQQQFPGQQQPFPPQQPYPQPQPFPSQQPYLQLQPFPQPQLPYPQPQLPYPQPQLPYPQPQPFRPQQPYPQSQPQYSQPQQPIXQQQQQQQHQQQKXQXQQQXQQXLXQILXQQLISCRDVVLQQHKHYGLTKFLQQKLPLANLFK

SEQ ID NO: 209396 - protein, 168 aa, Triticum aestivum
  unsure (1)..(168): unsure at all Xaa locations
  Clone ID: PAT_TA_103814.pep
MQIFVKTLTGKTITLEVESSDTIDNVKAKIQDKEGIPPDQQRLIFAGKQLEDGRTLADYNIQKESTLHLVLRLRGGMXXFVKTXTGKTITLEVESXXTIDNVKAXIQDKEGIPPDQXXLXFXGKXQLXDCSSXGLXXXXRESXLXFXGLSXXXXXXXFFXXXXXXXYH

SEQ ID NO: 209397 - protein, 140 aa, Triticum aestivum
  unsure (1)..(140): unsure at all Xaa locations
  Clone ID: PAT_TA_103815.pep
RTGLTKGXVXCVVTDVVWFSAQAAARDXGVPALALMXSSAASFRTFMAYPALLAKGHLPYDESRADAPVEELPPFRVRDLQRIDASSLDTFAGLLERFVDAARRSSGLIVNTFDAIEGPEVGDIRDGLSLPVFPVGPLNR

SEQ ID NO: 209398 - protein, 110 aa, Triticum aestivum
  unsure (1)..(110): unsure at all Xaa locations
  Clone ID: PAT_TA_103816.pep
MAGATMALSSPAMAGTPVKASRAAPFGEGXITMRKTAGKPKVAXSSSPWYGSDRVLYLXGPLSGDPXSYLTXXXSXGXYGWDTEGLXAXXQTFXXNXXXERLGHAGISPC

SEQ ID NO: 209399 - protein, 113 aa, Triticum aestivum
  unsure (1)..(113): unsure at all Xaa locations
  Clone ID: PAT_TA_103817.pep
MGKEKTHINIVVIGHVDSGKSTTTGHLIYKLGGIDKRVIERFEKEAAEMNKRSFKYAWVLXTXLKAXVRKGXTIEXLPXWXKFXXTKYFXPXXXXPXXRXXNKNMXXVXSXXX

SEQ ID NO: 209400 - protein, 117 aa, Triticum aestivum
  unsure (1)..(117): unsure at all Xaa locations
  Clone ID: PAT_TA_103818.pep
GGSPDRPACELLQKDFVDPAMGSPVLVAGGEAVVPAVAEAVAVARERGIFVVWVVREHDPSGRDVELFRRHLXSGGKGPTVKGXKGAXLADGLFIKEXDYXVGERQEFNAFFCAPLI

SEQ ID NO: 209401 - protein, 121 aa, Triticum aestivum
  unsure (1)..(121): unsure at all Xaa locations
  Clone ID: PAT_TA_103819.pep
ASASLAVLNAVGLHGXAADVLAEVVDELPSWVPTADRALLEGSRAGAVQADVVVAKDGSGKYKTVKXAVDAAPDRGKXRYVIYVKKGVYKENLEVGKXKRQLMIVXGDGIDXTMITGSPNV

SEQ ID NO: 209402 - protein, 194 aa, Triticum aestivum
  unsure (1)..(194): unsure at all Xaa locations
  Clone ID: PAT_TA_103820.pep
IPHQRESRPPPARDGHGAHRGIHPRPLXHPKTLPPHRRGGSSSVAFXXAAPPRMRPISLGRPRRAVAAXVAXPAKVGAXMPSLDXXTAVXNKEKVXXXRHEEYILRXGRNLFRLFXRLXXRKQIGXXGWXSKVRAGQKLXDSLXEAXSDIVXXNGLRKXGSKFFKEDVGAXLTEEXGTFGXILENGFCXDLFLX

SEQ ID NO: 209403 - protein, 171 aa, Triticum aestivum
  unsure (1)..(171): unsure at all Xaa locations
  Clone ID: PAT_TA_103821.pep
FGTKLXWGFXAGLVXXSAATGTSVPPPXPMLPSRRRRNLRGXGARSSCSSLRDEHLTDVXRGTGAEDPAXFARPRXTPTXGWTRRXXPAPXXPSXXQTPRRLXXWAFXYTATSXAPXPGTXATXTSSVSYGRGPRTGVXPGFXFXVGTLPTXXSAKSXVQPSTTWPXXXAF

SEQ ID NO: 209404 - protein, 171 aa, Triticum aestivum
  unsure (1)..(171): unsure at all Xaa locations
  Clone ID: PAT_TA_103822.pep
RERERTERYRXXXRALATIRQKSVFTDVRVEAQYRHIEVFDMGLPEEPLQITRCTKPKGDHYNPFVMDGGKYIGYHRCKSDHLEHGDDVPRRFDKLQSHHEXIGLFRVAGAFPAFSKXGSKLAFXDNEFKTVWLAXSDRMRVVXXXDXLMASXHPGWNPKKDIFFFLEPSF

SEQ ID NO: 209405 - protein, 156 aa, Triticum aestivum
  unsure (1)..(156): unsure at all Xaa locations
  Clone ID: PAT_TA_103823.pep
PAIPHRAVRPVAEEESEDSPAAAASGEEEDTGAQVAPIVRXEEVAVTTGEEDEDSXXYMKAKLYRFXKDGNQWKERGTGTVKLXKHKENGKVPFLXPAXTLXICANTXXLXHQXXEHXRSDXFFXLHXANFFYRELKDXMFPFRFGXVENCKKFKT

SEQ ID NO: 209406 - protein, 99 aa, Triticum aestivum
  unsure (1)..(99): unsure at all Xaa locations
  Clone ID: PAT_TA_103824.pep
AHPLPLVGRSPXXAXXXVMTIPLXPKNTRTLFSHATITXRXXLVIAKNKXLGVHNGXGGLFFXXGXLKPHEWVXFFKXFXPXXKQIXPFXXXLXKXLQX

SEQ ID NO: 209407 - protein, 55 aa, Triticum aestivum
  Clone ID: PAT_TA_103825.pep
NKGIIRWVLNCLWVWHFARVQLYVFSTGHLDTVWSQCDVFIFKADVDKLLWQFFG

SEQ ID NO: 209408 - protein, 117 aa, Triticum aestivum
  unsure (1)..(117): unsure at all Xaa locations
  Clone ID: PAT_TA_103826.pep
FKGNLIPRHGGFPXAAGAXCPNHPFXTXRRSHXDXAFYRTLSXSFPLASPPPXQXAARRPWKSSPXXEPYLXRVPQGCXVPXXYPSLTGXXLMRXRDCGKDFFYLXTLTXXVDATTR

SEQ ID NO: 209409 - protein, 149 aa, Triticum aestivum
  unsure (1)..(149): unsure at all Xaa locations
  Clone ID: PAT_TA_103827.pep
MDSVASWGLTPLADADPDVFDLIEREKRRQRSGIELIASENFTSFAVIEALGSALTNKYSEGMPGARYYGXNDVIDEIENLCRDXALXASXDAALGRNVQPTPVRNLDTRALNRRRIWGTSGTSPRVYTAGARLATSLELTKAHGNYKS

SEQ ID NO: 209410 - protein, 211 aa, Triticum aestivum
  unsure (1)..(211): unsure at all Xaa locations
  Clone ID: PAT_TA_103828.pep
RNSAXGXXVPQXQQPLSQQPQQTFSQPQQTFPHQPQQQVPQPXQPQQPFXQPQQPXPQQPQQPXPQTXQPQQPFSQQPQQPFSQTXQPQQPFSQQPQQPFPQTXQPQQPFSQLQXPQQPFXQPQQQLPXAQQPXQLFSHNNXXXFXPXXQQQVXPCRISLGQCKLXNGXFLWXXIWAKXNARDAGQXWQQIXXIGQASWGVFFGGGGQQHN

SEQ ID NO: 209411 - protein, 171 aa, Triticum aestivum
  unsure (1)..(171): unsure at all Xaa locations
  Clone ID: PAT_TA_103829.pep
EFTGRAKHSTMMILYNLHDSACSACHRAMDQRFAWRCLVCTGCKFCDSCYKQDGENLHIHKLKQTXNQQQLPNYTLQDYLESLVHASKCFHDPHNCSFKLCVTMXKLFYHGVRCXIRNQGXCRNCVFMWRLXLTXSKXCDHQDXXIPDQRSKSIWQPNAFCTARCYRKNNP

SEQ ID NO: 209412 - protein, 185 aa, Triticum aestivum
  unsure (1)..(185): unsure at all Xaa locations
  Clone ID: PAT_TA_103830.pep
MKTFLILALLAIVATTATTAVRVPVPQLQLQNPSQQQPQEQVPLVQEQQFPGQQQPFPPQQPYPQPQPFXSQQPYLQLQPFXQXQLPYXQPQPFXPQQPYSQXQPQYXQPQQPIXQQQEQQXXQQQQPQPIXNKICTTLIHAGCCXXNQHTHGTXKVFKKSYHWXTNVLSXLWKSPTRGQASQWW

SEQ ID NO: 209413 - protein, 207 aa, Triticum aestivum
  unsure (1)..(207): unsure at all Xaa locations
  Clone ID: PAT_TA_103831.pep
GIXHQKXXXPXXCXFSFSPSXLAXPEAASGXAHFLALIQAFPQSPRLLPIVWSLQESPNMFLLLPPPCSDPPPIPALDPVALXXFXXAAAFRGGWVLCQERILAAWFLXDLEXNFXGXFAXVWNKVXFFAGQEXGMNXLVLESREXXLRPPLXPFLGGXXXGEFXPKXXXXGXLSPFFIPGLHXSXLXKGLSNSRAQSXXRGPCXXX

SEQ ID NO: 209414 - protein, 198 aa, Triticum aestivum
  unsure (1)..(198): unsure at all Xaa locations
  Clone ID: PAT_TA_103832.pep
FGTRXXXSFWSTNNNVSAQAAFVYPVPEGSYSVNISCEGFQSVDHIGGNEDGYWIGLIAYSNSSGDNWGVGNYKGCSFKNFLATNTWRPGHKDLKLNDCQXFTDGQIVERDAVMSFXVEATGXDACFYLMGPXTMKTDKXTMFVXYXGXTNKXMXFGXISVTXXESXVEAERIQGPNFHPFQDIFVPAVEPWPHNSRG

SEQ ID NO: 209415 - protein, 216 aa, Triticum aestivum
  unsure (1)..(216): unsure at all Xaa locations
  Clone ID: PAT_TA_103833.pep
GCKXSARXGVRKADTXHXKQTNQKNTASQVHSSQEKSPFQKQAGQKYVANYSQSPQSHGSTVNHIQTNQQRTANQNQSESSQADTANVLRATKEFFVNHSLLRQAGVNNMQSNQENTAIRLQLGQADTXKQMQTVQGNSTDRSQLVQXLPVNQTQTIQESLLSTXKPSPXNLVXQMQIXEGNTGXQLXXNQLAFXTRTNFAGESXSRSQLXXVNCQ

SEQ ID NO: 209416 - protein, 175 aa, Triticum aestivum
  unsure (1)..(175): unsure at all Xaa locations
  Clone ID: PAT_TA_103834.pep
GTIRPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQXQCAAIHSVVHFIXMQQEQRQXVQIRRXLVQLVQGXXIIQPXQPAXLEXIKALVFRTFXTMCNVYV

SEQ ID NO: 209417 - protein, 216 aa, Triticum aestivum
  unsure (1)..(216): unsure at all Xaa locations
  Clone ID: PAT_TA_103835.pep
GTXLGXXXLPRLVXSXXAALGKFYPXLGRVRPCPDSGGYEFFLPXGGGGGGDTVELTVAESEDDFXEAXRRRSPGRRPALLARAAASVVEGSGDXGFALAAVQVTVFAGRGVAXGVSSPRRCDDXSYMHXVKNWAGTAXWLSVGRKXGPRCRPAVLDRAXXADPXGLXQEPLTNAGVXAXGFFLTPGPXGXRPTGIRCYLXPGDXXIKXRGRHPRR

SEQ ID NO: 209418 - protein, 157 aa, Triticum aestivum
  unsure (1)..(157): unsure at all Xaa locations
  Clone ID: PAT_TA_103836.pep
MADHHRXRGVLSXXXAXGDRSGHGGYXXDHHEQHQQKQPXLMCAXKGATXGTGAGSMLLVFRLILXXTXVIWXNVGTSVLVXLXPCLCPXAFRLXXFSAAFLXSXGXGVGXXFLXXWVSKTLTXKNXPXANKLNTPKGXFGSKAXKIKKXGXNPINK

SEQ ID NO: 209419 - protein, 216 aa, Triticum aestivum
  unsure (1)..(216): unsure at all Xaa locations
  Clone ID: PAT_TA_103837.pep
QQPXPXXPQQPXPQTQQPQQPFXQXPQQPXXQTQQXQQPFXQLQQPQQPFPQPQQQLPQPQQPQQSFXQQQRSFIQPSLQQQLNPCKNILLQQCKPASLVSSXWSIIWPQXDCQVMRQQCCQQLAQIFNKXLCAXIHXXVHSXIXQXXEQPQXQXGMHIFXXLFXXEQVGSXFXXQXQXIIKXQQXXXLXXXXSLGLQXLXXMXXXFVXTKXXLRR

SEQ ID NO: 209420 - protein, 183 aa, Triticum aestivum
  unsure (1)..(183): unsure at all Xaa locations
  Clone ID: PAT_TA_103838.pep
VCPSFQVIRYILTTNGTQSSAARSDLEQILVDETAEPTALPLSLLKDITGDFSDDQEIGHGGFAVVYKGIFGDKVIAVKKLSNAYMHETEFDREIECLMRAKHKNVVRFLGYCDDTQRSRERFDGKHVMAEIHQRLLCFEYVPKEGLDKYINXAYXEWGTCYKIIKGICEGLXTFRYHIITWI

SEQ ID NO: 209421 - protein, 191 aa, Triticum aestivum
  unsure (1)..(191): unsure at all Xaa locations
  Clone ID: PAT_TA_103839.pep
MAAATMALSSPAMAGTPVKASRAAPFGEGRITMRKTAGKPKVAASSSPWYGSDRVLYLGPLSGDPPSYLTGEFPGDYGWDTAGLSADPETFAKNRELEVIHCRWAMLGALGCVFPELLARNGVKFGEAVWFKAGFQIFSEGGXDYLGNPSLVHAXSIXXIWALXVVLMGAVXGYXXXGGXLGENLEPVYPA

SEQ ID NO: 209422 - protein, 103 aa, Triticum aestivum
  Clone ID: PAT_TA_103840.pep
MAAATEVYSPTPAEQHREQAAWRAVVGWLGLLLQVLLQVIRGAPSSLAKLLRSLGLRHPLLSAAPAVTFVQLPSKAPADDLPPLSPPPGRLTVRTHVLPRERI

SEQ ID NO: 209423 - protein, 214 aa, Triticum aestivum
  unsure (1)..(214): unsure at all Xaa locations
  Clone ID: PAT_TA_103841.pep
VXFHRNATIGPCXCAXXXXHKVPKSGXWAQSLSPYDNRILDFRMPADPSRSVVVSTEEEFLLHRVVFLVLGMVLMALAHTLSQSLVFYYGGAMTIGIFLVVLIILFQGMKLLPTGRKSSLAIFAYSSVVGMTTYFLHYLSGLLRSILVEMGIAEDMHNPVSXIFLLVCVILAGAXFGFWGVRKLGLTEKXSVDAGXAYFVXWAIFDWFLLLNLQ

SEQ ID NO: 209424 - protein, 211 aa, Triticum aestivum
  unsure (1)..(211): unsure at all Xaa locations
  Clone ID: PAT_TA_103842.pep
MAVXXEVKLSISGAALAALLHRCGAAVGDCDGLLFGRAHRPPPPAPTLSDYDDQTPAAPCLFISISGHSSLSNPCSLSDPLXXPNPPPXSSPXPLGFFSSRXXAPXRPXMRELALACSLSKTLSPIXHPLXFXLVFPSAXDDLFTHSFDYXAFLLVGSXFVPNXLTVVNVGPRFRDKXHFXAXSXLPLXKXKPRRAPTKQSYNIGKKKPEC

SEQ ID NO: 209425 - protein, 207 aa, Triticum aestivum
  unsure (1)..(207): unsure at all Xaa locations
  Clone ID: PAT_TA_103843.pep
GLINKSXXXFLIFALLAIAXTSAIAQMETSRVPGLEKPWQQQPLPPQQQPPCSQQQQPFPQQQQPIIILQQSPFSQQQQPVLPQQQPVIILQQPPFSQQQQPVLPQQPPFSQQQQQQQQQQPPFXQQQQPVLPQQPPFXQQQQPPFSQQQQPFSQQPPFSTNNTNSFPQQQXPVVQTIFALKPHAKGGFLSNPLTHPIPQTLLFLGV

SEQ ID NO: 209426 - protein, 207 aa, Triticum aestivum
  unsure (1)..(207): unsure at all Xaa locations
  Clone ID: PAT_TA_103844.pep
MKTFLVFALLAVAATSAIAQMETRCIPGLERPWQQQPLPPQQTFPQQPLFSQQQQQQLFPQQPSFSQQQPPFWQQQPPFSQQQPILPQQPPFSQQQQLVLPQQPPFSQQQQPVLPPQQSPFPQQQQQHQQLVQQQIPVVQPSILQQLNPCKXFLQQQCSPVAMPQRLARSQMLXXXXCHVMQQQCXQQLPQNPXQFRYEXIPGYHLL

SEQ ID NO: 209427 - protein, 209 aa, Triticum aestivum
  unsure (1)..(209): unsure at all Xaa locations
  Clone ID: PAT_TA_103845.pep
QSVKTFLIFALLAIAATSAIAQMETSRVPGLEKPWQQQPLPPQQQPPCSQQQQPFPQQQQPIIILQQSPFSQQQQPVLPQQQPVIILQQPPFSQQQQPVLPQQPPFSQQQQPPFSQQQQPSSQQPPFPQQHQQFPQQQIPVVQPSVLQQLNPCKXVLQQQXCNHVAMSQRLCXSQMWQQSNXHVMQQQCXXQVGGKPKQIPLLRPGPSA

SEQ ID NO: 209428 - protein, 126 aa, Triticum aestivum
  unsure (1)..(126): unsure at all Xaa locations
  Clone ID: PAT_TA_103846.pep
KXVGYNPEKVPFVPISGFEGDNMIERSTNLDWYKGPTLLEALDQINEPKRPSDKPLRLPLQDVYKIGGIGTVPVGRVETGVIXPGMXVTFGPTGLTTEVKSLEXHHEVLXEALSCDNVGFNVKTFF

SEQ ID NO: 209429 - protein, 186 aa, Triticum aestivum
  unsure (1)..(186): unsure at all Xaa locations
  Clone ID: PAT_TA_103847.pep
MXTFLVFALLALAAASAVAQISQQQQAPPFSQQQQPPFXQQQQPPFSQQQQQPXLHSKQQQQQQQQPFHXNXNPVXXXAXXFKXEKXXXFXRXKKXQFFXGEQKNQFFFPFFFLANFKPRGGFFPKKRPFLFWGKKKKKNFFFFWGKIFKKKIPLGCPTNFFHPNFGKNSPRKKIPPPIEKKNRGK

SEQ ID NO: 209430 - protein, 165 aa, Triticum aestivum
  unsure (1)..(165): unsure at all Xaa locations
  Clone ID: PAT_TA_103848.pep
AYSCVGVWHHDRVEIIANDQGNRTTPSYVAFTDSERLIGDAAKNQVAMNPXNTVXDAXRLIGRKFAXAPXQXDIKKWXXKGFFLPPXKTXXLLRNXGRTTFNKKFFWPKKSGKTGVFKMFVFTRFFILNVPKRPTKRPRFFWGFLKRGKFPIYKKGLPKKKFFFF

SEQ ID NO: 209431 - protein, 178 aa, Triticum aestivum
  unsure (1)..(178): unsure at all Xaa locations
  Clone ID: PAT_TA_103849.pep
MKQRRLRYGRLFRTHILGCPTVVCMDPELNRRMLLQGEAGGLVPGYPQSMLDILGRNNIAAVHGQLHRVMRGAMVGLVRPAALRQSXXPKIDAXMRDHLCGWAGTVVDVXAKTKEMALLSALKQDRRXXGPXHFFDAXKTELYTLXVXXPXSLPLXLPXGTNFYQRXFPRKTSVPFKK

SEQ ID NO: 209432 - protein, 108 aa, Triticum aestivum
  unsure (1)..(108): unsure at all Xaa locations
  Clone ID: PAT_TA_103850.pep
AAWIFFVLSTNSVDYPSPPGSASSMSLAPSSXQNSEAEYEILDVGLHIDELGKHYNXWTMTQFLNQENSFLKKYPFXXKAPKLXNHFANEIIFSLSNYSQCAQGXFTL

SEQ ID NO: 209433 - protein, 122 aa, Triticum aestivum
  unsure (1)..(122): unsure at all Xaa locations
  Clone ID: PAT_TA_103851.pep
MARLNSKAXAAAVVLAAVVLMMAGREAXXALSCXXXDSKLXPCVXYXVTGRAFSISKECCSRVQGLNXXARSXPDRKITCXCXKSXXTSIXSINMGXVSXVPRKCXVSXPFPISMSPTAQCQ

SEQ ID NO: 209434 - protein, 190 aa, Triticum aestivum
  Clone ID: PAT_TA_103852.pep
MSGGGGAYSDTESSESDGDMDEFVLVKLAEIRKEVQCPICLGIIRKTRTVMECLHRFCRDCIDKSMRLGNNECPACRTHCASRRSLRDDPNYDALIATLYPDIDKYEEEELAFGEEERTRNKKVKFICWVITNSYSTVFHIFSCSIYLPSHFYFIIDITFLMEESSHPRGDDSKSSPEALGKRLRKNFLC

SEQ ID NO: 209435 - protein, 150 aa, Triticum aestivum
  unsure (1)..(150): unsure at all Xaa locations
  Clone ID: PAT_TA_103853.pep
KGFSDVVKNGPVNCNTTHYRGIGYRAPPPVSGYSKMLLGVYAYFIEHKQRNTLIWLPTDGDAENFMKTHVEPTIRDIPSLXALAPWYGKKHRDXTLXMKXFTNGRGFWCLGGKAAKNYREKSVDVAGYDELAAFDDDIEQEGSXKFPPRQ

SEQ ID NO: 209436 - protein, 144 aa, Triticum aestivum
  unsure (1)..(144): unsure at all Xaa locations
  Clone ID: PAT_TA_103854.pep
XGNCSNIDGLVRLMTWRYPRHLLDPVLDDLRGGEQLTADCIYKICDLLRCSWPPQPIPAPIPGIYRDNSGNVTTITKIRKDVFVTTTVSKDHVPTATITSTCPSNDDCTQDDGVHISTELATDISSSVNSXVCFWRENPDFSHC

SEQ ID NO: 209437 - protein, 129 aa, Triticum aestivum
  unsure (1)..(129): unsure at all Xaa locations
  Clone ID: PAT_TA_103855.pep
FFFFXXXXFFFFXXKKKXXXXXXXXXXXXFFFFXKXXXXXXXXXXXKKKXXXXXXXFXXXXXXFXXXKNFXFXXXPPXXXXXFXXXFXPXXGRXNNQAPRMAGQXFSGEAXLVASDPRQIGAAFPFTRW

SEQ ID NO: 209438 - protein, 173 aa, Triticum aestivum
  unsure (1)..(173): unsure at all Xaa locations
  Clone ID: PAT_TA_103856.pep
GSVTASSLASFPRRHPPRKGGCLAAAATAGAAPAASAATAAAGARCSPTWRPPPAPPPWXCPPPXTKGTXAGSKPPGRPAASXGPPASAXPRAXCSSSTSTXPAPKKPARQXXXTKIKRTSKQXPLPPVHHHPSVYYXPSGRARNKNKNHPSCSFYAPCVFQTKGPFFPSIFN

SEQ ID NO: 209439 - protein, 146 aa, Triticum aestivum
  unsure (1)..(146): unsure at all Xaa locations
  Clone ID: PAT_TA_103857.pep
MAPTVMASSATSVAPFQGLKSTAGLPVSRRSNGASLGSVSNGGRIRCMQVWPIEGIKKFETLSYLPPLXTEALLKQVDYLIRSKWVPCLEFSKXGFIFREHNASPGYYHGRYWTMWKLPMFRCTHPTQVINEVEEVXKEYPDPYCH

SEQ ID NO: 209440 - protein, 217 aa, Triticum aestivum
  unsure (1)..(217): unsure at all Xaa locations
  Clone ID: PAT_TA_103858.pep
XXXXXXXXXXXXXXXXXXXXXXXXXXXXXXXXXXXXXXXXXXXFXXXXXXXXXXXXXXXFXXXXXXXXXXXXXXXXXXXXXXXXXXXXXXXXXXXXXXXXXXXXXXXVXVXFTXXNXXAXAXXFWGXXXXFSSXXSSAAGAGRTEPXAGTGXWARDAAADAQPRSRRRSASXXCLPRRXSXWGPRGGGEYEEDPSARASRTRSAXGXRSXDAPSPPG

SEQ ID NO: 209441 - protein, 169 aa, Triticum aestivum
  unsure (1)..(169): unsure at all Xaa locations
  Clone ID: PAT_TA_103859.pep
MANPRVFFDMTVGGAPAGRIVMELYKDAVPRTVENFRALCTGEKGVGKSGKPLHYKGSAFHRVIPDFMCQGGDFTRGNGTGGESIYGEKFADXKFVHKHTKPGILFMXNAXGPNTNGFQFXYFAPVPCNXWVXGKHVGLAKVGIGPFKKKKRGLSGLGFQNKINLGGQF

SEQ ID NO: 209442 - protein, 200 aa, Triticum aestivum
  unsure (1)..(200): unsure at all Xaa locations
  Clone ID: PAT_TA_103860.pep
ALSLSPQPQPFPSQQPYLQLQPFPQPQLPYPQPQLPYPQPQLPYPQPQPFRPQQLYPQSQPQYSQPQQPISQQQQQQQQQQQQQQQQQQQQILXQILQQQLIPCMXVVLQQHNILHGRXQVLQQSTYQLLRELCCQHLWEIPEQSQCQAIHXXXHAIIXGQQQKTTTTTWARGFFKAFWNNIHGGVFRAFLKNPQPRFSL

SEQ ID NO: 209443 - protein, 159 aa, Triticum aestivum
  unsure (1)..(159): unsure at all Xaa locations
  Clone ID: PAT_TA_103861.pep
QXXXYLQLQPFPQPQLPYPQPQPFRPQQPYPQPQPQYSQPQQPISQQQQQQQQQQQQQQQILQQILQQQLIPCRDVVLQQHNIAHGSSQVLQESTYQLVQQLCCQQLWQIPEQSRXQAIHNXXHAIILXXQHHHXQQQQQQXXPXPVSQVSFKGLEQFH

SEQ ID NO: 209444 - protein, 152 aa, Triticum aestivum
  unsure (1)..(152): unsure at all Xaa locations
  Clone ID: PAT_TA_103862.pep
MAAKGDGPAIGIDLGTTYSCVGVWQHHRVEIIANDQGNRTTPSYVXLPTSNALXATRXNQVAMNPINTVXDAXRXIGRXXTDXTVXXDIKLWPFKGCLLGWQSPIESNGSQRGGREKKQIFLGGRKFYGPKKKKKKFKFFSFGPPPFKKKKF

SEQ ID NO: 209445 - protein, 157 aa, Triticum aestivum
  unsure (1)..(157): unsure at all Xaa locations
  Clone ID: PAT_TA_103863.pep
GDVERNADDCRTWRRFDYGHVYASKSFFDSSKNRRVLWAWANESDSQDNDIARGWSGVXTVXRKVWLDQNRKXVKQWPIXEIETLRSKXVVXFLXTQVNPVAXQXSLVLAPQAXLEAIFXNPXPXKKLRTFXPNWVLGPPKTFSKEKWFPQKAQGLV

SEQ ID NO: 209446 - protein, 200 aa, Triticum aestivum
  unsure (1)..(200): unsure at all Xaa locations
  Clone ID: PAT_TA_103864.pep
LXXXTXXXILLDXXAIYDXXRRSLDIERPTYXNLNRLVXQVISXXTAXLRFDXALNXXVNEFXTXXXPYPRIHFMLSSYAPXIXXEXAYHXQLXGXDITNSAFEPXSXMVXXDXXHXXHXXXCLMXRGDXDPKDGHAVXVPSRPXHYXXVDXGPTGXXXXXXYQXXVWLSXXXXKAXGXXXXXXNHRXGXXXSXIXXXFX

SEQ ID NO: 209447 - protein, 179 aa, Triticum aestivum
  unsure (1)..(179): unsure at all Xaa locations
  Clone ID: PAT_TA_103865.pep
IRQXXVLAILMPTIAVILAIPVVYFFCWRKRRPEEVYLPSTSDDIQHIDSFFLELTTTXEIXTRDFXXSKMXGKXXIGMGYKGVLPDGEEIAVKRLGQTSRQGIGELKSELVLVAKLHHKNLVRLVGVCLEEQEKILVYEYMPNKSLDMIXFDSEXNKXLDWGKRFKNQKGFKSPPKNF

SEQ ID NO: 209448 - protein, 122 aa, Triticum aestivum
  unsure (1)..(122): unsure at all Xaa locations
  Clone ID: PAT_TA_103866.pep
MASTSCFLHQSTARLAASARPAPAVGRTQLFVCKAXKSDEAASDAAVVTSRRAALSXLAGAAAVAVKXFPAAAAYREXXNVFXKXKKNTDFLGYNGEGXKXMIPXVEPTVSSLGLSIFYHNF

SEQ ID NO: 209449 - protein, 197 aa, Triticum aestivum
  unsure (1)..(197): unsure at all Xaa locations
  Clone ID: PAT_TA_103867.pep
AXPQGPGQLQQPAQGQQPAQGQQXAQEQQPGQAQQXGQWQLVYYPTSPQQPGQLQQPAQGQQGYYPTXXQQSGQGQQGYYPTXXQQXGQGQQGYYPTXSQQSGQWQQPGQGQQPRQGQQGYYPIXSQQSGQGQQPXQGQQGYYPTFSXQSGQGXQPGHEQXXGQWXXXQEQGQQGYFSTFFTTQGQGAFKLNKGQGS

SEQ ID NO: 209450 - protein, 100 aa, Triticum aestivum
  unsure (1)..(100): unsure at all Xaa locations
  Clone ID: PAT_TA_103868.pep
NLRASTPVPALLFGQSXXALQVLXNGRFRSVXHRVVXNSXRPRVSTXXFGGPPFGXRLAPLRXLXGVGGRXRYXEFTWKEYXSSTHKGRLATDRXCSFEN

SEQ ID NO: 209451 - protein, 117 aa, Triticum aestivum
  unsure (1)..(117): unsure at all Xaa locations
  Clone ID: PAT_TA_103869.pep
XXXENTKTHXNSPFXXXYLSXGTTXFQISGXIXICLPRPDQQWKEGNTRGEAKQQPGCGTSPRWREAVGRRAAAGVGVPRPRRRSGGRGRRPRPGSTAETEGERCGRGLAEQPAGPE

SEQ ID NO: 209452 - protein, 202 aa, Triticum aestivum
  unsure (1)..(202): unsure at all Xaa locations
  Clone ID: PAT_TA_103870.pep
MKTFLVFALLAVAATSAIAQMETRCIPGLERPWQQQPLPPQQTFXQQPLFXQQQQQQLFXXQPSFSQQQPPFWQQQPPFSXQQPILPQQPPFXQQQQLVLPQQPPFXQQQQPVLPPQQXPFSQQQQQHQQLVQQQIPVVQPSILQQLNPCKVFLQQQCSPVAMPQRLARSQMLQXSSCHVMQQQCXQQLPQXXQQXRYXAIR

SEQ ID NO: 209453 - protein, 215 aa, Triticum aestivum
  unsure (1)..(215): unsure at all Xaa locations
  Clone ID: PAT_TA_103871.pep
SPEXTYPHQPQQQFPQTQQPQQPFPQPQQTFPQQPQLPFPQQPQQPFPQPQQPQQQFPQSQQPQQPFPQPQQQFLQPQQPQQSFPQQQQPLIQLSLQQQMNPCKNFLLQQCNPVSLVSSLISMILPRSDCQVMQQQCCQQLAQIPQQLQCAAIHSVVHSIIMQQEQRQGVQIRRXLFQLVQGQGIIQPXQPAXLXGDQGHWYLRTXSTMCNVYXL

SEQ ID NO: 209454 - protein, 152 aa, Triticum aestivum
  Clone ID: PAT_TA_103872.pep
PSPSSCCPMAPQALLDPEQPATSGLQPPEAASAAPGPARPCSSPSVLPRRRQPPSSAATGASSSAAPPELLACAPHARPRLVPAARSPQLRATRRLPQEAGPARGPFPFSYLLFILLLLSLTPSLCYLSLFPSSRDAPMAGSSRTGADLAGS

SEQ ID NO: 209455 - protein, 120 aa, Triticum aestivum
  unsure (1)..(120): unsure at all Xaa locations
  Clone ID: PAT_TA_103873.pep
LVETESSRRFPSPWRPRPQLAQALLQPEPKSSSSTPRRRPAPAPXPPPPLIVDASGRPQPSSSASAGTSGXRPPLPCWSSPASPWTPPASPASAASPSPAPPCPTSPLLPLLRTAATRGN

SEQ ID NO: 209456 - protein, 75 aa, Triticum aestivum; identical to SEQ ID NO: 106874
  Clone ID: PAT_TA_103874.pep

SEQ ID NO: 209457 - protein, 179 aa, Triticum aestivum
  Clone ID: PAT_TA_103875.pep
DLCQHVQTALHGRTFRVYASTDRFGVELGGALKNVYAIIAGMAVALNMGENTKSMLITRALAEMTRFAVSQGANPMTFLGLAGVGDLIVTCSSPKSRNYQVGFALGQGLSLDEAITRLGEVAEGVNTLKVLKAKAQELQVYMPLVAGLHAILFEGRTLEQVIELLMRAEPKTDVEKKKK

SEQ ID NO: 209458 - protein, 165 aa, Triticum aestivum
  Clone ID: PAT_TA_103876.pep
MEEKAAAHINPANNNISPFHIQNIQFQNAGYSDAAYNPEIAKEEAGLGVFLRNVILNHTVFVQAAAKNVCSVLQAEAIGLSLSAEVVKALGWNTAIFLSDCRNLVQVAKARNLLESPGDWRIRPMLAEFLNHTSFLSSCEVRSIPRNGNVIAYSLAKKAFMQKKK

SEQ ID NO: 209459 - protein, 85 aa, Triticum aestivum
  unsure (1)..(85): unsure at all Xaa locations
  Clone ID: PAT_TA_103877.pep
MKNLKLVTRVVQELQLHLDGETLVVSAIDAERHRAFFVSSANFXYSVNLLAXHQQPLQWSKTTLDSNVEEGLLEPGDFIIAMDYL

SEQ ID NO: 209460 - protein, 63 aa, Triticum aestivum
  Clone ID: PAT_TA_103878.pep
THQCIIQKPYIYCTNILRTHGSVLHSSSTYTPHITPPCLVSLSLTRSLLLTLSVSPMLTAHVS

SEQ ID NO: 209461 - protein, 58 aa, Triticum aestivum
  unsure (1)..(58): unsure at all Xaa locations
  Clone ID: PAT_TA_103879.pep
FSLVHYDHVVCVGLLLCEVLSCHCSEDQGFTGNRXSSDISVATXAIFLMFDSCSGSPR

SEQ ID NO: 209462 - protein, 196 aa, Triticum aestivum
  Clone ID: PAT_TA_103880.pep
RASSNPVLPEDNEPNQSSDTNTEIGHQQVTNAEENVNAAPCLQQNYEPRMHQHKDERSPINHNSDEPGQPVTESLSGSESAGRQHSERYGRIQTKRIRSQSPIARRSCSPSGENKHSPSQSSSHERQSRSPLAKRANLHQSKSAHHVSLLPGQPLVASSEPQMQFQPNAMAPSNDFLQNQIRTYTAQIFLILAIGF

SEQ ID NO: 209463 - protein, 150 aa, Triticum aestivum
  unsure (1)..(150): unsure at all Xaa locations
  Clone ID: PAT_TA_103881.pep
QTLTVXTYIGETLYAIFKAALVLVLFAHLIGNVQTYLQSITARVEEWRVKQRDTEEWMKHRQLPPVLRERVRRFIHYKWLATRGVDEASILKALPADLRRDINRHLCLDLVRRVPFFSQMDDQLLDAICGRLVSSLSTKGTYTGRRGATR

SEQ ID NO: 209464 - protein, 147 aa, Triticum aestivum
  Clone ID: PAT_TA_103882.pep
MAPDLNGVANGARWDYSTPGSSGYSVPDIVYNDPSTRKMRVLTIGAGLSGIQLAYQIQKYTQNVEHVIYEKNARIGGTWLENRYPGCACDIPSHAYTLNFALNPDWPRFFSYAPDILKYLEKVCDVFGLRKYMTFNTEMVRAEWQDE

SEQ ID NO: 209465 - protein, 146 aa, Triticum aestivum
  Clone ID: PAT_TA_103883.pep
MNSSRSLLSSPLFPTSSPNFRGAASSPSPSRASVPMIHDSTGGRASTACHYSPSLVAEEQAHGSVSLKGEKALLEFLLDMALEQHTEGKTFKAEEGAEGEFESYLRGLQRQVIYQQAFGEKEQLHLCNHFNFNAIRQKSSFQLLDL

SEQ ID NO: 209466 - protein, 165 aa, Triticum aestivum
  Clone ID: PAT_TA_103884.pep
IDCLLLLDGAEVPGELHELSGGNVVYVSATVMKKISGMQSVDSTEAIAVMHMPKHFCDLGDDEGGAGLDASFQSPKRILVLDGIQDPGNLGTLIRSACAFKWDGVFLLPACCDPFNEKALRAARGASLQLPIVSGNWCDLHDLVTRYGMKMLAGHPESSSDGSER

SEQ ID NO: 209467 - protein, 65 aa, Triticum aestivum
  Clone ID: PAT_TA_103885.pep
PKKLLKSSKGTKRLNETNHGLQMISYKNNDYRKPHELKNSDVLTIAYPATTLKIIRNSAYVVLQN

SEQ ID NO: 209468 - protein, 161 aa, Triticum aestivum
  unsure (1)..(161): unsure at all Xaa locations
  Clone ID: PAT_TA_103886.pep
MLLLLLLLLFSSLQLPTTAIDTLALGQALPWNETLVSKGGEFELGLFSPGNSGKHYVGIWYKKISKQTVVWVANREHPIVKPSTSRFMLSIHGELLLLTMPSDTLLWSSNASSRSPPSTTVATLQDDGNLVVRRSNATSSSXYVVWQSFDHPTDTWLPGAR

SEQ ID NO: 209469 - protein, 126 aa, Triticum aestivum
  Clone ID: PAT_TA_103887.pep
TTCRNPCLLRFSALFAELTDRIVPVALDAAQSTYYGSTARGWKAMDPWFFYMNPRPGYKVTFLPALRPEKTCGGGGRSAVDVANHVQAVIGKELGYRCTTLTRKDKYMKLAGNDGTVAGDDGKKFA

SEQ ID NO: 209470 - protein, 133 aa, Triticum aestivum
  Clone ID: PAT_TA_103888.pep
LDSCQNIRKPYPQKSKKHMKALQYPSFPYYKIWRAASRRRAIEEAGHRRRRGCGMDVDEQLVHAPRMADEQLADGFRGRCGGSCQYRPNLETPDRGRAPKSGGTAAAEGRGRGGGRNQVLVRGTGGAISATGE

SEQ ID NO: 209471 - protein, 95 aa, Triticum aestivum
  unsure (1)..(95): unsure at all Xaa locations
  Clone ID: PAT_TA_103889.pep
EINKEXFNNYSQQNIIPECLIGILYYINVVQSCDTTQLFTNLYSLRSKIDDGKLSCCRMYADLQNQQYRQNSYPHILLNIYRKIYITKYSPVTGA

SEQ ID NO: 209472 - protein, 166 aa, Triticum aestivum
  unsure (1)..(166): unsure at all Xaa locations
  Clone ID: PAT_TA_103890.pep
LRRDVDDLLEGRLPASGRARARAWRRDRLHPLHLRHHQFPVHRRGHADRDHADSLLHPLPREELLLDPALRRALRSWHRLRRYDPAVLRDLPAVLALPARIPSCAVVGNSGILLRHAHGALIDSHHAVFRLNNARVVGYTAHVGAKXNLSFINSNILHLCARRPAA

SEQ ID NO: 209473 - protein, 106 aa, Triticum aestivum
  Clone ID: PAT_TA_103891.pep
YKFLMVNIYIFFYKLGQTLVLICEVNKNGGSTREHIYMPLQNTFPSSYFQTASQKPLQILCTVNTGTPLQCRREKTQISRSFSFALSTKRLQLCVIAALLSTPFIS

SEQ ID NO: 209474 - protein, 69 aa, Triticum aestivum
  Clone ID: PAT_TA_103892.pep
LYKGKCVRTFEKGATRSTKHFELIHNDICLTFPVKYVDGFDALSVSWMTSYIYPIHDSEEPGKIDILKA

SEQ ID NO: 209475 - protein, 92 aa, Triticum aestivum
  unsure (1)..(92): unsure at all Xaa locations
  Clone ID: PAT_TA_103893.pep
RRYFSSLSLSHARSFSTSPERPPSPWTHLTARPPSTPSPRTAPGAPPSTSTTPTTATSSSXAAPPSPSTTSSPTQTARITVVRPRTGRLCCS

SEQ ID NO: 209476 - protein, 78 aa, Triticum aestivum
  Clone ID: PAT_TA_103894.pep
MPKPPAGFVLDDQGRCIAAASKRIVTIIDDANNRPLECIIRRVFSSTQDHECLLLCPVDMPVQVLKSTNFSGWIAVCL

SEQ ID NO: 209477 - protein, 35 aa, Triticum aestivum
  Clone ID: PAT_TA_103895.pep
TDGHAERVNQCLENYLRCMAFQQPKTWRSCLALAV

SEQ ID NO: 209478 - protein, 73 aa, Triticum aestivum
  Clone ID: PAT_TA_103896.pep
MVLITMSSSSSCLLPLDEEPPLPLMLNATSANGRTTTSMSYAPSGQGSSLSHLAKTASSTAASSLFCYSFSFQ

SEQ ID NO: 209479 - protein, 165 aa, Triticum aestivum
  unsure (1)..(165): unsure at all Xaa locations
  Clone ID: PAT_TA_103897.pep
LDLLDSDDPRERDCLKTVLXRIYGKFMGNRPFIRKAVSNIFYRFVSDADRHNGIAELLEVFGSVISGFAKPLKEEHKLFLWKALIPLHKPKTVGMYLPQLTYCITQFIDKEPKLSGTVIRGLLKYWPVTNSQKEMMFLGEXEEVLEXLTEMPEFQKCMGPHCFRG

SEQ ID NO: 209480 - protein, 156 aa, Triticum aestivum
  unsure (1)..(156): unsure at all Xaa locations
  Clone ID: PAT_TA_103898.pep
MTGGSGGTTRRPSAASRSRGDPSSSAPDPDARRAAAAAAARRSGRGDHGPLRVMAVSARTLLLLGIASVALLSFAFLAYTGGWWQAEAESEXPAALRKMARFVTPLDAPRMMDLAQFQSGHKESLYWGTYRXNVYLGIRAKTPVALIAGLMWNWRE

SEQ ID NO: 209481 - protein, 150 aa, Triticum aestivum
  Clone ID: PAT_TA_103899.pep
KCSLFHTTFMFFFSKIGFLKNVRTSKFVWNFSKLFSILKYVLKKQKMFVLYKIVHASKFVQDFSKLFFVSKFVLKVQKMFVLQKIIRASKFVLKIQKSFMLHKNVHKLQKCLISEKCLGNSNFSVFIKFGHMFKKCSCFQICLQIQKIVH

SEQ ID NO: 209482 - protein, 173 aa, Triticum aestivum
  unsure (1)..(173): unsure at all Xaa locations
  Clone ID: PAT_TA_103900.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSSYEYVSQGLKKYDFDNTMGGFYIAPAFMDKLVVHLFKNFMTLPXIKIPLILGIWGGKGQGKSFQCELVFARWA

SEQ ID NO: 209483 - protein, 202 aa, Triticum aestivum
  unsure (1)..(202): unsure at all Xaa locations
  Clone ID: PAT_TA_103901.pep
AGDVAELAITSLPLETRFPPFRLRRYGGFWLVEKFLKDVPAVHSVFKTRPSYVLLGSFPKCGTTWLKALVFATRNRADHSPHDLHHPRRRCNPHDVVRTWSWSLGGHWKTVEQAARVLAALPSPRLLATHLPYSLLPRRITAEESGCWIVYICRXPKDAFISSWVFTKKEAAATAASSTSPASTRTSSRTAPPRHTFEEAFE

SEQ ID NO: 209484 - protein, 186 aa, Triticum aestivum
  Clone ID: PAT_TA_103902.pep
VAIAPPSGLTHRRRWSEEDWAGSRQSEPMEGRRVRGCSGSAGCRPSRRSIRQPLLRRPRSQRLSPFSPQVPEEQQQGDRLKRHLSGGAPRCGIPPPTPSHRSQSTPSRMEPCTHGSLKIPCSVKAGSQPDCWLSPWTSSVLGYHQHLDLPLPVQKEVQSRLWSSDAISCFCQLPEAIRLNTFGVRW

SEQ ID NO: 209485 - protein, 191 aa, Triticum aestivum
  Clone ID: PAT_TA_103903.pep
LSYLNLIPFLLPLLCTYLSLPQIPSCVADLQRSVVTRCPKLVGTAQSYPRHRTRLLPRRDIGSHVAGTLPGQLWLGGGGASVPRGGGGGGVAMCEQQEWSWWTGPRRGRGEERRTEEAPASTVGSGGTPRLRRRARRRQGCRLSGETRRTRRRRARCRPRLGRDAPSPSARSSHKRVELEMVASLLAKQGA

SEQ ID NO: 209486 - protein, 109 aa, Triticum aestivum
  Clone ID: PAT_TA_103904.pep
RCSGDGTRPRAPCVRPATPVCLVSRGGPVPNSPYSESYYNSLAVVLQRRDWENPGVTQLNRLAAHPPFASWRNSEEARTDRPSQQLRSLNGEWQIVSVNILLKFALNFC

SEQ ID NO: 209487 - protein, 96 aa, Triticum aestivum
  unsure (1)..(96): unsure at all Xaa locations
  Clone ID: PAT_TA_103905.pep
IYAIGAGITAAAGTRLALQWILVKXLDCTHSNYQTLMRPXIVIYCHYLPVSGLGNLHACCLXLDVVAVSQAPSPESNPNSPSPVTTMVGPYPTIES

SEQ ID NO: 209488 - protein, 144 aa, Triticum aestivum
  Clone ID: PAT_TA_103906.pep
VHLKSESLSKFGESTIQESATCSCNKPQLLHMPCTHVIAVCCQIGVSTATYMSPYYSLAYLGRIWSGNFDEYRISRGYRNITPFECNTTTWIPDKRLECGLPVFVTSDCLETVADESEQQCNTGNGSTEDNQGATTCTEEPNEI

SEQ ID NO: 209489 - protein, 70 aa, Triticum aestivum
  Clone ID: PAT_TA_103907.pep
MPSVGVKIYSVFFKLLLRHRLQSLAAAAGAAADGDGDAAAFGVSCRADEATAPANPAFSAADGVAFKDLH

SEQ ID NO: 209490 - protein, 137 aa, Triticum aestivum
  Clone ID: PAT_TA_103908.pep
MGTPSPTPYHLQSPRTIITKIISMKQQEPATPDPPPPSKIILQPRRRTTPAMWCAAIAGFAFSVLLILAGLVILIVYLSVKPRTPSFDVANAALNTVYVGSPSSYYNGDMTLVANISNPNHKMGVVIQSGAVELFFR

SEQ ID NO: 209491 - protein, 162 aa, Triticum aestivum
  unsure (1)..(162): unsure at all Xaa locations
  Clone ID: PAT_TA_103909.pep
MDQAASYSASTTPLLLLLGSVTLAVSLFVLMGRSRHGRGKAGLPPGPPALLFLAKFLALRRSIFDLGPLLVDLHARHGPVFSVRLFRTLVFVADRKLAHRALVQGGATFADRPPPVDPTRLFTSGGRDIXSSSSYGPYWRLLRRNLAGEALSPARVGLFAPA

SEQ ID NO: 209492 - protein, 166 aa, Triticum aestivum
  Clone ID: PAT_TA_103910.pep
MAASALHQTTSFLGTAPRRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAQIFSEGGLDYLGNPNLVHAQSILAIWAVQVVLM

SEQ ID NO: 209493 - protein, 196 aa, Triticum aestivum
  Clone ID: PAT_TA_103911.pep
RTDAPQAAKRPSRRAKHMLGLLRRRAASSPAASLQLFQCCYHRSSERLLPCRDQEVSYGLNWAIAARGVVVKDKVFYNLEPSELQKSGTAYAERLSGTPLHVKGNVIGGFPEISGAQFAKLLKQVTFHLSSISSLYVQDGAIGSSAECDAKVRVISDNPSAIMSLSNILQKIPDRAISHDTCPLTIYVASSISTNV

SEQ ID NO: 209494 - protein, 67 aa, Triticum aestivum
  Clone ID: PAT_TA_103912.pep
EMKDQFYTPILCRMSIRRKQQIYLGILYIHGGALRSKWAIKQHHKSLHKTLQPLVCFTTIYEVNSWN

SEQ ID NO: 209495 - protein, 112 aa, Triticum aestivum
  Clone ID: PAT_TA_103913.pep
RVLLDTFPSQYQSVIVMLILNLLSSHSSDEEYMGTYQELVWRKEEKIKEAFDRFKSKMVDIAAQIDKANMDPKLKNRNGPGVVPYVLLRPSNGHPEDEKTVMGLGIPYSISI

SEQ ID NO: 209496 - protein, 181 aa, Triticum aestivum
  unsure (1)..(181): unsure at all Xaa locations
  Clone ID: PAT_TA_103914.pep
AATTTTTAAAKAGPVRISKWYPTESTRVRRNPTKAPKAHTLRRNIVPGTVLILLVGRFKGKRVVFIRQLKSGLLLVTGPFKLNGVPLRRVNQSTVIPTSTKVDISGVKADAINDETFNRIKVKKTKKSEEAFFAAGTVEKTQAEKDQITARRKAQTEVDGXILAAVKKTELLRQYLKSRFT

SEQ ID NO: 209497 - protein, 137 aa, Triticum aestivum
  Clone ID: PAT_TA_103915.pep
MSTDVAADVPAPEVEVAADPVVETTAEAAAGDAKPAKETKAKAAKAKKPSAPRKPRATPAHPTYAEMVSEAITALKERTGSSQYAIAKFVEDKHKAHLPANFRKILSVQLKKLVASGKLTKVKASYKLSAAAAKPKP

SEQ ID NO: 209498 - protein, 164 aa, Triticum aestivum
  Clone ID: PAT_TA_103916.pep
TSRRQWWRPMVCHFLLMAISETATPASGVESGSTSAARDLGARLGASISGGGVAAAAASVVGSLDTVMRAFSPDIRPLDQGGAQRGEVRGSPDVEFSGGSCTLSALGRRCGIQERRWVGAVRRLMRLGTVLPQCARAAASTTIRVGWNTGKEGHKGPDERSGNS

SEQ ID NO: 209499 - protein, 120 aa, Triticum aestivum
  Clone ID: PAT_TA_103917.pep
TERECSTENQQSRRDHQAGPAHLRVDTVRAGPVPVRAVVWTGRRRSGPDRTEHHDGPDFWDRTGSGQARAGPSGPAKPGPDRATCTGAAARCATCAGAVTRWASCESAGGKVGQVCAWRR

SEQ ID NO: 209500 - protein, 142 aa, Triticum aestivum
  Clone ID: PAT_TA_103918.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFGRTIKDEGFGS

SEQ ID NO: 209501 - protein, 119 aa, Triticum aestivum
  Clone ID: PAT_TA_103919.pep
KEFLLGDEVPRRPSLPYLRHSYRRCASHGRTAPCGGCCRAGIGPSHPRRVPRGLLMHMARLSSKRPHVLALLRTVLALAASDASDTVIPGAAQFQRDPKGELPHVVAVRPHCGGGLGRA

SEQ ID NO: 209502 - protein, 149 aa, Triticum aestivum
  Clone ID: PAT_TA_103920.pep
PVSEDVDMASVELLKAPPVPKKRIFLLVGVFSTGNNFKRRMALRRTWMQYESVRSGEVAVRFFTGLIFFFLGFHKNEQVNMELWREAQLYGDIQFMPFVDYYTLITLKTVAICMFGTKIMPAKYIMKTDDDAFVRIDEVISSLKKPTPM

SEQ ID NO: 209503 - protein, 51 aa, Triticum aestivum
  Clone ID: PAT_TA_103921.pep
IDPARTPKLAAWAERFRVAEPVKALLPGVDKLEEYITTVLYPKWNVAVTGN

SEQ ID NO: 209504 - protein, 164 aa, Triticum aestivum
  Clone ID: PAT_TA_103922.pep
MAPDLEPLLPRAGHRPVTGGWRSALFIIWVEVAERFAYYGISANLISYLTGPLGESTAAAAAAVNAWSGAASMLPLLGAAVADSWLGRYRTIVASSVLYITGLGMLALSSMFSSPSEQCKLTADGRQACPRSSLQTAFFYVSLYLVAIAQSGHKPCVQAFGADQ

SEQ ID NO: 209505 - protein, 160 aa, Triticum aestivum
  Clone ID: PAT_TA_103923.pep
LLCCLAAARGSVDFRADLNHPYAGSSLSTDHVIGHAARASKARAERINARVARAIGKGGDISAAHVPLAPLGDEGHSLTVGIGTPPQPRTLIVDTGSDLIWTQCELPRGRAARQREPPSTIPASPPLLFLPCGNRLCQEGQFQLQELDREVHVRRAVRQR

SEQ ID NO: 209506 - protein, 173 aa, Triticum aestivum
  Clone ID: PAT_TA_103924.pep
LPCRSRGRPGSKNPSRRQFLTSGHSPLAAASMGRRAKPARPGGGGPSPPPLPGFAARAAGLCWSSWGRIARGSTARQRGGKSTARRRVALARRSRCGMVLAPRSRCGRMRIWRLEGTRWARRLHLEGALRRSSAAHGGAARALGRSGGPDLASAAATTWAARPPLPSPLTGSH

SEQ ID NO: 209507 - protein, 171 aa, Triticum aestivum
  Clone ID: PAT_TA_103925.pep
MATECEVNKSRRFDRGMSRRTRKPVSLVACYEDRYVPPLARQLLHEAKLKRLLRCEDTKELQAPQQREDAEQQLEIPQAPQECEGVEKKAPEQYQDEKEKKPQQYEDEEQEKKPHLHQDEEQNIPKQYQDEEETGQQQQDDDAPEQCLDEDPKTPEQYQDKELEEEEEEEE

SEQ ID NO: 209508 - protein, 82 aa, Triticum aestivum
  Clone ID: PAT_TA_103926.pep
MRDVLCPDLEVHSWLTFQFYDMDFGTGTPTYVMPSYIPAEGLIFLAPSYIGDGSIDAFVPVFQDNLEAFKQCLYSIDHHDKE

SEQ ID NO: 209509 - protein, 116 aa, Triticum aestivum
  Clone ID: PAT_TA_103927.pep
LAGEIPQELTNLTSLATLNLSDNRLVGKIPQSGQFLTFDINSFEGNLGLCGPPFSKPCGVSLAPPSPARVEKSSNVDVILFLFVGLGFGVGFAAAILMRWGRIRKWFVKSARALWT

SEQ ID NO: 209510 - protein, 120 aa, Triticum aestivum
  Clone ID: PAT_TA_103928.pep
FARGALQHGASCEGWGSPFAAAAMEHLEAPSRVIGAARQHSPEPAGGDAAFKPPQNYRGRDAQGIGAVVQPRRRADAEMQPHRRCWCCKSPAVKLQWSARRQQPRAPMQHSLGAAPRAAA

SEQ ID NO: 209511 - protein, 155 aa, Triticum aestivum
  Clone ID: PAT_TA_103929.pep
QKRRTSTATTPTPSSLPVHNRCADTPLHLRLRGHDAARTVLSGAYAAALKQRRLGTGGDRLQGRGAGARAAHGVALTGRQLGASTRASRPRQRGNDVCGSRDSLGVLRQQQRLAARGNDVCSCSFSSWDNRSLPVFGRPCWSFTYIQVESLWSFS

SEQ ID NO: 209512 - protein, 146 aa, Triticum aestivum
  unsure (1)..(146): unsure at all Xaa locations
  Clone ID: PAT_TA_103930.pep
MAGRKGGDRKKAVTRSVKAGLQFPVGRIGRYLKKGRYAQRVGSGAPVYLAAVLEYLAAEVLELAGNAAKDNKKTRIIPRHLLLAVRNDQELGRLLAGVTIAHGGVIPNINSVLLPKKSAAAEKEAKSPKKKXATKSPKKKAAAAKE

SEQ ID NO: 209513 - protein, 134 aa, Triticum aestivum
  Clone ID: PAT_TA_103931.pep
MPTVRRRNPDVHVKALEGIVSANTFLTVAVFIGITGTITASSTVPRNCVAGDDIARNFFLFEILSFGFYLLSSLVAQGMKLSVTLLAAGDDFYGDGEQKPVMTDDCEEMPAWRARGPPGAAPAPCLRYRAGHDA

SEQ ID NO: 209514 - protein, 132 aa, Triticum aestivum
  Clone ID: PAT_TA_103932.pep
SKTTAPADGIPPHHSPANGIPPHHSPAFHPTASLSHRPPTLAVSLSLAPNPDPDPQRRRQHLGALRSHPSLLTPRQPAKVYGSEGSAYYEWSPAELLMLGVASIGCHGRRGWASRWTALAHRQQHHPSSPSH

SEQ ID NO: 209515 - protein, 182 aa, Triticum aestivum
  Clone ID: PAT_TA_103933.pep
FHVRCSAHILNILAQDGARYVHKPIEKIRELLRHIASSPLRIQSFNVIATNLDLPEKAGGINLDIPNRWNSTYLMIEEALEYKGALNNYASGNGEIAPDDVEWTNADVMCTFLKAFEEATKLVSADRTLTTHLFLHMVLCIRDALRDPQWSTSGTMSNLVYAMGQKFDKYWKESKLMLQLSS

SEQ ID NO: 209516 - protein, 80 aa, Triticum aestivum
  Clone ID: PAT_TA_103934.pep
IIFIKQERALIQDNKVEDALRHTSVLGWLYLKLLHALVLRSTTHRYKYQQIVLYQPIEELSVLKVPNESRDFHQYQEPKA

SEQ ID NO: 209517 - protein, 100 aa, Triticum aestivum
  Clone ID: PAT_TA_103935.pep
MVHVNFYRNYGKTFKKPRRPYEKERLDAELKLVGEYGLRAKRELYRVQYALSRIRNAARELLTLDEKNPRRIFEGAALLRRMNRYGLLTEEQNKLDYVLA

SEQ ID NO: 209518 - protein, 122 aa, Triticum aestivum
  Clone ID: PAT_TA_103936.pep
FDCRHHPFRRRNDHAATSMHPNQHVCTPFVCSGPSSHRRPRTRCSAPLRTFLALASSDAPDAAVAVATPILAGRSTPGLPAASDASAIPAQPNEPVRTSCSAPGSPRADGLRCTRRGHSRRG

SEQ ID NO: 209519 - protein, 143 aa, Triticum aestivum
  Clone ID: PAT_TA_103937.pep
LKESPAHGSCGLCRQGQGGRRDSFWCYSYLDGHRELAYTHVACMMEACYKRSQVAQVSAQATWAVGTPTTWEVGMPQSAPTTWEVGTPQSVPTTWDSGLSSSISKVSLFCKVAVAVARVASAVSTGTGGDPLWIDTTAAEPTE

SEQ ID NO: 209520 - protein, 103 aa, Triticum aestivum
  unsure (1)..(103): unsure at all Xaa locations
  Clone ID: PAT_TA_103938.pep
FHPIPLFPSGFVGRQPWTAATTATTNGGGGILXGDRXWMGASVVPAXFISMERXSCIHIHXMDDEDDYDPEEAKDRPLMXSRPQALPEYYYDRSGSSASFAKM

SEQ ID NO: 209521 - protein, 106 aa, Triticum aestivum
  unsure (1)..(106): unsure at all Xaa locations
  Clone ID: PAT_TA_103939.pep
PEPPWGAXKKRKPLLGXSGHFGIFXSTPKCPXLAEGXRGGSXPDSGXLRQYAXXFDTXRXTPXVVVXXAHAWIRXPTLXPKXKVNMARSMATNLYLLGRANNPNCL

SEQ ID NO: 209522 - protein, 109 aa, Triticum aestivum
  unsure (1)..(109): unsure at all Xaa locations
  Clone ID: PAT_TA_103940.pep
LFAAFFSLFCSKVCACKXLCAAGARYPHEHRNEGPHQARXKIXXCAXKRSXFXXMXVIFXLFWGXISTWVCDLXSDLCFHRLCXTXGKFAGDNRSSPXPLVWLSPXNXQ

SEQ ID NO: 209523 - protein, 136 aa, Triticum aestivum
  unsure (1)..(136): unsure at all Xaa locations
  Clone ID: PAT_TA_103941.pep
PNVVFALXQGSRSSPPVRVYTAEEVSSELEAAKVEYLERCVRVAGARRKKAKSKAAAAAATIVLPKLLHWHMRCFADDVESLLEWVHSQLPRATRAPELKRAIRELLHRGRPPTPEKMVEIEPYDADFRYLLPLVS

SEQ ID NO: 209524 - protein, 110 aa, Triticum aestivum
  Clone ID: PAT_TA_103942.pep
RTHHRDEAASVHHLTLAGDPPEKLRRPRPRPPLPSSVSGERARTGSDGQSRVDKWQIARSMTSRIIRIVSATIFIKLTGRVCRQSCPVCSKCTLKHDVTRPGAGFACKWP

SEQ ID NO: 209525 - protein, 100 aa, Triticum aestivum
  unsure (1)..(100): unsure at all Xaa locations
  Clone ID: PAT_TA_103943.pep
XFTRGXGTEGESIYGXKFADXKFVHKHTKPGXLSMXNAGPNTNGXSQXFICTVPCNWLDGKHVVFGXVVEGMDVVKNIXKVGSRSGTCSKQVVIADCGQL

SEQ ID NO: 209526 - protein, 136 aa, Triticum aestivum
  unsure (1)..(136): unsure at all Xaa locations
  Clone ID: PAT_TA_103944.pep
KXQXXDVTFRXPGRYVFGXXHARSDYLLPYPSPGFSPLERXDGPLLRLIXVNTDHXSXTCCHDYPSLGHYHNLRXQRHGTIAPVXHIYSHSISHDGHTSIDHGSXTAAGCTQNCRVXAQDNITDCNXHTHSCDETS

SEQ ID NO: 209527 - protein, 191 aa, Triticum aestivum
  unsure (1)..(191): unsure at all Xaa locations
  Clone ID: PAT_TA_103945.pep
IRPGGFIPYGSTSALGVGEIHSENVQGVQCQWLECTCXGKXKAGSLVLAEFPTRNPXVXSHSKLNRDVPNXIESERGXANAGAQSTARGPRKFQRDARGXCRGSRXTLVILETGGQXXGEXXYNPGRVGELVTKCXXXRXMHFTFPAVPGXTVTAXRTXPXAPINGGPDTRVRGTALXSPVWXITPHISTG

SEQ ID NO: 209528 - protein, 139 aa, Triticum aestivum
  unsure (1)..(139): unsure at all Xaa locations
  Clone ID: PAT_TA_103946.pep
PHNLHARDIDRDGFPEPNLPRHRHHTPCPIXTASLERLNSPDWHKSTSSTSPSATARRRYETHTQTTGSPRGFRNSRKMLESRREQTPXRTXXGPMLFPEPPTVELRRVETKLGTNNPCKTNHTKLRLLAVTLSCRAHT

SEQ ID NO: 209529 - protein, 153 aa, Triticum aestivum
  unsure (1)..(153): unsure at all Xaa locations
  Clone ID: PAT_TA_103947.pep
HVLVQVPIHFMCHRHATPQANAHATIILTTPHGPHCQLRSLLHLASTLYYLTRQSHTHGFARYTGSXLSPHSVTXCAIPNLHIPSNTKSQGVIFCAGVGTXRILLWVDIAIELPCTIPXWLDYIDRSVPPRDAPLTDGHHFAHALVVGPLVAN

SEQ ID NO: 209530 - protein, 76 aa, Triticum aestivum
  Clone ID: PAT_TA_103948.pep
QLNSLTEPHKTYIGISPLLFASIKGAPKLHVTMPFPKVYLTFIGSRSSLARRRDMGLRRDTYLNSSLSMGKNPEFL

SEQ ID NO: 209531 - protein, 77 aa, Triticum aestivum
  unsure (1)..(77): unsure at all Xaa locations
  Clone ID: PAT_TA_103949.pep
FFFFFFFFFFGHKGEAXASTQWRLESSTSKCQLLIPLRNYESGVHVEKSQETKISERQLTSSVRALEQPKAAPAENM

SEQ ID NO: 209532 - protein, 186 aa, Triticum aestivum
  unsure (1)..(186): unsure at all Xaa locations
  Clone ID: PAT_TA_103950.pep
RRHSXLAXSXTLCPVSDAXMGRHVSMXAXPPPCDPGQVXTXIIGVRDAITVLELASSIILALXLRLXPCLTPSPCGTLRPGFEPLTNVHLSXXVCSXKCVXIKGSTSHGRIATSTLSVTNWVTYTKCVYGPFSPFRLVEVPRFRCTSTGTKAPPREPXPSQXSXSVTSRHTHHVSCGTFRPNHTIS

SEQ ID NO: 209533 - protein, 176 aa, Triticum aestivum
  unsure (1)..(176): unsure at all Xaa locations
  Clone ID: PAT_TA_103951.pep
ELMHSGPKEFMKQVSAGTTLVICAMTCDIPXNLYNSSWESNWXNTRIARHQCLLHNGGLDCPLCFQNPKLSTRAKWAAMAKWGQNPQVGNESHHXVGPLPGQWVHLWFXAPLAAWPXXQVPFSPGTRTXQVLTGQGEERVRVVCDKTGNTLXRAGAGTQHRHRGXQDKALTQLRGN

SEQ ID NO: 209534 - protein, 186 aa, Triticum aestivum
  unsure (1)..(186): unsure at all Xaa locations
  Clone ID: PAT_TA_103952.pep
INLNMTHIHTASHNTLXLVTLHIADHTVTLITTTWTPPXXHTTWPQQLGHHNHXWPEHLRPGTFDPXISPKXXITLVEHLAFEXWNINSXXLXIHYHQPXXKFNQTPXPTTXAADSGANQTAXSTYSTTPIKXPRAPTTLGVWNQLASFSXNTLHQPXDXAFHXSTXIRFTIQANXSCXPRXTHSL

SEQ ID NO: 209535 - protein, 185 aa, Triticum aestivum
  unsure (1)..(185): unsure at all Xaa locations
  Clone ID: PAT_TA_103953.pep
ASSXXHILHPXSRSHLTTXDXAQRITHTLTTYHTXHLHILTXHPRGQGHILSGWSPHYFLMTHTTPQLVGXRDHIPFCXPPRDPXRTISLSTHLYXPHIRXSXIWWRDGSSESHFVCVAKLXFSPHTHCVPTGVMFXPHLXDASPSHPEATHFAPTIDLPGDCVVPTCVKSTRFILIDRWIYLVT

SEQ ID NO: 209536 - protein, 136 aa, Triticum aestivum
  unsure (1)..(136): unsure at all Xaa locations
  Clone ID: PAT_TA_103954.pep
SCACXXHVXTSHMCVLVAHGTHIPLATRVPPPDXMMXXCRESTRIRHTHDLASPVRVRXCVVXTGLAWAYCMPARNIPHFGYGLASPAXIGXYCXSQIEILPTLCYVNLLXLTTPSTRRNIXRCMLLFRMAISQYV

SEQ ID NO: 209537 - protein, 163 aa, Triticum aestivum
  unsure (1)..(163): unsure at all Xaa locations
  Clone ID: PAT_TA_103955.pep
PLLSRVRGVATSWARNNARRASNMMTYYIGTRVHGNYTSTTNHQGMYDHVVVDTSSXGQSQLFDWTREVXTPAEPWRRAXDRLARXWHSRAFDLTAYSRDXVGRHXQSSRLXPRTHVELPHDTPPQRTWVSPPGTHAYTTPAISSAGARQNVRXGTQWLRCTE

SEQ ID NO: 209538 - protein, 97 aa, Triticum aestivum
  unsure (1)..(97): unsure at all Xaa locations
  Clone ID: PAT_TA_103956.pep
LNSFMVFQLKHYRAXLSRRHYLDDLQPTIESSRAIWFTAEQRPVDSLIVHRSSKSLSCVKQFRTPHMVGSLTGTDTHYTNAQFHSRSVPALCXGLQP

SEQ ID NO: 209539 - protein, 104 aa, Triticum aestivum
  unsure (1)..(104): unsure at all Xaa locations
  Clone ID: PAT_TA_103957.pep
XPPHPLSNSXRRTPYXSLFFSSXLLXYEDSLNVXHXQSLGGXNLXXAXXLAIYRQVSYISKQKCVVVHLPPPHSPPRXSKSIPSXQXRGRCPVQYKXXXVFAFL

SEQ ID NO: 209540 - protein, 169 aa, Triticum aestivum
  unsure (1)..(169): unsure at all Xaa locations
  Clone ID: PAT_TA_103958.pep
SVDXPARTYFAQYTRSGHLLAXIPTWGDCPSVLXXXTAPILQMTISGPGTGVWTWRXXPTLDRSTRAPRCEPTKGXRRTGWRVTQTRTTXPQRRRVTYRLSXGTDPPSPNKLXRSRTAPRDGXRSGARKRXXKSQRRNRXDREEQRGGEKXPEKXLEPKKEKXTVEEQR

SEQ ID NO: 209541 - protein, 115 aa, Triticum aestivum
  unsure (1)..(115): unsure at all Xaa locations
  Clone ID: PAT_TA_103959.pep
KFPRVXVXPSXPPLGVXSYTPSRKYLKXXNPKXQPALAAXSWEDNSRGSFPEPGSTRNNXHHRRLECSISSNPITRHCVLCGXLHXATIDXRXGTATHVLTRTLTTLHASPQGDF

SEQ ID NO: 209542 - protein, 117 aa, Triticum aestivum
  unsure (1)..(117): unsure at all Xaa locations
  Clone ID: PAT_TA_103960.pep
RHRWLVFVGAVSYLACQRLRPAKVFCPVLRLVEIATSNLCLSSSSSFLRVCVCARAWMHTGFVLLDTIILYVKKIXMLQRCYYELNLYHMINTPELSGSHYSWRICTPCVVTRMPRM

SEQ ID NO: 209543 - protein, 182 aa, Triticum aestivum
  unsure (1)..(182): unsure at all Xaa locations
  Clone ID: PAT_TA_103961.pep
XXTTGHHRGVCSDCTXMRGRGFQXSQVNLVHVRTPSSQXXGSAVPVGTQTGTARFAXLPGWVHKGGSAIQSQGPATRPRRASVYGRGIRRACGSQGYHRTQTAXAACLFXLXVNIVPSGPVDQRRSLQQPQAGGTIGDRVSWSSVCQPEGVAGGRSGAAPYSTRADSAGRSSVGDSETQMTI

SEQ ID NO: 209544 - protein, 202 aa, Triticum aestivum
  unsure (1)..(202): unsure at all Xaa locations
  Clone ID: PAT_TA_103962.pep
RLRPXXPGXTADMLXVTPQFQWAYRAILGSDDRRVSVCAVKPEGETEWPNQAXCILRRLIRDQAKAQIFPGKCARESKWGRNYPSXQCAKISXPLPTHYPPRQRXPCHIYGNPCPPSTKGVPPTRFPWLLWINXNPTPTMPQIRSSTFYSVFTPICFKVLWGGSSRRSVALIPRASVTTQRVRRRLRRPGCGYRAVALXLTR

SEQ ID NO: 209545 - protein, 113 aa, Triticum aestivum
  unsure (1)..(113): unsure at all Xaa locations
  Clone ID: PAT_TA_103963.pep
XAIPHERLITTQTDAGXGXAHTHTSWLXSRVAQGGVXTRPRGXLRGAFRXCXNWLERFXPRKDFXHRPRRRGLMRGHSDDNCVDEEKAMVVXSPNDHGXXDFXVXKLYAXRXL

SEQ ID NO: 209546 - protein, 173 aa, Triticum aestivum
  unsure (1)..(173): unsure at all Xaa locations
  Clone ID: PAT_TA_103964.pep
PGLPCVXCCLGPPPRPSFRGFGVVPSFPTIPRAHXPGPAFGIRSRPNSTVSLPXSPMDTAGFCFLAPRAFLGLFQAAPATGGAXTGPLAPVPPAPRVRRPFPACPAVXSSSXPGGLSGRFSRSPAHVSDPTGGXLSCLGLCYRWDAXEPRSLFGYGGMDSXRTNSLTGPADLE

SEQ ID NO: 209547 - protein, 176 aa, Triticum aestivum
  unsure (1)..(176): unsure at all Xaa locations
  Clone ID: PAT_TA_103965.pep
IGLEHSRPVXRAFESQGRHXRDRTGEQVVPEADRWPADRKGXWXASNVRLDCTCXXWASTHXAGRGRVRXGNERTRGXXXXRXXRSGDSRXXPXWNIHGPRGRDTLSVXMAEXKDERTXXATVDMXVHVGSQKRPCTIRGETKPNXSPXPRHMGTHVXIVXFSSVSFFFXXFQRXK

SEQ ID NO: 209548 - protein, 179 aa, Triticum aestivum
  unsure (1)..(179): unsure at all Xaa locations
  Clone ID: PAT_TA_103966.pep
PSPRLGXALSPCXLGCXDRTGWSVXXLVGCXYADLYXAVPTRGWCXCCVGAXHAXSPCCVSRACVVVPSWPCHSGWCVXLLCXKVSALYGLXLGPRGYPYCXXXPFLFXFDCPGPLPVAXXXTFTDXCXXGRAPSLXAAGCLXXNPKGAPFXFVWFSAGKRPLHCWSXSGRXCYRSCGX

SEQ ID NO: 209549 - protein, 87 aa, Triticum aestivum
  unsure (1)..(87): unsure at all Xaa locations
  Clone ID: PAT_TA_103967.pep
MPSTLPGITTPKEHTWLMFPGSDIFARVPFHVAHTVLDKIKSIWTTTPEAASFVKEKSFAISEKGALADXISPGIVRSLVSLADKPK

SEQ ID NO: 209550 - protein, 183 aa, Triticum aestivum
  unsure (1)..(183): unsure at all Xaa locations
  Clone ID: PAT_TA_103968.pep
GGCEXNVXVFXGLGQNCGESYXSXXTLXIXXWGHAPXXSRSEYXXRSEGSNGLEVXSSSPXXLAXIXLDLVXHQRVNPIIXLXGTKXGGWXXCVHVIXXXAERCLQHHYPXVLSVALXWSQLARHXAVGGNXLPXRVPSVXSNXNRVYQHHLXGNRSNRDQWAVRHSVGXVVAXNRNGLXNQG

SEQ ID NO: 209551 - protein, 114 aa, Triticum aestivum
  unsure (1)..(114): unsure at all Xaa locations
  Clone ID: PAT_TA_103969.pep
AAPVREWFPGHRVTVLLNAQAMWVKSSNAPVNTVGXPPVIRRGVXCRVXLNSYDCVIRPHATHFXPSXGDLIFIGRQYATGSAMRTPHXQKCAKXXWXXRQXALGGKACRVRFC

SEQ ID NO: 209552 - protein, 145 aa, Triticum aestivum
  unsure (1)..(145): unsure at all Xaa locations
  Clone ID: PAT_TA_103970.pep
ARVTFFSLPHRGLCRCPLLRTGSPXGRHXTARWSXGDPLVSXNPAAGXCXRALWTTWASAPSXGANSHPTXXPTSXVRWGPCSNAAVPDXXKARNPLXRRDXTPSTVPRAIPLRGVHXHRYCEHRXRSRXPVTGDXRXTSLLHCT

SEQ ID NO: 209553 - protein, 170 aa, Triticum aestivum
  Clone ID: PAT_TA_103971.pep
PIRSAPYSTFSAAKKRCVGYIRRPPAGAAAGSNLQRHDPLRPCLASPTCSLIRGSKFFLHACEVRYCSSAPSSCMCSSLCFCRAATEDPTEGGDPSSTYLSRRALQATAACTAGNGGMHCRQQQHALQAPMACTTGSSSSVHSRQQQRAVRRPCVCSPRRCLISVCFAHN

SEQ ID NO: 209554 - protein, 245 aa, Triticum aestivum
  unsure (1)..(245): unsure at all Xaa locations
  Clone ID: PAT_TA_103972.pep
VFFLLFFCLCFVLXLVFFFFXSFYLLVMEXXEKGSGRXRXAXXRAPVRSCVHACHAPHCPLGRYPSVGGPWYFTXTRGAXSLCPXLDFTTSERRSVFPLLSCXFXGDXPDPFVLLXGLFFVQPDRXWPLLCPYLAVPTCPNLAVLPYWPAVLVLPCVVPPVTXSSAIVQIAPPSDEXALDHLHSQXLLPFVAIVGXLTKPMVRMRHKLPLWGQPVNPSLQACQLSVXGRRVAKGRXTRATRGSTE

SEQ ID NO: 209555 - protein, 145 aa, Triticum aestivum
  unsure (1)..(145): unsure at all Xaa locations
  Clone ID: PAT_TA_103973.pep
YKKVWCIQTDDNQLTNQLARQRLSTATNXXRTVQHERPTXRRCXPPLESRWGGXKXXNGVVPLTPHSTNXXXTEATPXDNXARTXHQHDRTPTXPSNRNNPAXQXXKTNRTXQSXRTKNXXHXTXXADXXKEXXXKXKKDKRKXP

SEQ ID NO: 209556 - protein, 187 aa, Triticum aestivum
  unsure (1)..(187): unsure at all Xaa locations
  Clone ID: PAT_TA_103974.pep
WSLEMIVKIPRKRKGHRDGPSRIILLARXVRGHWXWLPRIERENKQXEXPLTLASXRXCVPPGSDSVWRISLAYLYNTFTTCXQRGSCALRSFCYKGYFSTLGLQYTLXHWVXXGKYLYVSVSSTSPDVINQHQRXKIXIGXWVDSHQVEXVDFLMTFLEEVRISKLGSMXIRPXWFRSSPLRSCIW

SEQ ID NO: 209557 - protein, 144 aa, Triticum aestivum
  unsure (1)..(144): unsure at all Xaa locations
  Clone ID: PAT_TA_103975.pep
XQXPXXCTPXVXVARGRXXXQXWSKAXVQERXRXSSGXVGRSXXLVHILVXXVKVXGRWRCGGVLIILWXXXVDVXNVXNLLXLXXVNSSSXEFRSRXVAQYGXCLTXFXXLVQQLFIXCHXXVITCNQFQMGVVGPXKRIHTK

SEQ ID NO: 209558 - protein, 77 aa, Triticum aestivum
  unsure (1)..(77): unsure at all Xaa locations
  Clone ID: PAT_TA_103976.pep
CFSXSDIDFHDILITXSSLLXIIXDTCLVXILLTXHPHCFXLLAHXFGSLXMLVVXXXXNKXXVVXXPXPHXVGAPF

SEQ ID NO: 209559 - protein, 119 aa, Triticum aestivum
  unsure (1)..(119): unsure at all Xaa locations
  Clone ID: PAT_TA_103977.pep
RGAAGHPGRRQLVTGSMSIVHVEDVCRAEVFVAVNESLXGRYICCSYNTTVVQISRLLAEKFPRYNVNAERFVGCPTEPRVCMSYQKLVGEGFIFKHESLGEIFDDVVEYGSTPGILRD

SEQ ID NO: 209560 - protein, 112 aa, Triticum aestivum
  unsure (1)..(112): unsure at all Xaa locations
  Clone ID: PAT_TA_103978.pep
NYGSXPGCRNSAPAAPSFFTSRRTPRRRRSSSSTRFTRARTPPPGPPAASTPMRCPVKGGTRRLSSPSSCRGCSPPSLFSPDNRLDAMHIQIPERPTYWKVYVRMIVLGWAA

SEQ ID NO: 209561 - protein, 74 aa, Triticum aestivum
  unsure (1)..(74): unsure at all Xaa locations
  Clone ID: PAT_TA_103979.pep
VYCSNYXXSINALLCSYNVXXSSRTRSQISXSSXIDLIYYXIXXFXKCGGGGPHXKERNPTKRGGLAXNRWXXV

SEQ ID NO: 209562 - protein, 138 aa, Triticum aestivum
  unsure (1)..(138): unsure at all Xaa locations
  Clone ID: PAT_TA_103980.pep
YXPQTQPQPPPPPQLHXXSTSPXQIKXXLPPXXHPXLHLXXXXXKTXTFXPPLSLLSXVNXXDGTLCWLIFHCHPPPSAXLXSTPAXLXLXXNPCTPTXHPHGLHXACNNIHISTXCFIXPQIXMCHXIATHGGTTXX

SEQ ID NO: 209563 - protein, 62 aa, Triticum aestivum
  unsure (1)..(62): unsure at all Xaa locations
  Clone ID: PAT_TA_103981.pep
TTHNTHNQXHTGHTVGPVTANKHSSGYVSCDSVSXCDRTTMWYHTKQSXTAQSSWVKGXERW

SEQ ID NO: 209564 - protein, 83 aa, Triticum aestivum
  unsure (1)..(83): unsure at all Xaa locations
  Clone ID: PAT_TA_103982.pep
LLQVRITFTRGLIYTRLIPTSSHQRPHAQHTEWKNRHQIVYFCIPDNEKCNSGYLLSQYIKIACLSQQITLCPRLQYRQLQXG

SEQ ID NO: 209565 - protein, 106 aa, Triticum aestivum
  unsure (1)..(106): unsure at all Xaa locations
  Clone ID: PAT_TA_103983.pep
XGGNWVMIRGXASASTVXGSPHIKWXXRIXQSLEVPXXNXRLLEXHLVLCVADALLLPIREGEPHVPTFPSIVLMLRVVLXNXVFGCFFHECIARTFXEVXTICXS

SEQ ID NO: 209566 - protein, 98 aa, Triticum aestivum
  unsure (1)..(98): unsure at all Xaa locations
  Clone ID: PAT_TA_103984.pep
XYLVVXCTHTGXGQRXVQGXQYGGFSSGQPGXHYNEXMCXWXRGTXVQTAHKCAGXSVQAEQTADADSKCCXCTTHAAQHTHSGLGWXCMAVSXQCXV

SEQ ID NO: 209567 - protein, 117 aa, Triticum aestivum
  unsure (1)..(117): unsure at all Xaa locations
  Clone ID: PAT_TA_103985.pep
VXWSPRVNSKCQRVYXEEXVSPARRQXVSVIRXVLGQVSVGVXTTLHKGLNRXXVSVCEYPAHSVXYIKPGSEPNVXNTCXRQGLVCAFLMIHTXTXDGVTDEVCWLQPQCDGYQTL

SEQ ID NO: 209568 - protein, 145 aa, Triticum aestivum
  unsure (1)..(145): unsure at all Xaa locations
  Clone ID: PAT_TA_103986.pep
ILRHTKQMHFIKSGNGLLHKWTGLHFLCLSANKFVQDTASTLTGWTAHPAAAQRRPMRTAGXRPNERLVMRPRCSRRATVVDLAAERAAARAASLQLNRIRSPRVLHDTSNPTVYCTRSRDALHQHGPCCSSCGGGQRAGSPVGG

SEQ ID NO: 209569 - protein, 144 aa, Triticum aestivum
  unsure (1)..(144): unsure at all Xaa locations
  Clone ID: PAT_TA_103987.pep
XQKQXKKTAIXNXHHHSGLHLWCLLXPPDRMGXXLSPIAPVXXSXRLTTVSPHNHACTTHWCXFCNXTPWLMSSHNVSXXHHTTPDTCVHLWHTCXTLWQAHCHTHCTCLCAHXPQPTHHTPSTWXXPCASXXATRHXHTHTPF

SEQ ID NO: 209570 - protein, 113 aa, Triticum aestivum
  unsure (1)..(113): unsure at all Xaa locations
  Clone ID: PAT_TA_103988.pep
PYLTEALPPSIMMIDQEMPGFISSEALLHGVETRTSSPLPISRHQETYESTSLXGLYPIGEGAGYAXGGIVSAAVDGMYCGFALAKPRFXLFAGDIEAIFGQAPKANHGSVKY

SEQ ID NO: 209571 - protein, 94 aa, Triticum aestivum
  unsure (1)..(94): unsure at all Xaa locations
  Clone ID: PAT_TA_103989.pep
SXREREXESTGPHMLQPXXCYAXXVDLQTTMITMVFCXRQNAYTYXVVFATXCVNXXXVCYSFXRPTTTMLVVFANNHWMCGEQNGLVXXXMXR

SEQ ID NO: 209572 - protein, 116 aa, Triticum aestivum
  unsure (1)..(116): unsure at all Xaa locations
  Clone ID: PAT_TA_103990.pep
GCTFXGPRSPLTGXXRALYVXCSCXEKHHHARFISPQSVXGCQLXVHGHPPRXRTAGSXRQXGPGXVHRFPXSHDXIRTAIESXRXGQRTAXPTTKPCQVTQRRVGQQXFATXXQX

SEQ ID NO: 209573 - protein, 98 aa, Triticum aestivum
  unsure (1)..(98): unsure at all Xaa locations
  Clone ID: PAT_TA_103991.pep
IKKEXETXXTQXXSXXSTRXWWQHXITTSCRGDPANHXMIXSCPDQRHPASLMCGVQQXIPLCSSAWSNPHSSSPKGSPHISLQLVGHSAPATTQGAL

SEQ ID NO: 209574 - protein, 202 aa, Triticum aestivum
  unsure (1)..(202): unsure at all Xaa locations
  Clone ID: PAT_TA_103992.pep
TDRQSIHIIXCXTNIIIIICXXXCATXASDPLIDMIPXSXXXCASXIEPXXRAWCLXKXDPHXXQXSHIVSHXIIXXITPYHNFCXXISSVNTPVTVXGTVPPXVKSAXSGCCLTRSLHRXHXQVIHCNCXAXGXVSLSXXSICXVXXXYSMXPFVPHIGYRTNXXAKGPDLWPWNTNSLDXYLXRRIWGDYLPRXFPHXDL

SEQ ID NO: 209575 - protein, 142 aa, Triticum aestivum
  unsure (1)..(142): unsure at all Xaa locations
  Clone ID: PAT_TA_103993.pep
MGRDXWKKLXLGDTRRVYVINLVTLMGILGMIENLLSSVLTXADSPLSXXXTXCDFXEASXISXSKPHVSPGLGQHTPLDARLLLAGXSPQRDXLMGRYSLRSEMGTRNLYCMVPPLXTEPPRDGKICXMRLCASXHSLLAE

SEQ ID NO: 209576 - protein, 195 aa, Triticum aestivum
  unsure (1)..(195): unsure at all Xaa locations
  Clone ID: PAT_TA_103994.pep
RXPQVVVWWFSNRAVXVSSFRPTSSHTIHTXTHNPTPQLNSILIPYLSTSVLQHNPTPVESPPKWSSPLLSPDTALLDKPHTHYXFPTIHRGHQGPLVCPPTTVXHSRHIYPHTGPPQGASRLCPQRSDILNSAPPQCLRGPIVKGEPLARHTQRPRQTSAIWCPNVVIIXPLTFIATPHVGLPIFGHISLXVIL

SEQ ID NO: 209577 - protein, 205 aa, Triticum aestivum
  unsure (1)..(205): unsure at all Xaa locations
  Clone ID: PAT_TA_103995.pep
QPSSPEASTCIKXCPSIKNHIGIXASPTXALSXXIXSHIHIHLLHTXLQWIXHIPILTSCVQFPHFPXPGVSWARRATRYRXRXQXHHXLAXXPHGHTHGTICRRXXIWXNLSPAXXTTWWHLNLAQCXHNCGYTQXLAXWPXQHTGTLATXQXTQXRVYLVAXMTTTXCGGPTMAAIRLWVPKDXPXVADNVSPXTRSXNQWXY

SEQ ID NO: 209578 - protein, 105 aa, Triticum aestivum
  unsure (1)..(105): unsure at all Xaa locations
  Clone ID: PAT_TA_103996.pep
MFCQGXPPCFARSPFVAAATLMDYLDGLRLDQXETMLFSPMSVTHGFVGXRSASSPKCWSTHGGYPPNAMNHGGTGQNGNCNVLLPRSSEHRMAQRRAGXYLRSV

SEQ ID NO: 209579 - protein, 123 aa, Triticum aestivum
  unsure (1)..(123): unsure at all Xaa locations
  Clone ID: PAT_TA_103997.pep
WIPRLARNSAPATASQIVRGDGGHRRTTIEDLVVDLLLLGTIQREVTKRKNFRSXPAAQVGEGTPMAATQLGGGARRLREGPARLLRDDAGRLLHHGGWVLGPATRRRLSLGAEENRGRKTGG

SEQ ID NO: 209580 - protein, 214 aa, Triticum aestivum
  unsure (1)..(214): unsure at all Xaa locations
  Clone ID: PAT_TA_103998.pep
VHAXTXVLYTSHVHEDSAVSHRGXVLPSKGCGYIPGGEHVVPPTVGXRHKGIHINHLPTDLXITTGFACGXQRSKRHVFTPVILSRRAFXKPSGXRGRFFQQFXGPWXQGRXKSHRRXVPPNXSLIQRGEQQXQWGKGVRAKKMHVSVAXXIXLGRSHHGRLTQRLGTTSRXESAWDRFAFPSCXRXRRRXGXNTKTHKHTNKKHNTQHNTKNT

SEQ ID NO: 209581 - protein, 61 aa, Triticum aestivum
  unsure (1)..(61): unsure at all Xaa locations
  Clone ID: PAT_TA_103999.pep
TSEEVTXAANADVRMLMSNVMTKWEGSQSXYGVPXRQQRXCHNTTHVVTKCVYQLMSQFXP

SEQ ID NO: 209582 - protein, 195 aa, Triticum aestivum
  unsure (1)..(195): unsure at all Xaa locations
  Clone ID: PAT_TA_104000.pep
PXTWLPHHTDDRSFPCLSDVDTTGTXGVSVCRPSWXQLNRHLAVGTGQVXQCRAVHKYCWQXQXRLLSYQLCDMXVVQSVCXVAHVHCVLTQAFHLGKCRGNRVFASCNVLIKAXXCIWTEFDIGTXVRDNAVHXQHNHTXXQXSTWSXPPHKGYGYLXWVSSLGNHXNSIKEQWKQVWAAYDMFTTXKFSKSWX

SEQ ID NO: 209583 - protein, 203 aa, Triticum aestivum
  unsure (1)..(203): unsure at all Xaa locations
  Clone ID: PAT_TA_104001.pep
WPRVGHSGKYNGHPCLMYQCDLFPRMSTLACGHTSRHKRTIQFXVDWVHHTGFKCGINYQPPGVVTRQVTIAKVQRAVCMISXNSTSVXEVFIXSIDHKFDXIMYAKQCTSSHWYVGEGMEEGRVHLRXSEDLAALEKDYEEVGAEFDEGEDGDRGRRVLEPASWCFPKACCLLSHDLPEWLYLLSVCLNLCFVVFVLQPVVL

SEQ ID NO: 209584 - protein, 143 aa, Triticum aestivum
  unsure (1)..(143): unsure at all Xaa locations
  Clone ID: PAT_TA_104002.pep
IQVIREVWVRALPIMGVFXNPCFTTQQAXVSTRRWQVSQLGLSVTTCXARGNVITTCXCIRHAQFTHVDIQTVHQHRHIVGAAGYGWVSQGCNHIHSQEPGQQQNRSAAVTADTARHSGTQPGITCITHCICFAGRRREKGGW

SEQ ID NO: 209585 - protein, 120 aa, Triticum aestivum
  unsure (1)..(120): unsure at all Xaa locations
  Clone ID: PAT_TA_104003.pep
SLLXFLNFCVXLCVVLLYIXLLFIVSLLCFFLYVCSVCXCTPXTHLLYDARGGTHTHTXYTHTXCTLTRVIQXTIXHTYKXAQXHHGXHTLLCSSXXQPHTTXTQTTVXCYXTTPVEXLC

SEQ ID NO: 209586 - protein, 109 aa, Triticum aestivum
  unsure (1)..(109): unsure at all Xaa locations
  Clone ID: PAT_TA_104004.pep
TNRSNCXVCTVCRXCIXLXEYPXVXSTDTTLPXTPHXGTAHVFAXXHNXLCFSHLAPANCXXVKXRTCPFPGLHHTIGPLAXXYXPQGQHLXXXGSTYAXTHGXWSVAX

SEQ ID NO: 209587 - protein, 108 aa, Triticum aestivum
  Clone ID: PAT_TA_104005.pep
PCPLLVRRSTCRRLRSRSSEFLDGTSCAPLPRVADPWQQQREGPGSYFVQKGKININVLNQGTIELCHYDSQLHFCSSKCTYDLLLVTDAQMVEHVWSHLQDTRGRAG

SEQ ID NO: 209588 - protein, 79 aa, Triticum aestivum
  unsure (1)..(79): unsure at all Xaa locations
  Clone ID: PAT_TA_104006.pep
TTMSPSVVCITGLHFSXPSSALVRLHPMMVSSGMWTSGMLTVGVVAGGMVVGVAGKWXVLVAGISCCWGCRKWLVVVAG

SEQ ID NO: 209589 - protein, 82 aa, Triticum aestivum
  unsure (1)..(82): unsure at all Xaa locations
  Clone ID: PAT_TA_104007.pep
MTMITPSSKLTLXKGNKSWSSTAVAAALELVDPPGCRNSARERTSLEFFFFFLSLQDSVNPVLSVQFVEHRSSMSLWFDRGW

SEQ ID NO: 209590 - protein, 155 aa, Triticum aestivum
  unsure (1)..(155): unsure at all Xaa locations
  Clone ID: PAT_TA_104008.pep
XFFFFFFFFFFFFFFFFFXKXNXXKXXVXIVFXXKYXQQMWELDVXDEHLAVXYXTXSYXPHXXIXFTXSQIMXFCPXLYXLGYXTLLCXXHHMFYILIPPXXLLSLPVCATLSKSPHRQQPHVXCDTXLLXXCXHXVGXLXXXDSGPHTIXYFX

SEQ ID NO: 209591 - protein, 300 aa, Triticum aestivum
  unsure (1)..(300): unsure at all Xaa locations
  Clone ID: PAT_TA_104009.pep
VIRXRDRYPQXRELDNXSSPIAXRAARXQLRDDPDXLALDXAQXSPVSIARXRPLAPAQPHKPSRXXVLAPRXXXPPXSSRACEXXPXTKDSTKKLSARXRQXXTFQNRXRLXKHEXPXRXXPSXTXXXXXXNXQPXXQRXGXPRXEHXXXGAXSEXDNHXXPGHXQPXQPXXHPLRTXXXPTXPXXXXPEXSDXXXXXTXXHGXPRXRXTXPDXXTTPQHXQRXXPPTXXTXXXHXXDXXXXXPAXTTXXNEXRPPXXXXQXTXXXXXAXXXXCXXTXXXQXXXPXTQPQPEXXXXXXT

SEQ ID NO: 209592 - protein, 330 aa, Triticum aestivum
  unsure (1)..(330): unsure at all Xaa locations
  Clone ID: PAT_TA_104010.pep
LXFIXLIXXIXIFXYFLXIDIIIYYXXIIKRGEXNIKKXPXRPTQSXXXXNRAHTDXHXPPQTHKXXQRCXXTXXSVXYTPLIXXVXXTEGTRXKHTPXHTHTVSTHTXVXVTXTSPHTPVHXPRDNXXDNTPHTXAPHTTQDXCXNXLXXPXQXAQHXRAXHTQSXXCVDXTHTHRXAPLLAQXRHXRXTQRXLYPRXLHXXHAXCAEXRPXPXXRSXAPXXTYEPXRYFXXHXPXCLIAPRQDXSXALIXWLLCPLFXCCXYTXKKIXPXSXDXPXMXXPFSXCLXXSFLLLEXPXSNKXXLPHKKVSHPXXXMTHPRLXCRHXKSPV

SEQ ID NO: 209593 - protein, 111 aa, Triticum aestivum
  unsure (1)..(111): unsure at all Xaa locations
  Clone ID: PAT_TA_104011.pep
GNXXTXRVXGXSHYTPXXXRXHXNXSVXRTTXXCXGXTPXXIQXPPXLSXXXXTAXLXXXSTXFKXQNXTARGXXQSXRTIRXXQYXXXXGXXRXHPTTXRLXXALXNPXV

SEQ ID NO: 209594 - protein, 108 aa, Triticum aestivum
  unsure (1)..(108): unsure at all Xaa locations
  Clone ID: PAT_TA_104012.pep
XGIXPVFXXVFRGXAFSXXPXXPPLLRVXVSRLLAFXFXXGLXXXXXLXXXVXPXVSXXPXXXSGFSXGXXXLXIRRTRXXXGXXVLCRRHSLRGSXXVDXCDSLAQP

SEQ ID NO: 209595 - protein, 88 aa, Triticum aestivum
  unsure (1)..(88): unsure at all Xaa locations
  Clone ID: PAT_TA_104013.pep
FXVXGIXWDXGYXXGSKGSFXSTCXTRVSPLXRXIXXQLXWXTXIYSXRVXQTXXEIXRIXTSNCLYLCVYKVIPQFSHRVXCVFSET

SEQ ID NO: 209596 - protein, 104 aa, Triticum aestivum
  unsure (1)..(104): unsure at all Xaa locations
  Clone ID: PAT_TA_104014.pep
XXTPXXFXXXHKLVPRXXXGCXITXPXXXXXXXNXGGTXFQXXRSXXXPXFPTKXXLIXXNTTTXRRDIXPHTVXXKLKIXXXSPXTXKFNNETNLDGXLXLRX

SEQ ID NO: 209597 - protein, 193 aa, Triticum aestivum
  unsure (1)..(193): unsure at all Xaa locations
  Clone ID: PAT_TA_104015.pep
FFLXFFFFFFFFXFSLTHSAMCATLPLQCSXHTACSPHXSTXSXAIXXXHTPKQLHTLCAXXXMSHXAHXXHSRXXSHTYTPLXHTTXCAYVXHYITXHTXYSCRVLALXAHTXIVXNKHXXACALSXTFVAAPSTHICSXXTTTXQHXXCXCCSXPLXWRSXXCCAHXXXLCXXXXXRTXVCGNNTLLTTXL

SEQ ID NO: 209598 - protein, 165 aa, Triticum aestivum
  unsure (1)..(165): unsure at all Xaa locations
  Clone ID: PAT_TA_104016.pep
EILGARSMRDQGDNYRSSISECKHVLSMDNRATEGQWAQRQSQLYSYVTXASTXSLQSGDQLDXRHQAHNMCRXMRDSTVMTRHPGXDFKRMCKYGDAIKGRRRASGHSTQDSXRRAAPDSAXXXQLLKTHSRAGSVRVLSRIVYVSDARRHERVPLLLPGVSQX

SEQ ID NO: 209599 - protein, 155 aa, Triticum aestivum
  unsure (1)..(155): unsure at all Xaa locations
  Clone ID: PAT_TA_104017.pep
XRGXXXXXXITXLELXXXKXXVXXXXXXXXXVTQPXXKXXXXXQXTETRXSXXXXXXXXXXIXXGWKSXLXXEXMXXRXTATQXXIXHVSSXRXXXXPXXXXXXXXRRXXXYXXXYQXXXXADEXXXXTXXXKXXXKXXXXXXXXXLXXXXXPXX

SEQ ID NO: 209600 - protein, 46 aa, Triticum aestivum
  unsure (1)..(46): unsure at all Xaa locations
  Clone ID: PAT_TA_104018.pep
YYLFITYITXLLGXFIXTXVIYLLXFSYYLIITLXGLYLILXGIRA

SEQ ID NO: 209601 - protein, 297 aa, Triticum aestivum
  unsure (1)..(297): unsure at all Xaa locations
  Clone ID: PAT_TA_104019.pep
LGSXSITHLHTHAPLHTAHVSHCXTPPHXVPTPSPLCTPXPHPQXTXTHAHMCVAPRXSHXCTXTXQSHTHSHTLXKXTCVHHHXXPXHYTXHPHLSSXXPNAAHITXQXNSKQCAPPCAHCFVLPXWLXHXTXSQQXSIIXXSXQLXYXXTLNYPPXLLVXMLCQPXLAYXAYXXXXTXPGXLXPIXFXDXNXPXFLRXLWXHPLWXXMVXLIXFDIVVAMIFRQAPIIFXEPEXWXLCHIIPXXLXFXLTGXPTXLSFLXXCXVLLXXPLPYXVXNTLPXLXATXXXGPIWQGXX

SEQ ID NO: 209602 - protein, 331 aa, Triticum aestivum
  unsure (1)..(331): unsure at all Xaa locations
  Clone ID: PAT_TA_104020.pep
XXQXEXXXTXXLQXQHXXTXSRXXXILXXYHPXEXXXPASSQXAXXXXTXSPDXKAXXSKXXEAXXXKVRXQPYKQPXNHXPXWXXQSQAXXAXGRXXXXNARTRVXXKXNQTXXQVQEGKPPPSXXVXPTQXKPTQXIQTXXCDRTPKQPXXXQHKXPLXXQXNEQAPAWDSXPAQXQXXXXPDPVRTXRPTPGYXPPXTXXXPNTYPAPXQXXNSTXAQSNPXQGXGQXGXQXXGTXXEYRRRXSXDRXTVXRANHQXCRGDHFQNXPXPSRGEPRPXPXPPXXNXXXLXXQSTNXDPEXEHPXXPRRTWIQKQXTQXXXTXRPXTMEK

SEQ ID NO: 209603 - protein, 168 aa, Triticum aestivum
  unsure (1)..(168): unsure at all Xaa locations
  Clone ID: PAT_TA_104021.pep
XAMAKCKPQLDPHVTASQESXSTAPXYIXQXXCXXXGFVGGXSIRQNLEPKARLRXCCGKXVYXSXSHXVVIXEIIGLXQTQXXCYTIVXXXPTCXTLHPKPSXDGLAQVLXXXXXXRHVXYVXVXSXSEIQTISXGXLMLHKKYCIELENLTRMLXVMLSLXAXKLX

SEQ ID NO: 209604 - protein, 144 aa, Triticum aestivum
  unsure (1)..(144): unsure at all Xaa locations
  Clone ID: PAT_TA_104022.pep
XCFXXXVXXXLFXXLXXXQXFXXXXXXXXXRXXXXXLXXXXXLXXXXXXLXXXXRKPXTXQXXXXXXGXXXXDXLRXTKWXXSXXVXXXLCRXCXXXTLXMXLLMWXNXXXQXDENXXSDVXXXEQXXKXRWXWXXNXXEQEXG

SEQ ID NO: 209605 - protein, 222 aa, Triticum aestivum
  unsure (1)..(222): unsure at all Xaa locations
  Clone ID: PAT_TA_104023.pep
ILFXGPYXXFXGINRNXFSXPISMXVQLXFXYXXAIPXXXXXXNVCXCIHKXXNSTSXDLXLXQIQXFHQVCXQXPRIXTXXXIFXXXVKEFNSPVQIXPXXRAXXPNGXDXLFLKDHYLAXTXIAYQXLXINHXFKWPPQERXWVLHRFYQXAITXWQXDPXAQVXSXXLFAGVXPSGSKVAIFHXXXTXXKYXLXXESXXRXNXXAXFXRIFTXXTHITX

SEQ ID NO: 209606 - protein, 193 aa, Triticum aestivum
  unsure (1)..(193): unsure at all Xaa locations
  Clone ID: PAT_TA_104024.pep
WIPRLQGFGTRRRMPEPGTDAYAELERDPXRAFIHTITSQIQTIIGISLLEVLSKHSSDELYLGQRDTPEWTSDPKALEVFKRFSERLVEIESKVVGMNHDPQGRRXXGXHRQGHPQQHLHLSMVHRSFVSSTPTTVRARPNKERATRSPRTGTCRETSAVCVTLCVSLCQQLFDHGVFYLCVAVGRVHLSYA

SEQ ID NO: 209607 - protein, 113 aa, Triticum aestivum
  unsure (1)..(113): unsure at all Xaa locations
  Clone ID: PAT_TA_104025.pep
FFFFFFFFFXFXFFFFXFFFFFXFFXFFIXFXLRCICVHIVIIHNHKHTKTKPIQPPRRMKNRHNTTLRSSTYPQDHAQLLHTTVVPNHVVQATESINPNSVAEILLHKDSSP

SEQ ID NO: 209608 - protein, 136 aa, Triticum aestivum
  unsure (1)..(136): unsure at all Xaa locations
  Clone ID: PAT_TA_104026.pep
GFQKKSGQMSKNNXWRKGXINXAHAEXRGLXRNNQSNXXXPKXXVXYWPDXXSSPTTXLLDTTPHXPXXTXXAXTSQXGDHDXXQPPTXGGXNXQQXRQTXAXCHXKVGXHTSQXXTGXPXXNXIXPPPWPPTVGX

SEQ ID NO: 209609 - protein, 89 aa, Triticum aestivum
  unsure (1)..(89): unsure at all Xaa locations
  Clone ID: PAT_TA_104027.pep
VQXYVCVXMPFDVSPSXQALPLXHXARXXIXXXXFETRRAAVXDXALSRLXLRCXIXSVASRGFQTSSTSSLXXFVXLGFDARFXLIDI

SEQ ID NO: 209610 - protein, 155 aa, Triticum aestivum
  unsure (1)..(155): unsure at all Xaa locations
  Clone ID: PAT_TA_104028.pep
CVXICMTXXXXXTDXXWXMXGIVYALVXVNXRHXLDCXLXTRLGXXXXYLQDDQXXYXXXHXPLYPWXCSPCGDWATDPFCXXSXQXWXCRPHXRXXSQXAXGHTPKVXSXXRTLTPRCWXILDNXQRXGXXRVGAPXHXXXPRXRXKXVPGGAG

SEQ ID NO: 209611 - protein, 145 aa, Triticum aestivum
  unsure (1)..(145): unsure at all Xaa locations
  Clone ID: PAT_TA_104029.pep
XSXXXXLXXGNXLXFKLKFXNTKSNXXXXSQTHRHXXNXQXXDQTHXHTCDIYLYXIXYXCSSHTLCTLVPTHXPXXSTLATLXXXXXXXXXXXLLQYHPPLXXQYALATVXPHPSHXXCCLXVPGGTYXPXLDXPXFNTLEHPX

SEQ ID NO: 209612 - protein, 237 aa, Triticum aestivum
  unsure (1)..(237): unsure at all Xaa locations
  Clone ID: PAT_TA_104030.pep
MKTLLILTILAXMAITICAPANIHXSDPLRWPXCTNCATTNQPXSPMLQPXPLIPAXQQXQXFPQPQQTFPXSXPNXQVPQPQXTTXXPFLXPQQPFPQQPQQPFPQTQQPQQPFPQQPQQPFPQTQQPQQPFPQQXQQPFPQTSXKPQQPXSPGSXXXXXQPXPQPQQQLPAAPTTCQXSFPQQPRSFIQXSLQHXXXNPCXXILLQQLPVIDVNTILVQIILKKQIDKVIAKQCK

SEQ ID NO: 209613 - protein, 159 aa, Triticum aestivum
  unsure (1)..(159): unsure at all Xaa locations
  Clone ID: PAT_TA_104031.pep
MHNDWXXACNEEGAXEGSVVHLRVXXASTGNTGVHTLPHVGQECTMXANCXRXXPCMQAQADVXXXXXEAVRXWMWGMIVQXSXQAGSRRGXQRGAGTHSRHSTGTSGAGRALGTGAQAQFXRXLLHRLRGLVRSGGQAXGMGWSAHTGGCCEGLAGAG

SEQ ID NO: 209614 - protein, 154 aa, Triticum aestivum
  unsure (1)..(154): unsure at all Xaa locations
  Clone ID: PAT_TA_104032.pep
MIHHPLNFAPHTHSCLLLVTPHTLAPAQQFPPCTMPCDCCPPHPPTPTXNFXXLWXLTIPTXAXXTLPLFXXPNQXXTXXTXPPNPTPHTXHPQPTTPQPXXXSFPQPTPNTHTXTXHTNPMPQPXWPRKQXKEPQQXCNAPQQXXTTXTNPEQ

SEQ ID NO: 209615 - protein, 187 aa, Triticum aestivum
  unsure (1)..(187): unsure at all Xaa locations
  Clone ID: PAT_TA_104033.pep
XXVGVSXLLXLSXXXXLGAXXGXXGXGVXXXYXRWWXXIXFXRCPYVKYIQTQXVXCXRFXVXXLGVVXRXQMQGGKIXFLCLLXLMXXISLLLLCGTKGKLLCXXXTXXGSXCAXQGCCVWXXXRCXKXVVQXVGXVVWSMXRGQXGSYHXVQFXVFXQVWRSCVKVSTHTMLGARSXVWCWAXTR

SEQ ID NO: 209616 - protein, 191 aa, Triticum aestivum
  unsure (1)..(191): unsure at all Xaa locations
  Clone ID: PAT_TA_104034.pep
AGGNXARDXXSXPPVFXXXSXXRYNXQGIIIHNPVRYSMSGXXXRMSNQGXXXCXHNIXCIXCVRWXVSGSAHMQSXCRHMVHTECXGRQSVGVHTEXGNMAHSXHXAGQRXAEWQDXGGEXHRGXRQCNWLGKQDLXGVGWSMXGRQXTGGXXXQGVWVAADXRGRTVQXGEGWXGHGHEWXGLFVAVXX

SEQ ID NO: 209617 - protein, 217 aa, Triticum aestivum
  unsure (1)..(217): unsure at all Xaa locations
  Clone ID: PAT_TA_104035.pep
RSTNPNPCXCXXXHXXXTXVPRXPTDRAPXXHXXPXXTXXRTXQPPXXAAXPXHXXXPXXXHXXAXPTXRPXXXXXPXPXXXPQXPXXTXXXPHTQAXXPTPXXQQRPPXXGXXLRXSXCAXTXTRHRKKEXXXXXXXXPXXXXNXTXTXRRXQXXXPXQXTXTXXNXXXXXXXXHTXPPXTPTXXXXXXXHXTPPXHTXXTXHXHXXHQXXPXXXN

SEQ ID NO: 209618 - protein, 207 aa, Triticum aestivum
  unsure (1)..(207): unsure at all Xaa locations
  Clone ID: PAT_TA_104036.pep
FLXXXSXRQXEXXXTXMCCXWXLLXRPLCXVVXXWLLGXVLXLXXSPXXFXFXXXXXXLXAXXSXRPXXXFLXXVSSXCLSVXXXXSXSXLCXGXLLAXXXXCXFXVLXCGXXWXXXXLECXVFXXRFXVCXXWXVXXGXGGXXRFLXAMQGRDXXXXXNXXXSIXXXWAXXXVIVRXGTRGNAEHXPSRXXHXAQXQXKVXSLQCT

SEQ ID NO: 209619 - protein, 123 aa, Triticum aestivum
  unsure (1)..(123): unsure at all Xaa locations
  Clone ID: PAT_TA_104037.pep
LSALRGEXLVXXGARKXXVVXGCLXATXXFCFCLSVASSXXSLXLSREELXYXXDGLTCLLAFAALXRIXXAGLAGCGXXWXRVVGSENXCXDGTCNXLLVMXLQAFAGKLVASIAKILXSVS

SEQ ID NO: 209620 - protein, 186 aa, Triticum aestivum
  Clone ID: PAT_TA_104038.pep
MTMVVHSLEGGHHLQGKEPESQNKCDYPVKGKAIKEAESDHKHAESKSNYYYSKYAKGLTGEELEEIFRSALIQQGNVVYVTILGKNQVRIKNNLLTFPGKFAAKHLVERSHDILLLRPNRSETWCARYYYHPKEQGFSYSSWTKFVRDNKLCKGHVCVFELMKGVSKATMIVHVFTKVDGRFVLL

SEQ ID NO: 209621 - protein, 146 aa, Triticum aestivum
  unsure (1)..(146): unsure at all Xaa locations
  Clone ID: PAT_TA_104039.pep
PLEPMAAPPCRVAAPCSTSSLPPSCCLPRHGPGXPCRPPRSRILSCLQCPAPICCSCPLPSSKLHPGLAAPVCASICLSVPVPSHXASXHQPACPLHHLPAPPXCPSATPVPCSCSCLLPPEALLLCCLSAXSXHTPSXCATPCHP

SEQ ID NO: 209622 - protein, 79 aa, Triticum aestivum
  unsure (1)..(79): unsure at all Xaa locations
  Clone ID: PAT_TA_104040.pep
CHGAYLCAAPVGAFLLCPTPPLLXPPTARRKTIAGCXVFPXNGXXLSLQKVKRGGSCVXGFGSQGSGKAGQSVPGNYQG

SEQ ID NO: 209623 - protein, 139 aa, Triticum aestivum
  unsure (1)..(139): unsure at all Xaa locations
  Clone ID: PAT_TA_104041.pep
LPLXXWXFXGXFXNTPQPTXHXPXXLXIXXXXCLQTXTXQVPPXXKTXPFXXFPRKAXPXXFTCFGXHNSNSQSLLSISNTPXGXFXLYTXXXYRHXXXRXXFXPXTPXLDXGVPPVXRAXXNLFXXAYTPYVGEELQE

SEQ ID NO: 209624 - protein, 237 aa, Triticum aestivum
  unsure (1)..(237): unsure at all Xaa locations
  Clone ID: PAT_TA_104042.pep
TAXPPXNDHYSXLHXIPXDCXVPTXTPHLCXTLPHNHPHVAPAPXSAVPTCXPXLCXXXXXRQRTTXEDRPPXQGXXPHXDXXQXQSPMAXXPXXXXEXPQXXXPPKARRRGRTXXXAPRXHDGSXXVVGAXRRQRRRLXXTXXXRXNGAXXGGQRPXXDGDAXFXXTGQRAAAXXXTXANAXXTXPXXRXXIXXXYPAETXAQKGXXRVCXTXKXGGXQATDXPXRXNTXNNXXKR

SEQ ID NO: 209625 - protein, 297 aa, Triticum aestivum
  unsure (1)..(297): unsure at all Xaa locations
  Clone ID: PAT_TA_104043.pep
XGVPSXXKXMXLSIXXHSNISPPXAHVFWXXXYPKEXXXXXXVSTKXNGNXHPHXHXALVQAMXXHXLKSTXFXXSXXPQNTXXAGQWFXXXXSGXHXQXGXSXNTGXRQPTLWCAIXSNRCQPHSVPXVXILXXFKLCICSQHCPMGFXXSXXFNWSXXSAHTXSTVQXIGFKHSSAAHITSSRXHKGNNTAAAHSMHTEXQHSTGHQVHNNCNMEHCXHRHCSSLMRVIRGRGSQWQCINXHRAWQVTCMHAGREHSADSTFSSGHTQASGQVLLVTDSRQNEASSSGGRGGDSS

SEQ ID NO: 209626 - protein, 192 aa, Triticum aestivum
  unsure (1)..(192): unsure at all Xaa locations
  Clone ID: PAT_TA_104044.pep
RHITQQQXHTVHNTQQXKVHWCTSSTCXKQSQSITVEEASLSQTMAQGTCXPRXEHSIHRQTGNXTVRASQQSNSTIVHTVXXGXHASHRSTVXNWVRTEHRXHSTSKHQHSTVNTSHQXSGQQTEGLXTDGRSKSDXHHLLLVPARQAKQLEXVTSEKSSSNSQYQQQDEYHELCHREPRFTAARRARREX

SEQ ID NO: 209627 - protein, 119 aa, Triticum aestivum
  unsure (1)..(119): unsure at all Xaa locations
  Clone ID: PAT_TA_104045.pep
NHXNDYIVLQIRRGXKPDXVSVTDSVVRIHTIFFXHLPPLRXRHAGXVXVLXAXXESLCSRXSSSLDKLNTMSXVPLKSDPEVEXRLXLXICVCDRIIGLFKGXSQVRVDSLLVENIGQ

SEQ ID NO: 209628 - protein, 87 aa, Triticum aestivum
  unsure (1)..(87): unsure at all Xaa locations
  Clone ID: PAT_TA_104046.pep
FIRDFARFQAYWLKNELDXNKNLTRILTXNIYAYKFAIRHSGCXKLLGRADQVQGXXXAITPAGRKGDVLQGRLSWVTAGFSQVTTL

SEQ ID NO: 209629 - protein, 168 aa, Triticum aestivum
  unsure (1)..(168): unsure at all Xaa locations
  Clone ID: PAT_TA_104047.pep
XXEPTNXFSCNXQFYHXQPPIYLSIEANGQXQXQXPXXRSSLXPLGKEQEAKXPIHISKHKXXQTXXXEXXSKXQRGVMILXSPLSPXRSXKECQTAXLPQKSPFLXXSXPEGXEKAERXPXXSPERXRKKXKXPPXXNAXMEXFFRVGYRPRXTQXSXKKXFPXPLL

SEQ ID NO: 209630 - protein, 223 aa, Triticum aestivum
  unsure (1)..(223): unsure at all Xaa locations
  Clone ID: PAT_TA_104048.pep
XTXXXQXNXXDSLVSHXPXFLVVXVXLGXSXSAXXLXXLRNXRXPTPAHLXSXVXXXNCXIXYXQTXXPYGLVXPXXXTXTXXXLXTXGTXSXGHTTSLXTYIXXXXQIXGLRPNPQXXXVPXXIPXTHFDXTXWXIYTXLLHXXXXLGRTXQSSHXIXXPXXXPLCXNTMXPXCLXHXQVTKLVPXXVXXXTXWXTSTXXNIPPQHIGIXSDDTIPKWAXTQ

SEQ ID NO: 209631 - protein, 202 aa, Triticum aestivum
  unsure (1)..(202): unsure at all Xaa locations
  Clone ID: PAT_TA_104049.pep
XCTGLKWSXXCELCCLXLXSMCLPXLXXAPXACXCGCALLAGXSXPLXALLVLXFXHPIGXSXLEGLXCXCXXFWXIQXGCXXRFXXXFLLXGXVGPWAALTXMNPXXLWXXAFXXEXGXXXXXLXXPKXXCGAKNTXGXXWKPVKXQLPKPXNXEAXXPTWAXXGGXLPPPKXXXFXXFHPKKPXSXDXQXPLXVGXPXRX

SEQ ID NO: 209632 - protein, 207 aa, Triticum aestivum
  unsure (1)..(207): unsure at all Xaa locations
  Clone ID: PAT_TA_104050.pep
STWLHNPHEDFLIFALLAIVXTSAIAQMENSHIPGXLERPSQQQPLPPQQTLSHHQQQQPIQQQPQPFSQXQPCSXQQQQPLSXQQQQPPFSQQQPPFSAATTTSSTCNNHHFHMQQQPVLPPQQSPFPQQQQQHQHAWCNNKSLFVXAIHFCSMLNPCKVFLQQXCSPVAXPQRLAXVANCLQQSSXCHVMQQQCCQQLPQIPQQS

SEQ ID NO: 209633 - protein, 279 aa, Triticum aestivum
  unsure (1)..(279): unsure at all Xaa locations
  Clone ID: PAT_TA_104051.pep
NDLLIVTILAMATTIXATCQYAMSDPWLPMYIWPQQQPFPQPQQPFXCQQPQQTIPQPHQTVPPSTQQTFPQPXQTYPHQXQQQFPQTXQPQQPFPHAQQTFXXQQPQLPFPQQPNNHSPMPQXSXNNNXPHVTCXPQQAFPHXPRTIPCMPQQPXQSFHPXNEXLLIHAXLQQQMXPCKNXLLQQCXPVSFGCPSLISMILPXSDXXVXQAQCCQELXQIXQRFPCARSHWEIHLAWVEWCLRAHWHAHTPRPIGCEGWTTLGATWSPHKASKRRHSG

SEQ ID NO: 209634 - protein, 89 aa, Triticum aestivum
  Clone ID: PAT_TA_104052.pep
IFFSLKSFWVTDLEDACNCGSGCSCGSDCKCGKMYPDLTEQGSAAAQVAAVVVLGVAPENKAGQFEVAAGQSGEGCSCGDNCKCNPCNC

SEQ ID NO: 209635 - protein, 163 aa, Triticum aestivum
  unsure (1)..(163): unsure at all Xaa locations
  Clone ID: PAT_TA_104053.pep
CQYTYIGCAACAVPRCDVMLLNCCAPVLGCPCVXLCWLAELCXCCADCAAVCCQLXXCLCVPXEHCLLPCAVXVNXSICCXQXXCQXKCVCVVXVHSPLCXPACLCLXPVXPTXHXKLAFCXVVLAELCVLXCLLVTLTACVQPMCCAECDCCRKLSLLVCSV

SEQ ID NO: 209636 - protein, 214 aa, Triticum aestivum
  unsure (1)..(214): unsure at all Xaa locations
  Clone ID: PAT_TA_104054.pep
XRGQAXSVVXXXRXXLFXCXFXVKXXVCCXLVXXVVHLCXHTWXRXWXFACXGLSRAAWTQRCHQAAMQWPMCKXXQCVDNAAHCNXXXDANTNXAAQLMCCGLVWPEAXQARVXWLQVXVXTTTQAGWVTMAXVRQGWLGTXQVQAHSCVKXAGTQQAQTRVEHLMLDSMEGXKLHFKTLYCNNPKSISKTXFKGQSQANWGSMQGKQATGXG

SEQ ID NO: 209637 - protein, 133 aa, Triticum aestivum
  unsure (1)..(133): unsure at all Xaa locations
  Clone ID: PAT_TA_104055.pep
MEVAAAGEPAPAGEWLEERGVDAVYLPRLIAGVISGALTGLFALAGALTGAVTGALXGRASDSGVLRGAGLGAIAGAVLSIEVLEASRAYWCSDRLGTCSMLSIPDFGHDDVYDIFGDISSRGLSREALEKLP

SEQ ID NO: 209638 - protein, 110 aa, Triticum aestivum
  unsure (1)..(110): unsure at all Xaa locations
  Clone ID: PAT_TA_104056.pep
MGSEWVLALVLAMXVLAAMVVCXRXATVHAISCSTVYSXADAXACSTVQQWLGLXVPWGCCXGIQNLLAEANNSPDRLHQSCCACLKNCPNCCPVLCAPTITLAACLRSP

SEQ ID NO: 209639 - protein, 121 aa, Triticum aestivum
  unsure (1)..(121): unsure at all Xaa locations
  Clone ID: PAT_TA_104057.pep
XISXRVXLDIXSSTQPLFASXTIRPSIHQVSKMIIWTPASLNXVLXTISTSNLQGQIGXIEXGLSFLLGRGPWQAXXKXCRGIIAAAXXGQVVRXRQXNVGSTAFCQPSHXXTLXVQAXXV

SEQ ID NO: 209640 - protein, 153 aa, Triticum aestivum
  unsure (1)..(153): unsure at all Xaa locations
  Clone ID: PAT_TA_104058.pep
MSPPHPPTMPIHPHATPXTXNAIFPPTPHTHXIFPPIHTPPHTHNVSXNAXMPTPXTTPNILPCXXTPXIPTQXHPXXPHAQCRXSAGTSHTXPHXXPNTPSFPPXRXTXXHXQRTTXXCPXPXRXPPXRXQHAQPQQIARAHAPKARSSPSI

SEQ ID NO: 209641 - protein, 181 aa, Triticum aestivum
  unsure (1)..(181): unsure at all Xaa locations
  Clone ID: PAT_TA_104059.pep
QQPPCSXQQQPISHMQQQPIIXIXLQQSPFSAATTTMFLPATCNQLLYLQQPPFSACNNNHVLPQQPPFSQQQQQQQQQQPPFSACNNNHVLPQQPPXFSQQQQPXHFLHAXEQASSQQPPXAQQXQXFPQQQIPVVQPSCFCMQLNPCNCCSSNMHVPCGNCRNCLASVTNVCNMSSLPL

SEQ ID NO: 209642 - protein, 161 aa, Triticum aestivum
  unsure (1)..(161): unsure at all Xaa locations
  Clone ID: PAT_TA_104060.pep
PHNRHSTYREVPRGEMGDRRQLSTCSDXAXQVDQASFSADGCKHFVTSTVTWHSTASNSGHXFTAXHSTPSTAXHNXLGAQAQITALHGFAIQXASTSLQAQKTRWLSSLTHVXYLAPRSLXXSRGFXRNLGQMRTLMRWWISSKRTAKPLGCGCGEGGGG

SEQ ID NO: 209643 - protein, 180 aa, Triticum aestivum
  unsure (1)..(180): unsure at all Xaa locations
  Clone ID: PAT_TA_104061.pep
KWRRSRSSCSQSAXLRPPIDQXLQNLQLFEATKXEVVCELSECQLVCTCNPWCSECLXXRXXQSFDXLCESXRALWFXXNXLIDCCXIEKTLSVSPIXSHFVSLXXXCXHWCIXYISPSXLVXPVXXEXHQLLXCSLDPSVTKASITSIRXTXSCHFXQXXDVSKXXQCKEXISIIGQMW

SEQ ID NO: 209644 - protein, 101 aa, Triticum aestivum
  unsure (1)..(101): unsure at all Xaa locations
  Clone ID: PAT_TA_104062.pep
KLVSQFFXEHTAQXGMTQLNSRQGQMVSDQDAGRRRGSSVQQAVSSQXXSDTRRDLVQPTAGRCCCCVCLARRDSEAPMGWEFVRAGIGRRGAGERSPEKL

SEQ ID NO: 209645 - protein, 111 aa, Triticum aestivum
  Clone ID: PAT_TA_104063.pep
EKGQKCRVVCYYLLLRFSLHIVAGRKWRNSVGHRVACFCGFHGHSAWREIASLRAVRRRVHAVRGSVCAAHVNFVLLFVQCGVCDHAEYWGECSLLRLFERKCELKLQFIL

SEQ ID NO: 209646 - protein, 271 aa, Triticum aestivum
  unsure (1)..(271): unsure at all Xaa locations
  Clone ID: PAT_TA_104064.pep
IPCTQQSFPQQSQQSQQPFAQPQQLFPELQQPIPQQPQQPFPLQPATTIPPATXQQPFPQQPXNNHFPMPQQPQQPFPXPQQPQLPFPXQQPQQPFPXPQQPQQPFPQLQQPQQPLPQPQQPQQPFPQQQQPLIQPYLQQQMNPCKNYLLQQCNPVSLVSSLVSMILPRSDXCKVMXXQCCQQLAQIPQQLQCXSHPWXVVHSIIMQXEQQQQQXQQQGIQIMXALFQXRPGXGHQSKPQKTQLQXGXXSRALXLGTLPTXXXCWPPXXST

SEQ ID NO: 209647 - protein, 232 aa, Triticum aestivum
  unsure (1)..(232): unsure at all Xaa locations
  Clone ID: PAT_TA_104065.pep
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXVESSDTIDNVKAKIQDKEGIPPXDQQRLIFAGKQXEDGDLXGLQHSEESPFHLVLARVALRHGA

SEQ ID NO: 209648 - protein, 99 aa, Triticum aestivum
  unsure (1)..(99): unsure at all Xaa locations
  Clone ID: PAT_TA_104066.pep
XWCDLQQEDSLNCIWIWHGRLGAMGXLVSSRXRHAVVVGGSTQXXVVSGGHEGRREPXLCLGASDDGGAGALXTDHXTRSWQTVAGISFWQLTMWTDGA

SEQ ID NO: 209649 - protein, 200 aa, Triticum aestivum
  unsure (1)..(200): unsure at all Xaa locations
  Clone ID: PAT_TA_104067.pep
YNSTTTTTNHTPFLRASCTLACTSTDNPIFLEPNCSRSIIVMDQLTLRYWLEDVGEDGHVDVWRRGGPGHGRRGGGRRGHRCRGRAERRRRAGGGGRRVARRPPDHQRHHVLQEPAGVARHQPLLAGITKQAAVEEIRRAVGHRVLQQEARVGCHVTAAVAAAVPGTAGTTAADGGELLAQGAPVVVGVIMAPXWVSLAS

SEQ ID NO: 209650 - protein, 165 aa, Triticum aestivum
  unsure (1)..(165): unsure at all Xaa locations
  Clone ID: PAT_TA_104068.pep
XLSSFCXMCHWLAXPAGHVVGXQXHXVHLKPPQXPPXXCXXAXPILXQRSKSPPRXTXXXHGPALMAPXKRXTGQXNGWPPXRXXXXXPRXQXGPMQXATQXXANTTXGPTHXAXPXDKXTXAPRQPXXXXPCKKTXDPPXXLAXHXPDETPXXARXQTXXGXKT

SEQ ID NO: 209651 - protein, 114 aa, Triticum aestivum
  unsure (1)..(114): unsure at all Xaa locations
  Clone ID: PAT_TA_104069.pep
XQQXTTTFHXAQXXXXVQVXATXXCXNYXSPKLNRXXTFPXXHAXIPSDLXIXRSIVDLRKPHFHIVPTADWMVGXXRFQLQIAXLXLWALIPQENQXXXTVGAEGYITSGTTQ

SEQ ID NO: 209652 - protein, 117 aa, Triticum aestivum
  unsure (1)..(117): unsure at all Xaa locations
  Clone ID: PAT_TA_104070.pep
LXXRGXDHTXEQXRSXAXHKSLAQDXSRLRPXXXIVXAATHQXGMHTQAISXHGMAAMQGAHQRTTQQHXHSTXHTQAVVTXRXAGHSXXAXHXQQRDPAXPARQATSLRXQLHRTG

SEQ ID NO: 209653 - protein, 217 aa, Triticum aestivum
  unsure (1)..(217): unsure at all Xaa locations
  Clone ID: PAT_TA_104071.pep
MPVMLYERMKGLGKDVPELIILPVYSALPSEMQSKIFEPAPPGKRXVVVXTNIAEASLTIDGIYYVIDPGFAKINVYNSKQGLDSLVITPISQASAKQRAGRAGRTGPGKCYRLYTESAYRNEMSPTTIPEIQRINLGSTVLXXKAMGINDLLSFDFMDPPAPQALISAMEQLYSLGALDEEGLLTKLGRKMAEFPLDPXXSKMLXASVELGCXDEI

SEQ ID NO: 209654 - protein, 157 aa, Triticum aestivum
  unsure (1)..(157): unsure at all Xaa locations
  Clone ID: PAT_TA_104072.pep
REDFLILALLTIVATXTTAVRVPVPQLQPQNPSQQHPQEQVPXLVQQQQFXWQQQSFPPQQPYPQPXQPFPSQQPYLQLQPFPAAXQLPYLQPQPFRPQQPYPQPATTIFXNHNNNNYLQKQFPQPQQIPQQQQIPQQPQQFPQQQFPQQQQFPQQQ

SEQ ID NO: 209655 - protein, 107 aa, Triticum aestivum
  unsure (1)..(107): unsure at all Xaa locations
  Clone ID: PAT_TA_104073.pep
LLLXAHFISXNXXXNXNXPCPDLMDQLAXAQVSVXLDXXTCTXAXFSLXFSXRHSNDGVPLGGATHHDEVXGVVVTXHRXISGYILHHXRSRCRTCSRIRTTQLHSR

SEQ ID NO: 209656 - protein, 207 aa, Triticum aestivum
  unsure (1)..(207): unsure at all Xaa locations
  Clone ID: PAT_TA_104074.pep
GAHVVVASLETFSSTILTRCTNPRFLRTTLCFSHSASAPALGAASLQPTPPPPPPTTCSSDGGGGMRWESTRKKRVVLRVGYVGSEYRGLQKQRDLSADSTIESVLESAIFKAGGILESNYGKLQKVGWERSSRTDKGVHSLATMISLKMEIPDRAWEKDPDGIALANFINSNLPDNIKVFSILPAQRSFDXRRECLYREYFYLLLK

SEQ ID NO: 209657 - protein, 147 aa, Triticum aestivum
  unsure (1)..(147): unsure at all Xaa locations
  Clone ID: PAT_TA_104075.pep
LXSSAXXXEYISGPGSGWXTNKWEGAQASEDHTMGXGPVQVERREPGRLGNWRGKEAHSEXEGTGQXRLLGSGSARSGPKSNKGXHSFREAGXTASGQMQSSRRAGSRGSQMRLATAGLQARGRRQVAGTGPDDDREWVDPAXGEFD

SEQ ID NO: 209658 - protein, 131 aa, Triticum aestivum
  unsure (1)..(131): unsure at all Xaa locations
  Clone ID: PAT_TA_104076.pep
QLCNYVVLPNFSCNMPXDNLQQPCTIVQQLCTTQLLHNMSCDNCATIVYYPTSPATCHVTXCATXCVLPNFSCNMSXDXCASKPXTIDNSQDNCATIVYYPXFSWHACHVTIVQTTHXPXCATXXXLPNFS

SEQ ID NO: 209659 - protein, 162 aa, Triticum aestivum
  unsure (1)..(162): unsure at all Xaa locations
  Clone ID: PAT_TA_104077.pep
CLLCCLLSPPCCLLCXXAACHPXWMXALTPXCLLXXLFVMTNXIGMCEQHAXNAHGLTVACXSXKAAPXSKLHCAPNWQQPLXSGTPLPACTRPRKCVXTLCTLLXLPTXVCXLCVXPTLQRFLASNYDIPPXCSTFPCXFPHTAFXXPSCXXXXTLNSFQP

SEQ ID NO: 209660 - protein, 147 aa, Triticum aestivum
  unsure (1)..(147): unsure at all Xaa locations
  Clone ID: PAT_TA_104078.pep
QQLIPCMDVVLQQHNLAHGRSQVXLQQSTYQLLQELCCQHLWQIPEQSQCQAIHNVVHAIILHQQQKQQQQLSSQVSFQQPQQQYPLGQXSFXPSQQNXXAQGSVQPQQLPQFEEIRNLALQTLPAMCNVYIPPYCXIAPFGIFGTK

SEQ ID NO: 209661 - protein, 216 aa, Triticum aestivum
  Clone ID: PAT_TA_104079.pep
SFENLRPPERKICSSSPNKLSEELIKLTVTIFHKLSRTTDHADPELELSSAPKLNITSCIGSSRSLAPKLSSSSSSDRAAPSPIRSVKSRAAAPLECGGDEGEPAGRCERFVEFTRSSFDSSRVWLCLADIKNLRVLMNKLCTVDPSFLTNKQKLAFWLNIYNFCVMHAFLQHGLPPSPDKLLALLNQASVNVGGRVLSVLSIERLFLRHPPDEGN

SEQ ID NO: 209662 - protein, 139 aa, Triticum aestivum
  unsure (1)..(139): unsure at all Xaa locations
  Clone ID: PAT_TA_104080.pep
DRHERRSLSAMKLVAAANVLSRAVSAVVSSRPFSEXLWWSVLYNMNQEIQSEXHXLALNRXXAVKRVAIVVLTXXERGSAXAFNNNVLKKXRXARMEDLRQLGXXTTPSISVGKKGNAYFQVPXTTFPXSCFLXVCGVP

SEQ ID NO: 209663 - protein, 144 aa, Triticum aestivum
  unsure (1)..(144): unsure at all Xaa locations
  Clone ID: PAT_TA_104081.pep
QPRHPWPPRAEKKPVAEKAEKTTAAKKTKAEKRPPAXQGXAXEKKGKKKSXXSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 209664 - protein, 204 aa, Triticum aestivum
  unsure (1)..(204): unsure at all Xaa locations
  Clone ID: PAT_TA_104082.pep
AAQNPSQQQPQEQVPLVQQQQFLGQQQPFPPQQPYPQPQPFPSQQPYLQLQPFLQPQLPYSQPQPFRPQQPYPQPQPQYSQAQXPISQQQQQQQQQQQQQQQQQQQQILQQILQQQLIPCMDXVLQQHNIAHGTDHKVFGKQSNFNQXXGKKWCGQNLWASLGSKRPVAQGPFQQMVGNWNLIWHSKPTKTKQNQFKATGLSLS

SEQ ID NO: 209665 - protein, 164 aa, Triticum aestivum
  unsure (1)..(164): unsure at all Xaa locations
  Clone ID: PAT_TA_104083.pep
GRPXVRRLLAARVVVMVRGCPSGSDVDVGCHGVVVAHGGGLGHFTAAAGLLRRPLVGERSWRPSIPLPVVRALPSSKGWPSPSGAHRPSRARRQDRARLAPDSRTGLVSRPAAGSDSSRARQQDLTRLAPGSRTELVSRPAAGRVDGGQFWPVYRVSTLGTAQE

SEQ ID NO: 209666 - protein, 215 aa, Triticum aestivum
  unsure (1)..(215): unsure at all Xaa locations
  Clone ID: PAT_TA_104084.pep
QPGQLQQPAQGQQPAQGQQSAQEQQPGQAQQSGQWQLVYYPTSPQQPGQLQQPAQGQQGYYPTSPQQSGQGQQGYYPTSPQQSGQWQLVYYPTSPQQPGQLQQPAQGQQGYYPTSPQQSGQGQQGYYPTSPQQSGQGQQGYYPTSPQQSGQGQQPGQGQQPRQGQQGYYPISPQXQSGQGQQPGQGQXGYYPXSPQXSGPRATTGHEQXPGQWLE

SEQ ID NO: 209667 - protein, 139 aa, Triticum aestivum
  unsure (1)..(139): unsure at all Xaa locations
  Clone ID: PAT_TA_104085.pep
FXAGPVASXXGVSXGXXXLXXXVVLXXXPXXDXXWXXXXFXSLXHADVQXHXVGRWIRXXLXXXXVHAXXXDAXISXPXXXCXLLGXAXQLTXPGXXXXXQVTXXECGSFLAXPESMEXPVVIFSSXXKXCWAXCGVPH

SEQ ID NO: 209668 - protein, 136 aa, Triticum aestivum
  unsure (1)..(136): unsure at all Xaa locations
  Clone ID: PAT_TA_104086.pep
XSQXXVWPVXGPXTQXGXWEXRXHRXXXXNXVXXXVNQCPXQAGSATXQPQKSVTXQKCTVRAGCQCGRCXCEGQQSGQHTVTVTVREGXGVGGXHXHXGGAHITSAGSGEASXGRQQAVHRCRWAAACLQHNHST

SEQ ID NO: 209669 - protein, 233 aa, Triticum aestivum
  unsure (1)..(233): unsure at all Xaa locations
  Clone ID: PAT_TA_104087.pep
MGKEKIHISIVVIGHVDSGKSTTTGHLIYKLGGIDKRVIERFEKEAAEMNKRSFKYAWVLDKLKAERERGITIDIALWKFETTKYSCTVIDAPGHRDFIKNMITGTSQADCAVLIIDSTTGGFEAGISKDGQTREHALLAFTLGVKQMICCCNKMDATXPKYSKARYEEXVKEVSSYLKKVXYNLXKVPFXPXXGXEGDTXIERSQXCLVQGPHLXEALDXIMRRKHMAPGRK

SEQ ID NO: 209670 - protein, 134 aa, Triticum aestivum
  unsure (1)..(134): unsure at all Xaa locations
  Clone ID: PAT_TA_104088.pep
WRSRELYGPLIDXSAARHVGGFVQLLASVRRVLPHQEQNAATGRTYHRVILEVGDDTRSSFSVSLWSNTTSSTIXAGDVLLLQNIKIVEFRNGLEGRAXQMSAVQILMNSKDLVQSEGIDEFIINCKVGMLQDQ

SEQ ID NO: 209671 - protein, 124 aa, Triticum aestivum
  unsure (1)..(124): unsure at all Xaa locations
  Clone ID: PAT_TA_104089.pep
GYNGVPPXGPEQVCRCLPLHGCMPHGGSCTPLPSKXGRTKKDEHRGRXSGLXRRIGVNFPGPCFGATXSCXXVLXSXQFCLVLNTKXFPSPIIXLEQELIMXVCXVCIRICLTLCHALSYLXXX

SEQ ID NO: 209672 - protein, 154 aa, Triticum aestivum
  unsure (1)..(154): unsure at all Xaa locations
  Clone ID: PAT_TA_104090.pep
FSSWRQISSWRSDGGRLTPALVGSLGLMTGFFFNGLGGWPSETTAAAGSNDIGLIIQALLCLFRQDRSHSSFCSVSSRNXQDEGVRGVRDASAGXRRREAAEGFEGRILPVSRSNXVKVDLGGRESCGLCSSQPPSPEGQAEGTPPLSSASYSX

SEQ ID NO: 209673 - protein, 125 aa, Triticum aestivum
  unsure (1)..(125): unsure at all Xaa locations
  Clone ID: PAT_TA_104091.pep
TVPDLDCACNITCQLMCCSPCLLLCCXVMCCAVLCXXVLCCXCXCAVLTVCVPMLPVMCAVMCLCCAVLXXAVLLLCCAVLTVMWLCPCQLCCAVLCCAXXMAXLLNCAVXVLTVTCCXCAVLCC

SEQ ID NO: 209674 - protein, 159 aa, Triticum aestivum
  unsure (1)..(159): unsure at all Xaa locations
  Clone ID: PAT_TA_104092.pep
RXCLXYLGXXAYRGTXFXHXSIVISXWXVLDFXVPXGXRXVXMXXDRTDXIISFPSKXTVSSSAVXMQGWPGSXQSQILLTPCTSIXXCXXPPSSXSXRVXXRSVXHLXIXPMXIHFXQXXGXXXXXQXGVQXXPPRXXXXXEGHTVAXXXXXRXXPXW

SEQ ID NO: 209675 - protein, 216 aa, Triticum aestivum
  unsure (1)..(216): unsure at all Xaa locations
  Clone ID: PAT_TA_104093.pep
GKLRSERSEGSLVLLLKMQIFVKTLTGKTITLEVESSDTIDNVKAKIQDKEGIPPDQQRLIFAGKQLEDGXTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLXVESSDTIDNVKAKXQXXEGIPTGQQRLNPRG

SEQ ID NO: 209676 - protein, 224 aa, Triticum aestivum
  unsure (1)..(224): unsure at all Xaa locations
  Clone ID: PAT_TA_104094.pep
XXXXFXXXXVSSFPXWXVXYLFLXXESNSXAGREAHVXHXXFMPVPNVGCSXXFXHFWHFAPXXFVXXDLRKRNXGXXXLSRRSXXWKSNAEQCXKNLKGGAHPXLXCXLCAQXYXACXTAXQLXVYDRSIQHTHSTSAKFMGTSSSAXHSSEQGTHHNQATSXHTAGEITQWRAESHSSXXTRGQHSRGGDXSCXPTRGCVHGAVSGSSSLGTXALRCLPEPX

SEQ ID NO: 209677 - protein, 265 aa, Triticum aestivum
  unsure (1)..(265): unsure at all Xaa locations
  Clone ID: PAT_TA_104095.pep
PHACASPVLWLPPHHLLLPHPCPTPYSXRRXLXLXPRFPYMEGSGFXTCLLCVNNVPXGELDRVSLPCAPVLXLRXQAKCAAXLSXYISSDDLLCPXSTLSPKLDRXQXXXXIXSQTRLXTLLLXPXSQXHMXXQXTRHPAHDQEWLMXXHTPDPHISTNLXLXXHDXXXSPRQXXFAARTQPGATHRXXRXXKIWVKPQXHGLTXDTXKXFXNXPKXXWLXLHYNXQXXHYXTHXTXRXRKGXLQXVGXAXXXLKMXHKXNXPP

SEQ ID NO: 209678 - protein, 131 aa, Triticum aestivum
  unsure (1)..(131): unsure at all Xaa locations
  Clone ID: PAT_TA_104096.pep
AGCSLPVGLNLAFSAVAAHRRSEXWQELPVFSAAVSTSQQPKSRDLADLDYLLSQSETYDAXVAAVPLDXVSTSLMQFAXXLAELDAQQFPLVQCLLLLPRMVSPSEDICRASAEAEKRXLDSHFLLCRQL

SEQ ID NO: 209679 - protein, 97 aa, Triticum aestivum
  unsure (1)..(97): unsure at all Xaa locations
  Clone ID: PAT_TA_104097.pep
PPCCGGYPARGYXXLAIGWVXHDYHCXAPIALEGSNKQLLVQASLMERRARXASKPPCSGGDASISGEPSGXGEQADRDQIGMERLGXRRGCXGXEG

SEQ ID NO: 209680 - protein, 180 aa, Triticum aestivum
  unsure (1)..(180): unsure at all Xaa locations
  Clone ID: PAT_TA_104098.pep
MKTLLILTILAMAITIGTANIQVDPSGQVQWLQQQLVPQLQQPLSQQPQQPFPQTQQPQQPFPQQPQQPFPQTQQPQQPFPQLQQPQQPFPQPQQQLPQPQQPQQSFPQQQRSFIQPSLQQQLNPCKNILLQQCKPASLVSSLWSIILXPKXDCQVMRQQCCQQLAQIPQQLQCAAIHSV

SEQ ID NO: 209681 - protein, 193 aa, Triticum aestivum
  Clone ID: PAT_TA_104099.pep
MPTHVASPHGGRDMAIGTLFLCGSCVSYALWFVVQAKVAKVFPSRYWATALTCAAGSLQSAVAAAVAVVLAPAGDGHGWARTWTLRWDLQLATVVYSGVFNTGVTFVLVSWAVERRGPVYPPMFNSLSLVATTAVDAVVLGTDVYLGGVLGAALVVVGLYAFLWGKSKELAAAKAVNAEQELRCAGDTDDGIA

SEQ ID NO: 209682 - protein, 161 aa, Triticum aestivum; identical to SEQ ID NO: 129051
  Clone ID: PAT_TA_104100.pep

SEQ ID NO: 209683 - protein, 206 aa, Triticum aestivum
  unsure (1)..(206): unsure at all Xaa locations
  Clone ID: PAT_TA_104101.pep
SSLCVCTXLSLXCVHAXXQHQMIQCILLNVCEYGPIIMXXPVVXTIQXPTHCXTCHLXWLWXELQLQLHXQFAXXLHLAIAHCTCKXWXQFHXANHPPTXXTXTTLWVVQMHTQWCNXISQSIXPYXGKANKHTXFTPLICPLCNSIPXXWIXXQXXLAXPXXLLXXFGYTTLXFRHNTLALIWCXXFXIXNLHHRTPLTFVAFPX

SEQ ID NO: 209684 - protein, 159 aa, Triticum aestivum
  unsure (1)..(159): unsure at all Xaa locations
  Clone ID: PAT_TA_104102.pep
VGMXRPXWGMXXAQTXGXGXNLAXXXLVXXWXPKSGWWWXXXQXXLXCQXXGXXXXXCGHXWDYXXGXAXXXXXTPXYYXGRXQXCCXSXGXWXALGVLXCGVTLXVXCNLRXGXGLDXRTLXRDYHWGDHYVHLLVTWGXXTWGTTLLCXVLRGLHTX

SEQ ID NO: 209685 - protein, 206 aa, Triticum aestivum
  unsure (1)..(206): unsure at all Xaa locations
  Clone ID: PAT_TA_104103.pep
LCAACLTXXHQXATLPANEVXECSCXSHTXHXHHDDHXVTXLHXPCXXXSVXXPHXSPXKIPALXHDNKPAMWPCXQLXXCTRTCAPTPSPAQLVTHHXXXAQCIAXCXHTXLVVKIXXLVLVXSQTXTVVXNXAHFAPLCTXVXSMVGXXLDITXSAXLAKDNHXXWXXNXGXXPALARPXXLVTXPXTXKXAAXXXSXLSDFXX

SEQ ID NO: 209686 - protein, 252 aa, Triticum aestivum
  unsure (1)..(252): unsure at all Xaa locations
  Clone ID: PAT_TA_104104.pep
XHCFAXHTIXALHXSLTPXFILQXAXXGVHHPXQVCPNLFTXHTTSIAXFGPFGVCTHWAPXSITLGXHTHXLSPLFXXXXAPXGTNQLXTTFWSHTAWFTXCKATQHPHQPXAHKHAXIAPQHTSXPNXRXHLPFIXPWLHTRAHFKLGWHRXTFQHATWLGIALHXQAHXITLACPRHHTHMGTXXLGLEPLVXDPNPXGHNTTCXHXXXQXIQVXXXGSLIMCXXLTPXHXPXIGSXXLXHXXXPRQHX

SEQ ID NO: 209687 - protein, 167 aa, Triticum aestivum
  unsure (1)..(167): unsure at all Xaa locations
  Clone ID: PAT_TA_104105.pep
XXPPPXPXXXHRLXLAPPPQXGCLHXTXSXITSTXAPAPXXIQHTNITXCWSIHXCXAXSLYPHSQQPPSSXVCXPPXNWSXGCTCTRXHHNTHXXVHLLXQHCNCASQPXYXLCRXLSXAXHSPSXCPXXLFVXTPHTSXCPPPXXXPCXSSXPHTXXXLPXIXVG

SEQ ID NO: 209688 - protein, 145 aa, Triticum aestivum
  unsure (1)..(145): unsure at all Xaa locations
  Clone ID: PAT_TA_104106.pep
QVQQASQHPXICCVHLXTMXAXLVPSSTXHCTCXPTSIYXKPXVQCHIAXXPDXLHPQAVXXAXHIVHMPLXCTQXAHPHXKWSSXHMXIALVLVAXMHPQXSXXCPCDSCXTRHSCXGSITXPXFKANXLXXXXNXLXGNNXSX

SEQ ID NO: 209689 - protein, 166 aa, Triticum aestivum
  unsure (1)..(166): unsure at all Xaa locations
  Clone ID: PAT_TA_104107.pep
YGPXCXPCHQVAXMWQXXXXIXGLXNXGXWGXMXWHVXAXRIAXXXVPXIWXYSXSXVTGQSXGXGXQCXXDTAMXXQPGXMXRYWCXQVCXXXXXQCXTCQGMCTVCGRXXQXCTIVTLVXQXVSQWVKGKCXSXRVHVDXXAXQCSAAHXHKCLAQATMHWGTH

SEQ ID NO: 209690 - protein, 233 aa, Triticum aestivum
  unsure (1)..(233): unsure at all Xaa locations
  Clone ID: PAT_TA_104108.pep
CVPWYXXXRPIVSLSLQFTWPVCXXTXCXCTWAKPWLFTNFXXALXSHXSPLFCPACAVNQLHSSALXTXICPSXTHSIAXSPXTIVRTIXATHLVTXXVHXHXXWSHXQXXAXSTQXXXYGXXIPWXXQFXSHPHSVPAQHSCXHTHXXISSXIPTHQAQFSTCXHSVCFAKLXCYPXFVHXHXQVTXHXSTQPXTTSVEQXYXQTCSQTNVGFATHXXXSLNSKLXPXQXV

SEQ ID NO: 209691 - protein, 142 aa, Triticum aestivum
  unsure (1)..(142): unsure at all Xaa locations
  Clone ID: PAT_TA_104109.pep
AMXQHSITXXYXAVXXKKXKKKXXKXYIYXYSIILYYIXXISNIXXHHXSXHSXXSXIXPHXXAHXCXHTXMXNQLTHXHMLCSCXIXXTXTPXXLWPXXXITXXHTHXTHXHTHIHTHNIXXTPPHTHTXHMCXCPLTTHN

SEQ ID NO: 209692 - protein, 154 aa, Triticum aestivum
  unsure (1)..(154): unsure at all Xaa locations
  Clone ID: PAT_TA_104110.pep
CSXCNHTSVLQHXCVAQASXPVAATPCTXMCLCQPVPGLLVHCXCSHCDSSTXXXVLCVXSLXIVASVPXCVPPXVAXHCTXVXPHAPHPXXHRXLSXXHGXMXLCPLHXALXHIDNKTXTQCXPQXHXIKYSPPPVXLMIVPHLIXVXFAICS

SEQ ID NO: 209693 - protein, 166 aa, Triticum aestivum
  unsure (1)..(166): unsure at all Xaa locations
  Clone ID: PAT_TA_104111.pep
XRHRXSHQVLQQIGXXXQXVXXGXXXVQXQTVXGQXXXPRGXXXSXLXXXHHXSAIVRRXXVXWGDVPLDAPSNASTCXLVQDAXATEGQCGQTLCVPKXHCRQLLLPSARKTPXQNXEXPXLWGTMQQGIXTMWTAIFXWVXQEQEGXXQAEQRGGGXGGXLVXI

SEQ ID NO: 209694 - protein, 158 aa, Triticum aestivum
  unsure (1)..(158): unsure at all Xaa locations
  Clone ID: PAT_TA_104112.pep
XQAEVGEGPQSVSTGSQAGRTRQCTGGGDSSTDSRPLHSQHGXWPVSSHGQAEAAPVSRKWHQVVGGXRSSPQPVTPTXSRTSSXVLPXQLFMRRLSREAEGDXSGRRSGRTEPREERSSGSTTTRCQPGHEVGEDAGAGLXGGXELRXGSTSLAPRQ

SEQ ID NO: 209695 - protein, 106 aa, Triticum aestivum
  unsure (1)..(106): unsure at all Xaa locations
  Clone ID: PAT_TA_104113.pep
WVCRVSXSCVTXXVXGXGXQXXVGVTXRVSRVXVSVHGQVSRSCHSQCXVAXSKPXQGVSVXCKVRXRWXKPHXXGVTRKXESVTXTGXWXGRXVQAGTXLAFXTF

SEQ ID NO: 209696 - protein, 134 aa, Triticum aestivum
  unsure (1)..(134): unsure at all Xaa locations
  Clone ID: PAT_TA_104114.pep
VFLGVGAKXTQGXXXAIXAGHSVCRHXAXANTGXXVXVSTHRAMSXGARXKVWGXXXXEXICTSEGSMEGQWGHKCNXAGHRGXFRHXXTCGATGGXQXTCGXRXQGHRQMVSGXQGGXXGVAQSQQHVMGMGH

SEQ ID NO: 209697 - protein, 129 aa, Triticum aestivum
  unsure (1)..(129): unsure at all Xaa locations
  Clone ID: PAT_TA_104115.pep
AWSVIHCLLXPCSXALXXCVFPELHXPCNWLSSSGECLSGSXXPGSQIFSECAGLDYHXXNPSXDAXLQSIHLPSXACQVVLMVLPVEWLPRSXGRXAGRDRGPXLTRTADXRTHXXPRRGPRXSRSSR

SEQ ID NO: 209698 - protein, 83 aa, Triticum aestivum
  unsure (1)..(83): unsure at all Xaa locations
  Clone ID: PAT_TA_104116.pep
HEHLGEEAAXPCRRSPRRRGRRGRAXVSVARGWWCGGLTHAGGREVGAGEGHAQSVQARELRRRDDTPATRVGREVPAARTPE

SEQ ID NO: 209699 - protein, 86 aa, Triticum aestivum
  unsure (1)..(86): unsure at all Xaa locations
  Clone ID: PAT_TA_104117.pep
RVDRGPGWPSCVGKXSRIGAAQDVVAASVPYXLXQXCAYGGTFCALCLYRLRXXLHSQPAKWFDGSRXCICRVTKDCAVTXRARAR

SEQ ID NO: 209700 - protein, 223 aa, Triticum aestivum
  unsure (1)..(223): unsure at all Xaa locations
  Clone ID: PAT_TA_104118.pep
VXXSXLGGVSXLWXXXXCGGCPXXXFGPXVVXXWGFFSCXFVVLVCLXSSXXXGSLFXXPRXLXXXRXGXFXRFLXXCGGHXGXXPXXXFGXXFRFFPVRXXACLGPXXXGGFXXWGGXGXXGQXXPAVGLSGXQKGSAGXRXXXLGAVRXAWXXXXPRLTRXXXXESWQDKCRDXFWQXTMXDGWXHRGGXGPARKHXGXEAIPXEWKSGXXLXVXRGGSQG

SEQ ID NO: 209701 - protein, 230 aa, Triticum aestivum
  unsure (1)..(230): unsure at all Xaa locations
  Clone ID: PAT_TA_104119.pep
TEFXAXQXSTNLQHFXAKXVHLKGFTPSHNFGIRXTRQXXCVXHXSRIQHKPXGVRXXXATFVHXXXXFXWTXGQAVXXMHRHTXXXSTATATHXXXXESCXVHTAAAXSNQQIQHNSHSTASHSTGGSTTXTGQQHSVGRAPXARSXPAYPVARSPRGXEXXAGASTKEAGSTRQDEGXRRGGRRRRRRRRRGRRGGARGGGGGGSSPXRPGXQQQGKFHFSLLSFRAL

SEQ ID NO: 209702 - protein, 124 aa, Triticum aestivum
  unsure (1)..(124): unsure at all Xaa locations
  Clone ID: PAT_TA_104120.pep
LHPXETFYVHLHERLYIYQNXTCRPRXXFNKKXLHSVSSILTAXCQXCIWVXRLFRSSWLVLSXIVXAXDAPEHEXDFCTAQGXXYTCIGXNXSXGFXSQSRIARXDHNRQAHARIXHIRDFNL

SEQ ID NO: 209703 - protein, 119 aa, Triticum aestivum
  unsure (1)..(119): unsure at all Xaa locations
  Clone ID: PAT_TA_104121.pep
HXAMARXWPGQVXCXXNYXHVFLQHXSCCKSEHRSGNIXSTTGRDNXQXPSSWTRLVRQXQXQRNIEEVQMQAQAVVAGXYTGAQXDRQLTQFTHIRQLVXDTHRGRSRAQAATMXLXX

SEQ ID NO: 209704 - protein, 123 aa, Triticum aestivum
  unsure (1)..(123): unsure at all Xaa locations
  Clone ID: PAT_TA_104122.pep
HIMLCSGLCLGRQQMVMMLSTLDGGHPPSVDGIEAASPLHETCTKVDSTHHIRGEENQISGGISTSCLLGHHGQRRARVGDASRTGEMFSFFMALAPGLEPQRAPSSRGLXPCTSGRSXRCRD

SEQ ID NO: 209705 - protein, 159 aa, Triticum aestivum
  unsure (1)..(159): unsure at all Xaa locations
  Clone ID: PAT_TA_104123.pep
SMSQYXAXWXXXVXXQGDEGLLYSSHHIXRVGXLGIRGNNHIGDEPMWXVVSNTHSERRIXQSGXRFWRQSQHTQHSTELHTQCTAXQHSTXQTQESTGRQHTHXGGTGXAXXRQKGXRRGAQMGGXQXQEAVRTEEGCRRWRQAGEGPDRXQEQRGHG

SEQ ID NO: 209706 - protein, 166 aa, Triticum aestivum
  unsure (1)..(166): unsure at all Xaa locations
  Clone ID: PAT_TA_104124.pep
XXXXXLLRPXAXVAGCYVRRACGWLLLAXXXXLATCQXRLCGWLRASAVVATCCAXVVAGSYVLCVLCCAVLTVLCCAVLCCAHCAVPAAVLCCTPVLWPVVMCNLAAVLCVPSQXIXSHXTIXVXPXXXQXTXXXXFPXXFXXVXXXXFPLVXXXPXXFWQFLXX

SEQ ID NO: 209707 - protein, 218 aa, Triticum aestivum
  unsure (1)..(218): unsure at all Xaa locations
  Clone ID: PAT_TA_104125.pep
QIERFEKEAAEXMNKRSFKYAWVLDKLKAERERGITIDIALWKXFETTKYYCTVXIDAPGHRDFIKNMITGTSQXXGRCXCLIQSXSTTGGFEDWYLEGSXQTREHALLAFTLGVKQMICCCXKMDATTPKYSKXPXMRKIXVKEVSSYXKKVGYNPXKVPFVPISGFEGDXMIERSTXTLXWYKGPXXXLRLLTRSMXPKRPSXKPLRLPLQDVYKI

SEQ ID NO: 209708 - protein, 146 aa, Triticum aestivum
  unsure (1)..(146): unsure at all Xaa locations
  Clone ID: PAT_TA_104126.pep
LHSSTQAKASWRSSSXSVQSGMAVLRVCVLCTVCLAXCVALLCHCVWLCCLPVLXLCTAISLLXQLCLXXLATXLTCLXXPWXXKLLHGXCWAVCPGPVAPXVCLLAPVHPEPAGLSANNXPRPAAPSAVLPQELXANXAASVLXP

SEQ ID NO: 209709 - protein, 77 aa, Triticum aestivum
  unsure (1)..(77): unsure at all Xaa locations
  Clone ID: PAT_TA_104127.pep
NVPVGAPPCSSKKIYNPFCYQKKKKKTRGXGPVPNSPYSESYYNSLAVVLQRRDWENPGVTQLNRLAXIPLRXWRIA

SEQ ID NO: 209710 - protein, 76 aa, Triticum aestivum
  unsure (1)..(76): unsure at all Xaa locations
  Clone ID: PAT_TA_104128.pep
RSLSSRGGPVPNSPYSESYYNSLAVVLQRRDWENPGVTQLNRLAAHPPFASWRNSEEARXDRPSQQLRXLNGEWEL

SEQ ID NO: 209711 - protein, 183 aa, Triticum aestivum
  unsure (1)..(183): unsure at all Xaa locations
  Clone ID: PAT_TA_104129.pep
XXDGMGVILSNTKXXXXAMLAGAXQVPXXTXRAPTXXXATSRCXXQXTCAFLKGXHIXRGIXSHTXXXXTSRXVFKXCFHXKFWPVXGRRNSQXAGXQQQQXQHNCQXDRHNTAGHXVXTXPXXXXRSQXXHXXXRGRXXXSXGXGRXGXRRRXRTXTRQRDTTATDXPLXPNDGGCATRRPK

SEQ ID NO: 209712 - protein, 124 aa, Triticum aestivum
  unsure (1)..(124): unsure at all Xaa locations
  Clone ID: PAT_TA_104130.pep
TKWLSFAPSLKAPDRVSPERFSLQHADLVDRFFSLGCRHGLALIYLRKRLQLLVWDPVTGDQHHIAVPPGFXHGXSPISGAVFRSAGDVQHFHLALVGSSERQITQAVARVYSSETGVWXPKFP

SEQ ID NO: 209713 - protein, 205 aa, Triticum aestivum
  unsure (1)..(205): unsure at all Xaa locations
  Clone ID: PAT_TA_104131.pep
MDAKAEASGDDAVPEAPEQSVVLISAGANHSVALLSGQMVCSWXGRGEDGQLGHGDSEDRPVPTVLTSFDVPRITSVVCGADHTAAYSDDEMQLYSWGWGDFGRLGHGNSSDVFNPQPVVALQGMKIKQIACGDSHCLAVTVTGQVHSWGRNQNGQLGLGNNEDSLLPQKIKAFQGVCVKMIAAGAEHTTAXTEDXHLYGWGWVT

SEQ ID NO: 209714 - protein, 169 aa, Triticum aestivum
  unsure (1)..(169): unsure at all Xaa locations
  Clone ID: PAT_TA_104132.pep
ALFASSMAFSLMXRCPGDKTXWCVSVDDCFSTPPFXPAAXLGCLVHSTVPLCLVFLSXSXQPTCCICIAVLHVHLAASPASSSTCSHASSSCATYARALPAQXTLAPVEIIHTPSCXQCAAFVCIILPLKHLVIMCXXXLHAQXAPWXLAXGIPPXWLTXPQXXHLITV

SEQ ID NO: 209715 - protein, 219 aa, Triticum aestivum
  unsure (1)..(219): unsure at all Xaa locations
  Clone ID: PAT_TA_104133.pep
MPMQCSAQYKSTMKTFLILALLAXCSNHLPQLHVRCSSATICMXQNPSQQQPQEQCXHLVQQQQFPXMQQPFPPQHAISCSLQPFPSQQPYLAACNHFLQPATTISCSLQLPYPACLQLPYPACLQPFXPQQXPYPQSATTCILQPQQPISAAXMHACXQQQQQQKQQQQQQQHDPSTNFXNNNLIPCXDVVLQQHSIAVCEAHKLKKYLTGAICVCQV

SEQ ID NO: 209716 - protein, 159 aa, Triticum aestivum
  unsure (1)..(159): unsure at all Xaa locations
  Clone ID: PAT_TA_104134.pep
LNQEAGMCKTEHRHQVVVVQQAQQGDRQHSTGGSRQEEKVRSTEQAIAVLRRMRRAXHSEGHRGHTXTGRTANASAQHRSKQQQGXRSMPMSMTGTGGGRXRXGVGVGVGWGRXGRRRWXRRVAGRHGXTGGDVTQXTQMPGIHGGVRADPLTCEAKSL

SEQ ID NO: 209717 - protein, 166 aa, Triticum aestivum
  unsure (1)..(166): unsure at all Xaa locations
  Clone ID: PAT_TA_104135.pep
XGEEXGAGQMNGXTEEEEXAGRSSRQAGQAGRRMRNRVQGSPGSSIRQRREGSXQAQRAGRREGXLXSKQVRRQARQVAEGVXLLHSKQVHAAHGTGRVAGTXQDXXXTCXQHCTEXCXCXQXHQXHKXNQXAASQEXXLVXEGARGETGRQGDEEAGEXXAKXXS

SEQ ID NO: 209718 - protein, 95 aa, Triticum aestivum
  Clone ID: PAT_TA_104136.pep
MALPALSFQPSTLMGSKAADSASGFPDWVFLCEEPRFSERRNETTAKCRTGEGQAVEVSFWLVDPPGVSYFTFNCPGLDASVFHEKEPSLVCAAA

SEQ ID NO: 209719 - protein, 75 aa, Triticum aestivum
  unsure (1)..(75): unsure at all Xaa locations
  Clone ID: PAT_TA_104137.pep
MSCNCGSGCSCGSDCKCGKMYPDLTEQGSAAPGRRVVVLGVAPXNKXGQFEVXAXTGRADGXXXXXTXMLLRRLI

SEQ ID NO: 209720 - protein, 170 aa, Triticum aestivum
  Clone ID: PAT_TA_104138.pep
SSEGKRGVSDQLGAMKGHMDLLSHRLDLLTVRVDKQDSCISEKNKEFDMIASRLEQALQDVRQNEIISSELLDRFRNATDSLKEVEKQNQYLRNVIQDKEKIFTSTIYKEKEFKERMTSLVESMREFENLVTYQQTIIANKIQHSESRFCLLKDQCKHLTKEGNLLKRKA

SEQ ID NO: 209721 - protein, 98 aa, Triticum aestivum
  unsure (1)..(98): unsure at all Xaa locations
  Clone ID: PAT_TA_104139.pep
TQPLASSLTTEFPITNPTVRGHPPSDAXSVCCRNLSQYXSVXXPXNSTAXPXXCSPXLDXGSHKSGKXTNVSRTTPTVTIPNFGVDRHTSVAAXTRTD

SEQ ID NO: 209722 - protein, 65 aa, Triticum aestivum
  Clone ID: PAT_TA_104140.pep
IMLIPCVMLVDKEIVCSHGIGQQCSKSRMCVCDLVLILHPWHEPIWHLVHLYFPVLLWFSYYYKV

SEQ ID NO: 209723 - protein, 180 aa, Triticum aestivum
  unsure (1)..(180): unsure at all Xaa locations
  Clone ID: PAT_TA_104141.pep
MPWSRDFIKNMITXSQADCAVLIIDSTTGGFECWYLQVXXPRTREHALLAFTLGVKQMICCCNKMDATTPKYSKXARYEEIVKXEVSSYLKKVGYNPDXVPFVPISGFEXXDNMIERSTNLDLVQXCPTLLEXALDQINEPKRPSDKPLRLPLQDVYKIGGIGTVPVGRVETGVIKPGMV

SEQ ID NO: 209724 - protein, 78 aa, Triticum aestivum
  unsure (1)..(78): unsure at all Xaa locations
  Clone ID: PAT_TA_104142.pep
WGRRRRWAXPGQNDGTAAEEWVAGGVAGRRAVVRGRRKGEEEXAGEGGGWVRRSLRDGATEGRGRSRRGIGAVLLHLS

SEQ ID NO: 209725 - protein, 56 aa, Triticum aestivum
  Clone ID: PAT_TA_104143.pep
RCGELEAILSRLITACWAFFLRRNDCCYSYYLYWRKKQQATGENTPTRRLRAGLGS

SEQ ID NO: 209726 - protein, 69 aa, Triticum aestivum
  Clone ID: PAT_TA_104144.pep
CQCESIRLQQWSCPQRHAHVRGVVHRLVIHGTGNPSWRSYHLQQRCGFQSVVAVSCFRIHRTWHYRCAC

SEQ ID NO: 209727 - protein, 70 aa, Triticum aestivum
  Clone ID: PAT_TA_104145.pep
CQSSMTTVDLDARARCGKAAAEVPVASRLEADTQLARSKGYMGASLGPEARSYHAFRPDGPAGVGSDQFH

SEQ ID NO: 209728 - protein, 49 aa, Triticum aestivum
  Clone ID: PAT_TA_104146.pep
DCGASTGVDVGRSTAVVWRKELDGEGAKGRREGRRGAQGQRTRTSPEQL

SEQ ID NO: 209729 - protein, 41 aa, Triticum aestivum
  Clone ID: PAT_TA_104147.pep
GHVESISHDAMLHRISCGNSLGHIMCDNPLDLLSVSKPADL

SEQ ID NO: 209730 - protein, 53 aa, Triticum aestivum
  Clone ID: PAT_TA_104148.pep
LVKATKGDALLLICSTITLLKSYRLLSPSLMDKPLSRCTSFLSWRIYLECWFT

SEQ ID NO: 209731 - protein, 74 aa, Triticum aestivum
  Clone ID: PAT_TA_104149.pep
WRSGGGGGGGEYPTEGRRRGGGGAAREARQGGGGHGGVVVREVRGSGEQPVFVALSDKRAWARLCVQTGFCNRL

SEQ ID NO: 209732 - protein, 50 aa, Triticum aestivum
  Clone ID: PAT_TA_104150.pep
RRRLRPWSPRRGRRPLPLQGPGHRRPRRSTLQRGSEGRGERWCLLAGAEI

SEQ ID NO: 209733 - protein, 54 aa, Triticum aestivum
  Clone ID: PAT_TA_104151.pep
IIFSNNRYNYMVVAVSLPRFDAINRHLGSNPLRPDPGVQPINLISVRTNERMTP

SEQ ID NO: 209734 - protein, 89 aa, Triticum aestivum
  Clone ID: PAT_TA_104152.pep
MASKSNCVLLLAAVLVSIFAAVAAIGNEECTPWMSTLITPLPSCRDYVEQQACRIETPGSPYLAKQQCCGELANIPQQCRCQALRYFMG

SEQ ID NO: 209735 - protein, 48 aa, Triticum aestivum
  Clone ID: PAT_TA_104153.pep
SGCVVYPSVCRTRVTKFCYEQCLSNAVTNEQRYMIVMLSMPMNLILKK

SEQ ID NO: 209736 - protein, 65 aa, Triticum aestivum
  Clone ID: PAT_TA_104154.pep
MDAVDSVVDPLREFAKDSVRLVKRCHKPDRKEFTKVAARTAIGFVVMGFVGFFVKLIFIPINNII

SEQ ID NO: 209737 - protein, 89 aa, Triticum aestivum
  unsure (1)..(89): unsure at all Xaa locations
  Clone ID: PAT_TA_104155.pep
PGEGXXXXXLXVIXPSXLAXSXXSXTIEXVRXSFTSIXXHGFXXSLPXDPEXGGLXXGXSXXXFAXPDXAXXASHLXXXPDALITLVXI

SEQ ID NO: 209738 - protein, 111 aa, Triticum aestivum
  unsure (1)..(111): unsure at all Xaa locations
  Clone ID: PAT_TA_104156.pep
QQCCSWYYLFXXKQQQQPWSXVSFQXLLQXXPLGRGPXRHXXQNPXAQGLSSLXXCPSXGXIXNLXXQXXPAXXNVXIPPXCTIXPFXIXGTNGNKFSRYMRFFSPMVWLL

SEQ ID NO: 209739 - protein, 133 aa, Triticum aestivum
  unsure (1)..(133): unsure at all Xaa locations
  Clone ID: PAT_TA_104157.pep
LIKNAAYIGTPGKGILAADESTGTIGKRFASINVENVXDNRRALRELLFCTPGALQYLSGVILFXETLYQXTKGGKPFVXILKAGNVLPGIKXDKGTIQLAWNNGETTTPXFDDLXQRCAQFYKAGARFPQLL

SEQ ID NO: 209740 - protein, 133 aa, Triticum aestivum
  unsure (1)..(133): unsure at all Xaa locations
  Clone ID: PAT_TA_104158.pep
SSLSLSTAWPXPPSVRPHAPXRVRXFRXXRXRRSRSXAXALRXXXXPFTCFXPXRXLXSLAXXXNVXSSXPXXLXPPXXXLLSXXSXXCXXPXGXXTSXMXXLSXDXXXXCXXIXXEXRCXXXXXXXQVXXLX

SEQ ID NO: 209741 - protein, 133 aa, Triticum aestivum
  unsure (1)..(133): unsure at all Xaa locations
  Clone ID: PAT_TA_104159.pep
XKNSIXAENPLLSIPSQGSKSLLRCHDXRSLCRRLFRPLPPTLHCRGPXXKXFVAAAAVQGXTPXSSSPRQGGFESXPXTXGIAAAELPXTSXPPVXGKKPXXRXFXSXXCXKKSGCXVISQXNSXXSTHVFL

SEQ ID NO: 209742 - protein, 103 aa, Triticum aestivum
  unsure (1)..(103): unsure at all Xaa locations
  Clone ID: PAT_TA_104160.pep
MVKYSTDPANPTXSAXAMGRDLRVHFKNTKETAFALXXMSLNKAXKYXEDXLAHKQAIPFRKLCRGVXTXTQXXNRXPXGPGXXPANLLIXSDFXKNAENHPK

SEQ ID NO: 209743 - protein, 133 aa, Triticum aestivum
  unsure (1)..(133): unsure at all Xaa locations
  Clone ID: PAT_TA_104161.pep
QQPGQAQQSGQWQLVYYPTSPQXPGQLQQPAQGQQGXYPTSPQQSGQGQQGYYPXSPLHSGXRLQXXYXTSPLQSRQRLXPXXGQQPXQGQQGXYPXSXXQSXGQGQQPXXXQQXXYPTSXXXHDXGNNXDSY

SEQ ID NO: 209744 - protein, 102 aa, Triticum aestivum
  unsure (1)..(102): unsure at all Xaa locations
  Clone ID: PAT_TA_104162.pep
MERIGEAHQVHQLQQVQQXGVAAAPSFGVVEHSVXXAAAAAATNPKAPGLPPXPPASFXGQQRXAGGDXCMDDSXGXXGRKXVXPAXRRSLNXXPFPGFFPP

SEQ ID NO: 209745 - protein, 103 aa, Triticum aestivum
  unsure (1)..(103): unsure at all Xaa locations
  Clone ID: PAT_TA_104163.pep
MGXEKXHINIVVIGHVXSGKSTTTGHLIYKXGGIDKRVIXKFEKEAAXMNKRSFXYAWVLDXLKPTXEGFPIDIACXKFXKTTKFYCTXFEAPGPKSSPCAPP

SEQ ID NO: 209746 - protein, 121 aa, Triticum aestivum
  unsure (1)..(121): unsure at all Xaa locations
  Clone ID: PAT_TA_104164.pep
KSPSPPPYPSSLPSLXPPPLSSLRFGSLLPRRHDTSTXAVXAAXGHGRPHXXAWRGRAXAXLGXDSXAXXPLRAXXSSASTXVXXHVXXXRRXXXXPYXYXPXXXXLXRLCXXGPAAXXXX

SEQ ID NO: 209747 - protein, 132 aa, Triticum aestivum
  unsure (1)..(132): unsure at all Xaa locations
  Clone ID: PAT_TA_104165.pep
NFALDNHPCPSPPPTTSARRHRRPATASPGAPRAPPPSGXCXAXXSPRGRPPAAMRPPSCXRSTXTPIRDXRDCXVRRHXISVFXRDXNGXIXXIXGVFXTXSYXXXXVRRGAQXRQGALLNXLLXXGXGCX

SEQ ID NO: 209748 - protein, 83 aa, Triticum aestivum
  unsure (1)..(83): unsure at all Xaa locations
  Clone ID: PAT_TA_104166.pep
KQKQQQQPWSQFSFQQLWQQYPLGQGXFRPFQQNPQAQGXVQPQQLPQLEEIRNLALQTLPAMCNVXIPPYCTIAPFGXFGTN

SEQ ID NO: 209749 - protein, 94 aa, Triticum aestivum
  unsure (1)..(94): unsure at all Xaa locations
  Clone ID: PAT_TA_104167.pep
DSYLRLYIQDLLQILTYLPFHCARPWWFLEXNIKVPCQPSSIIGCLCRHYYPGLVPIXXXXEDPXWSWEHWKXXRIPKTSGAGCTAVLTXQKEE

SEQ ID NO: 209750 - protein, 126 aa, Triticum aestivum
  unsure (1)..(126): unsure at all Xaa locations
  Clone ID: PAT_TA_104168.pep
TERPTPATSPAAGDARRWRAAAPAPPRSPPPPPAPSPPSPRSPPRPAXAPLPTAAAAARPPRGGAXSPPPPREGPKGXRPTSPSPPPKKPSPPPPAPXKPSPAPVPTNRSSSSSAASPATSPKAIS

SEQ ID NO: 209751 - protein, 133 aa, Triticum aestivum
  unsure (1)..(133): unsure at all Xaa locations
  Clone ID: PAT_TA_104169.pep
PXEXRXXSMXXDGNXXXHXAGXXGXGHNRTEXGXTXXGKXRXXGVDGQXXXXXSXXEEXNXNPREXPXYXIRDXXGXXDIXVXGEXVXEGXVVGGXXEAADEAAXXDVRHCXSCSPILNXNEPNRAGNRGLSG

SEQ ID NO: 209752 - protein, 98 aa, Triticum aestivum
  unsure (1)..(98): unsure at all Xaa locations
  Clone ID: PAT_TA_104170.pep
XXWSXXXXXXXXXWXPXXSXXXXXHXPPEDXSXXWXFXPIXCXXXXHYVLQHAXXRSAXSHSXVNEXTSSMXXXXMKXCLSXLYYLSLPRXNXSXXXV

SEQ ID NO: 209753 - protein, 93 aa, Triticum aestivum
  unsure (1)..(93): unsure at all Xaa locations
  Clone ID: PAT_TA_104171.pep
NLFIFNFXFIKNXASXEANIQNXXLLMMSFLSDIXXXXXRPQXXXLLLSNXXXLXRNNXRVPEKCKPSVFVVLHXXKALTLXLGFXVXTISLP

SEQ ID NO: 209754 - protein, 77 aa, Triticum aestivum
  unsure (1)..(77): unsure at all Xaa locations
  Clone ID: PAT_TA_104172.pep
LALDKEXKRLSVETTPNQDPLVTKGSNLHPLLGIDVWEHAYYLQYKNVRPDYLTNIWKVVKLEXMLEKXYKKXLXLS

SEQ ID NO: 209755 - protein, 67 aa, Triticum aestivum
  unsure (1)..(67): unsure at all Xaa locations
  Clone ID: PAT_TA_104173.pep
YGIHGVGTVNRGXEVIXAGMTGEGWTAXVVRHHGTELXVIESXFKLREGQPTAXVXDMRKSLIDSYX

SEQ ID NO: 209756 - protein, 100 aa, Triticum aestivum
  unsure (1)..(100): unsure at all Xaa locations
  Clone ID: PAT_TA_104174.pep
SRSRAIHNVVHXIIWHQXQKQQQQPSSQVSFQQLLQQYPLGQGXFRPFQQNPQAQGXVQPQQLPQFEEIRNXALQTXPAMCNVYIPPYCTIAPFGXFGTN

SEQ ID NO: 209757 - protein, 133 aa, Triticum aestivum
  unsure (1)..(133): unsure at all Xaa locations
  Clone ID: PAT_TA_104175.pep
IXKXXXAXEGXFFFFPXXLXXKXTGXXXEFSXGXFFXXXXXXFLXRXSXPPXPHPXGGXSFFXXXIXXGLFFXFXEXXRAXLGXXXKKXXXPFXEXXFIFFFAKXXXXFXXXNKKKXXXXTXXXXXTNKKKXK

SEQ ID NO: 209758 - protein, 98 aa, Triticum aestivum
  unsure (1)..(98): unsure at all Xaa locations
  Clone ID: PAT_TA_104176.pep
XKCXKPKSXSPTXXAXVTGAGEXQXLYQMAASSQXAAXLVALPTRGMEXILVXAXTLNLXPHMTPRCPPRXPLLLXNSISTYRYRRPXKGGPVPNPPX

SEQ ID NO: 209759 - protein, 134 aa, Triticum aestivum
  unsure (1)..(134): unsure at all Xaa locations
  Clone ID: PAT_TA_104177.pep
QQQQPPFSQQQQQPPFTQQQQPSFSQQPPISQQQQQQQQQQQPFTQQQQPPFSQQPPXSQQQXPPFSQXQQPPFXQQLXIPVXHPSVLQQLXPCKVFLQQQCIXVXXXRXLAMXXMLXQNICHVXMQXXCXQQL

SEQ ID NO: 209760 - protein, 58 aa, Triticum aestivum
  unsure (1)..(58): unsure at all Xaa locations
  Clone ID: PAT_TA_104178.pep
YAHTHAQQIRIFLADIYSGINTNTFFMYYSSPAXIILLLSDSXSLQSLKLHWEASKQH

SEQ ID NO: 209761 - protein, 131 aa, Triticum aestivum
  unsure (1)..(131): unsure at all Xaa locations
  Clone ID: PAT_TA_104179.pep
WSLISVATTATNAVXVPVPQLXPQNXSQQXPQEQXPLVQQQQFLGQXQPFPXQQPYPQPQPFPSQQPYXQLQPFLQPQLXXSQPQPFRPQQPYPXPQPQXYXQPQQPISXXXXQQQQXQXQXXXQLQINHS

SEQ ID NO: 209762 - protein, 94 aa, Triticum aestivum
  unsure (1)..(94): unsure at all Xaa locations
  Clone ID: PAT_TA_104180.pep
RKEAFATGGLNSRWXXSAPMTATMRVMALTTEVKSRYRSVQAITRDRSTDTNSWNCTKNGNLCVESLCDHISHVDYRSFRHPVEGEKFLLISKI

SEQ ID NO: 209763 - protein, 132 aa, Triticum aestivum
  unsure (1)..(132): unsure at all Xaa locations
  Clone ID: PAT_TA_104181.pep
QLPGPAGHLRLALAVTASFAISCIGRSRRRRRAXHKRIAFPPPPLRRLVSSSIRRLLPRPRPLGGGWPGRRGRRKAPAXXLVLLVLSLALGDRLAVLXEAWRXXGLGQALXIWAAVLGRAKKKKKDKRAPEG

SEQ ID NO: 209764 - protein, 81 aa, Triticum aestivum
  unsure (1)..(81): unsure at all Xaa locations
  Clone ID: PAT_TA_104182.pep
FKVHTCIHMQQEFTNERTVSSKSTHAYISNKXSQQHTCNQKFTNERTMXSKFTPSMNLKDAMSSTATCXPTRQRHPRCKLX

SEQ ID NO: 209765 - protein, 87 aa, Triticum aestivum
  unsure (1)..(87): unsure at all Xaa locations
  Clone ID: PAT_TA_104183.pep
DLDRDDDDDDVLSTSEKGTMKSKCXRQXXAKYCIAETEESDMCVVCSLNYYLSCYIDGMPITDIGTAALWKWLTSFXXRMENVFGLD

SEQ ID NO: 209766 - protein, 133 aa, Triticum aestivum
  unsure (1)..(133): unsure at all Xaa locations
  Clone ID: PAT_TA_104184.pep
FHFNXXXIANTSGDRTXTRNGXXVTSNGXLNIXEPXRRTXIXDXXDRSXRYXXGXXVXTDPXFLIXGPXRGXXILSLYXXXXRYXLPLXXLPSSXFFXXXXLPPLCFPFXXLPXQXSXXXXPXXXPSFFXPSL

SEQ ID NO: 209767 - protein, 87 aa, Triticum aestivum
  unsure (1)..(87): unsure at all Xaa locations
  Clone ID: PAT_TA_104185.pep
MDXXXLEEIXRQYXWEXLXKXTECXYCVSVEDRRSGKPXESVMINXPXCRQGXQXTRQXISRPGPVXVGDXSXGSXSXXSXEXLLXI

SEQ ID NO: 209768 - protein, 118 aa, Triticum aestivum
  unsure (1)..(118): unsure at all Xaa locations
  Clone ID: PAT_TA_104186.pep
MARGTAATAAAAAKGKKKGSVSFVIDCTKPVEDKIMEIASLEKFLQERIKVAGGXAGNLGDSVTVTRDKSXVTVTSDGAFSKKXLKFLTKXFLKKHNVRDWLPXIXXXKXRNVFXLRF

SEQ ID NO: 209769 - protein, 85 aa, Triticum aestivum
  Clone ID: PAT_TA_104187.pep
TLVAQCSFHSAMEAWSSSDSNPPSKASSHLPPFFFPVSTWFCVLEKRNEIFPASDCLVCCLVLTETFGSASFHFGDVKTSQICSP

SEQ ID NO: 209770 - protein, 75 aa, Triticum aestivum
  Clone ID: PAT_TA_104188.pep
HTTNLRESTRRTTVTGYTMANENCKAGASNIRKAQTVAILCSTKGASLERVAHFSYKRCQKKSMLVTAVAHIEAK

SEQ ID NO: 209771 - protein, 66 aa, Triticum aestivum
  Clone ID: PAT_TA_104189.pep
TYSFLTAVYLYNILIVEILKTFWLIITYCDTSVSLLSRQNLSIYIAIIGDVSFMASNTAYFRMVHM

SEQ ID NO: 209772 - protein, 50 aa, Triticum aestivum
  Clone ID: PAT_TA_104190.pep
LRSRTKQLLGTPGVEQLKQRLLVMFHLSKLEVTAFYRLRCNLTTVGRFSP

SEQ ID NO: 209773 - protein, 115 aa, Triticum aestivum
  Clone ID: PAT_TA_104191.pep
KPDRSIAASHLMALRNLVTRMGTPAAAALRPPSVSRGAQAARSRPFSRQVEHEDISKIRAKKKYEFSLFLLERSEKQLESAKVWAQRFQRADKYLGWTLKVVMPASLVAVIAGSK

SEQ ID NO: 209774 - protein, 181 aa, Triticum aestivum
  unsure (1)..(181): unsure at all Xaa locations
  Clone ID: PAT_TA_104192.pep
MLYFPTIISVLEVLAVTVPVLLTVAFVTIAERKTMASMQRRLGPNAVGXYGLLQAFADALKLLLKEYVSPTQANIVLFFLGPIITLIFSLLGYAVIPYGPGLVLLDYNLGILYMLAMSSLATYGILLAGWSANSKYAFLGSLRSTAQLISYELILSSAILLVVLLAGSLDITVIIEAQRAI

SEQ ID NO: 209775 - protein, 76 aa, Triticum aestivum
  Clone ID: PAT_TA_104193.pep
NQTAAHQSLDGSRVDGEMPRRASLADPKSTGRWGLRWPSIETGSCSEVTAEWGRAAAMAFLAKIVVGGVKNQQRSP

SEQ ID NO: 209776 - protein, 91 aa, Triticum aestivum
  Clone ID: PAT_TA_104194.pep
NDYICCYYSDAASGTATVAVGSGGGSGTSKAGVARMVVVSKGPSKFLAAHGLEQWWADDVELQVALNHSKLVDRQLRSLYAPPPAAPAARS

SEQ ID NO: 209777 - protein, 217 aa, Triticum aestivum
  Clone ID: PAT_TA_104195.pep
SRQSRILAALSKKVIDLDELRMLAAQGVPDGAGVRSTVWKLLLGYLPKDRALWEQELAKKRSQYEAFKDEFLPNTVGGSSTPGGSEGHSDGNAEHVENGFLDRSEIAQDDHPLSLGKTSQWNQVAEHSEMIEQVDRDVKRTHPDIHFFCGDSSFAKSNQDSLRNILIIFAKLNAGIRYVQGMNEILAPLFFVFRNDPDYKNANFAEADSFFCFVELL

SEQ ID NO: 209778 - protein, 94 aa, Triticum aestivum
  Clone ID: PAT_TA_104196.pep
PCRWRRSFMAGREGSKVMARLLFFWYKTEIQEDPGRRRQNGNKEWCHRGECAAACRAQRLIYRRLSSSYAGCYTSHLEPLALLHCPWAMAALMH

SEQ ID NO: 209779 - protein, 162 aa, Triticum aestivum
  Clone ID: PAT_TA_104197.pep
AGLLEMDLMETEAQLEHTVASVEAISEHQSMLKSSISDMQHVIEDLKDKYLKAETRAENAESKCTLLTDTKFELSEEISFLRGRVGGLENSLRQANQLKLSTAKDIGIKTKTITDLVAKLALERERLHLQIVTLTRKNRMLTQKCKENVNEGTLLSKKVTAN

SEQ ID NO: 209780 - protein, 162 aa, Triticum aestivum
  Clone ID: PAT_TA_104198.pep
MKQIDNQLLVDDNTTPNSLNDANKKVVVNPKSSSTNRVKKAIVDPNDVAQVVSRWTGIPVATLCEEEKDKLIHIGDRLHERVIGQDEAVNLVAQAVLRSRAGLDQPSQPTGSFLFLGPSGVGKTELAKALAEQLFDSEKMLVRVDMSEYATAGSVTRLIGAP

SEQ ID NO: 209781 - protein, 89 aa, Triticum aestivum
  Clone ID: PAT_TA_104199.pep
GYLLQVMLFNRKSPDAPARPLAIASASFTRSLSRTSDSKKAELLQLYAIREMTFHGSMDKLDLFCLSIFNMPQTEHIYSMLPSNVHRKA

SEQ ID NO: 209782 - protein, 76 aa, Triticum aestivum
  Clone ID: PAT_TA_104200.pep
PSMDLLYELGRNKYICCYVLVVRSIFTFKIKIRDRNRIGLTCPLLHSLSPSIVPLYIPLHGSDQYNIIFIQKKKKK

SEQ ID NO: 209783 - protein, 100 aa, Triticum aestivum
  Clone ID: PAT_TA_104201.pep
NYIGLEVITFIVESNLPPLTHLFSELSLRTVCEYRRRCTRRRRRCGSHCFGSDRINRLAGWRGGVLSAALLLGRWDRVFCGVCLGLGRRPAGSSRWSRDG

SEQ ID NO: 209784 - protein, 76 aa, Triticum aestivum
  unsure (1)..(76): unsure at all Xaa locations
  Clone ID: PAT_TA_104202.pep
YYRSQGTRGHGTLQNGALCVFLRLARPEAAPRPRARRGVGDNKTKFVLFLXXSSSPYSHPTLHTPTTIAGHHRSSS

SEQ ID NO: 209785 - protein, 129 aa, Triticum aestivum
  Clone ID: PAT_TA_104203.pep
TLGQGGSQDFFDLSVIDGFNTPMSFQPVGGAPCRAATCAVDITRECLPELQVPGGCASACGKFGGDTYCCRGQFEHNCPPTNYSRFFKGKCPDAYSYAKDDQTSTFTCPAGTNYQIVLCPARNDLHMDQ

SEQ ID NO: 209786 - protein, 60 aa, Triticum aestivum
  Clone ID: PAT_TA_104204.pep
LFSLLCLEKKRSGPLFHILQKDHGFKDTVVYKTLVFAEAKHIKVFKTMLFLRNHGIARKL

SEQ ID NO: 209787 - protein, 63 aa, Triticum aestivum
  Clone ID: PAT_TA_104205.pep
LCGRAGHPPSAPGSISPGLGSIPGRPEEERGRPPSVLSGEASRGKMLPSAICFSAFCSMNLQC

SEQ ID NO: 209788 - protein, 81 aa, Triticum aestivum
  Clone ID: PAT_TA_104206.pep
TTEHRIDIPSASLLVFMERPAGPAVLVSQHRSSLPAYRSAMALKVNSDPWSASSTILSSRTAIAGVMWLLQSPATPSRRRT

SEQ ID NO: 209789 - protein, 200 aa, Triticum aestivum
  Clone ID: PAT_TA_104207.pep
NQLDEAPIGHAEVNFLKSNLSDLMDIWVPLDGKCDPASNPKLHLRIFLNNSRGTEVVLNYLAKMGNEVGKKINLRSAQTNLAFRKLFNLPPEEFLIDDFTCHLKRKMPLQGRVFFSPRIIGFYSNIFGHKTKFFFLWEDVDDIQVIPPTLSIGSPSLMVILRKDRGSEAKHGAKATDHHGRLKFHFQSFVSFNDAHRIIM

SEQ ID NO: 209790 - protein, 158 aa, Triticum aestivum
  Clone ID: PAT_TA_104208.pep
ILYRIHLITVYQRKGNMFFEFSESLNPRFIFFSPQYQAYFFPPMLQHKMSVGGSCEGEMGDENLQAASQDSGQSSDPAVPPAPTSRISVKHVVDVIWTFNEFKRFLVTSIGFGGMLDLQMLQKLNLKFSAWTMSKVSTTRCTIVLAENKILKFSESMI

SEQ ID NO: 209791 - protein, 83 aa, Triticum aestivum
  Clone ID: PAT_TA_104209.pep
EPAAGPKPSEVYGFVGSITVVIATAVYLAWAYTPEPVLRSLGITYYPTKYWALAVPSLAMVALALSLLAYLGSNLVATPPPTS

SEQ ID NO: 209792 - protein, 80 aa, Triticum aestivum
  Clone ID: PAT_TA_104210.pep
IKMFSPKNWSNFVRFNSCKISMCATLWNGELNQENSVTRACATSLLFQRPRRRGACATRGLAHRRRVIHPGALTPHTPQP

SEQ ID NO: 209793 - protein, 169 aa, Triticum aestivum
  Clone ID: PAT_TA_104211.pep
ANLVMLFFLLRKLILPFYSFTLFCVILPLTMFVPEAELPIWVICYVPMIMSVLNILPAPKSFPFVIPYLLFENTMSVTKFNAMVSGLFQLGSSYEWVVTKKAGRTSSESDIFAMAEETDTATRPAPRLVRGVSEAGLEAWAKTHQLDNKDLQLKAQAEEVTSLAAAIKK

SEQ ID NO: 209794 - protein, 61 aa, Triticum aestivum
  Clone ID: PAT_TA_104212.pep
HLCIYFSLVYSYIDLITYSKKCKRNNFYHCESFLCYCSGKSLEEPNKIVAMSWDSFLYFLF

SEQ ID NO: 209795 - protein, 45 aa, Triticum aestivum
  Clone ID: PAT_TA_104213.pep
MMNSDGGRVLRERTLAALRQAEEALLEGGESEVTLARLVDAWIRA

SEQ ID NO: 209796 - protein, 199 aa, Triticum aestivum
  unsure (1)..(199): unsure at all Xaa locations
  Clone ID: PAT_TA_104214.pep
RDDDLTEHHTDKEKRMDLRSVDKFHYVDHERGNNEEQNLIRTEKLKERFDEKYDRDHREKTDRTERRRGEDVVERPADRSLERREHSIERMQDRGTDRVPEKGREDRNKERSKVKHAEPSIDRAHTSDERFRGQSLPPPPPLPTSFVPQSVAANRRDEDSDRRGGSTRHTQRLSPRHDEKERWHVEEGXAPLSQDDGKH

SEQ ID NO: 209797 - protein, 68 aa, Triticum aestivum
  Clone ID: PAT_TA_104215.pep
HNHLSENYNKKYTYRELMETCVDVKFGTKYVWVMNMISYHSTCIIITDSVSYFCFRILTYGLCPSHSN

SEQ ID NO: 209798 - protein, 70 aa, Triticum aestivum
  Clone ID: PAT_TA_104216.pep
KFSGRHLLFYSNPVSPLVRASGDVVPSKSGPLCRLLFLVREDNIHLTMSCPQHQVHCADCYSLSGRIIFI

SEQ ID NO: 209799 - protein, 146 aa, Triticum aestivum
  Clone ID: PAT_TA_104217.pep
SSWCQSVWFIEVIYYCSKFFRFDLEEGLGLCPGSAVVAEDGAAVRRWPSMSQSSGSSTYIYHDILLACLPVFFSPEILPSPSSSSATIMAAGWNKKMRWFGGEADLGRTLSPVDGVGVAGMGCGGGATLGEEERRGCVQREKEESD

SEQ ID NO: 209800 - protein, 117 aa, Triticum aestivum
  Clone ID: PAT_TA_104218.pep
SWLHLVAGTSFSDFFYHHPTKFRDIWTVALPHHFNSYMYNGAIQTLPLTFLTQLATTDLMPHGRQIEHYYYVHQAGQLYNSKLYRPKVQADGSFLRVWRRPETDGLEFQPYSSPIPQ

SEQ ID NO: 209801 - protein, 142 aa, Triticum aestivum
  Clone ID: PAT_TA_104219.pep
PAGGLQSDAIVRCQWQRATRSSHTSSSSGSSPTYEVVTGRAMVRVVLAVASRASMRGRKPGWHLDFIYCLAPAPSSSAARTVVHSPSPPSNFPISGATNFIHNLAMRFCAGGLQVKMQGNQPASLQQHTQALPSALLSQLFL

SEQ ID NO: 209802 - protein, 162 aa, Triticum aestivum
  Clone ID: PAT_TA_104220.pep
HGTVYKGILSDLHVVAIKKSNIVVQREIDEFINEVAILSHINHRNVVKLHGCCLETEVPMLAYEFISNGTLCEHLHHGSPRAIPWGDRLRIANEVGKAIAYLHSAVSIPIIHRDIKSSNILLDDALTAKVSDFGASRYIPIDEVGAATTTAVQGTIGYLDPM

SEQ ID NO: 209803 - protein, 92 aa, Triticum aestivum
  Clone ID: PAT_TA_104221.pep
KHPQNEGSNAMPDKQSQNSINTVCDECCLKVDATMGSGRSCCGRRRVPYKFSPRVCVRADRCLDPVSLHVGVDVSANLYFPVNLYLSVCLVT

SEQ ID NO: 209804 - protein, 46 aa, Triticum aestivum
  Clone ID: PAT_TA_104222.pep
EHANNAQYWHPCWCVCEINRESMKKDTHSVRITYSISLCMPKMHLK

SEQ ID NO: 209805 - protein, 78 aa, Triticum aestivum
  Clone ID: PAT_TA_104223.pep
SLASMEGALDTFFAASNRTCSTCFSSVVHGGNTLLRYPRSILTLCFLSNLLHHYQVEFLSFSMIDFYMTVLVLFCHLP

SEQ ID NO: 209806 - protein, 69 aa, Triticum aestivum
  Clone ID: PAT_TA_104224.pep
LCLVTNAEYESIVHAQRNMFLRLQDVWPQVMYMGCSMQGGSSCTSHAADRSTSWSVHGRGIVWPCKFKC

SEQ ID NO: 209807 - protein, 93 aa, Triticum aestivum
  Clone ID: PAT_TA_104225.pep
LLGSTCYIEMDHNSKREVAVFYPEGHPNGNAESVANAAAAKRRSKRILESVRRSLHVDDGTAEYYLSVTGGEARAAMMEFSEDLRWEQRQTGH

SEQ ID NO: 209808 - protein, 168 aa, Triticum aestivum
  Clone ID: PAT_TA_104226.pep
HRLYVGAKKVVEWDEEEDHVQITLDGVPVEVEAGKNAQWVSRAMPGLSVTRTDTVNTVVVELDGVFSISANAVPITDEDSRIHNYGKTEKDSLVHLDLGFKFHTLTNAVDGVLGQTYHSNYISKVNVTAKMPIMGGAPKYLSASLFSTDCTVSRFHRNGDAAIETFAS

SEQ ID NO: 209809 - protein, 89 aa, Triticum aestivum
  Clone ID: PAT_TA_104227.pep
FFFFFLQLYNLIKKEPIRHNISYNSQAKYIPIIHSTNLVFSYKILLNIHITSSSELRRIVGCGFSSGFFFLELLCTQLLKNEGQHRGSC

SEQ ID NO: 209810 - protein, 110 aa, Triticum aestivum
  Clone ID: PAT_TA_104228.pep
NKQLTDREIIIPPGGFKSLKLLRFFATTVPRLSFAVTGKEVMPALERIDMRFGAFEGIYGIETLKSLQEVHLSVGNQADEITKFLVQDLKDTPKYLDEKYANKWPKIITE

SEQ ID NO: 209811 - protein, 93 aa, Triticum aestivum
  Clone ID: PAT_TA_104229.pep
WTAASDDTSGGNASGGGSGNGGGQGGGVAQGPSMGVGSGSGIGGGQTGSTGSYGQGYATGTGAGTGGGGGGSNNGGSGGGGGSGSGSGSGGYP

SEQ ID NO: 209812 - protein, 96 aa, Triticum aestivum
  Clone ID: PAT_TA_104230.pep
GSVRLPHDGKARMVVPKSGFVMVICVVELELDSFEVGVARLSIRTCCPLKSDFSILFKTGVDHCVVLRIRAREKEELRPYHLFILHGPIVDFLKVH

SEQ ID NO: 209813 - protein, 158 aa, Triticum aestivum
  unsure (1)..(158): unsure at all Xaa locations
  Clone ID: PAT_TA_104231.pep
GGGSNFRSIHEXALGGKVNGDVVALVTDKPGCGGAEYAMCNGIPVVVFTKSKSAPEGVSTDELLNVLRDLKVDFILLAGYLKLIPGELVKAFPRSMLNIHPSLLPAFGGKGYYGLKVHKAVIASGARYSGPTVHFVDEQFDTGKTLXQRVVPVLANDT

SEQ ID NO: 209814 - protein, 72 aa, Triticum aestivum
  Clone ID: PAT_TA_104232.pep
LGINQLRDYNNNLPRTKFTKSLNGNSLPSLTCTSRWHVVSLATCRTCPAMPKSQACCNYNQYLLEFHAKLTE

SEQ ID NO: 209815 - protein, 60 aa, Triticum aestivum
  Clone ID: PAT_TA_104233.pep
GYIFLSIRRVSIVKSVCLIIITCHVKYIILGKFWCNLQVISMEIGCFLCAKPTVSFYNAC

SEQ ID NO: 209816 - protein, 165 aa, Triticum aestivum
  Clone ID: PAT_TA_104234.pep
LYDGMLIRYVKSSTAHLGKPAAAGESADMVDFDMTYYRSRDPRRARLHEDFLEEIEQMGLFKYGGLPHWGKNRNLAFAGAASKYPGMRRFLRVKSAYDPDGLFSSGWSDMMLGVSGGGAAPTTDAPGCALEGMCVCSRDAHCAPEQGYVCRPGKVYKDARVCTKV

SEQ ID NO: 209817 - protein, 105 aa, Triticum aestivum
  Clone ID: PAT_TA_104235.pep
GLIGSEATSGKTTPAAYRAAAEKICTLSLEEAKAAYPKARASDVPYLCMDLVYQYSLLVDGFGLEPTKAITVVEKVKHGEYFIEAAWPLGEAIEAVSPTKRLQDA

SEQ ID NO: 209818 - protein, 88 aa, Triticum aestivum
  Clone ID: PAT_TA_104236.pep
RSKSESELSRNHQIEQTQEHQIYVLEKGSTQDPHVSTVNGWIGDSSTRLEECTTPRQRSAGVGRRWERAEMGHRKEECQRAELRRNVE

SEQ ID NO: 209819 - protein, 126 aa, Triticum aestivum
  Clone ID: PAT_TA_104237.pep
MMPSSFAEWPERIETLEHGQKAVDGADITIQIHQMKLLDYLHTIRTGQVFGTVLAVVHTVEFQKTGVPHAHILVWQEKNDDQAPALADVDPDACTAAPANSVEAAVAQPARLNRIATTAAAASTIS

SEQ ID NO: 209820 - protein, 110 aa, Triticum aestivum
  Clone ID: PAT_TA_104238.pep
DYLDCFGDPEVMGKIGTDIEDFKCSWLFVQALVRVDERQKDILFENYGKSDPACVAKVKALYKELNLEVVFSEYEREIYEKLISDIEAQPNEAVQAVLKSFLHKIYRRMK

SEQ ID NO: 209821 - protein, 84 aa, Triticum aestivum
  Clone ID: PAT_TA_104239.pep
VVGTKKGVDDNTMVVNRTAKNIFHHQWHRVLLVLKMKHEQHVSLTGSKRSVGARNSRNNCLITYKHVNKLVFHGKNKLVAYINE

SEQ ID NO: 209822 - protein, 90 aa, Triticum aestivum
  Clone ID: PAT_TA_104240.pep
MLDPFALVKDEVSEISNRLRLTVVSEVPELTSAAGHFFRAGAEGKRTCPTVSPYFRVVLNILLLHQGTCCCLLRHISIYMMYVPVLIASA

SEQ ID NO: 209823 - protein, 148 aa, Triticum aestivum
  Clone ID: PAT_TA_104241.pep
PVTGDGMYMFMGKYKGDQVQNTLDINLNGPFSLFGREHELIMGFMATRSKQDVPMYGSIYPPVGGSIYDWRGEYPKPDIPRSGQNDIVQRQTGAYLATRLKPTDDLSVILGTRVSNFSGTDNTDFYDPTKADNRLTYRQTGVVTPYAG

SEQ ID NO: 209824 - protein, 85 aa, Triticum aestivum
  Clone ID: PAT_TA_104242.pep
IHHNTFCRSCKLIILTTSSELKLIKHPKIFSATQKDKKTIVRHMVCIHMPFKEFLEHLFSHDFAMVKPRSLQPKLLRTKQYSRSR

SEQ ID NO: 209825 - protein, 206 aa, Triticum aestivum
  Clone ID: PAT_TA_104243.pep
MASSGGMMLAMMGLVAALVCPAVASEFISMPTDDVVLPDGLSYDFHAQSCPNLQDMVRAAVVTARNKDIGVVAGLLRVFFNDCFPNGCDASLLLEESPHYLSERMILPHNAGLHEGALNLIESIRNTVHITCKNVSCADISMLATREAIMLSGAPSYDVPLGWMDSFGPATFDEVDEFLFIPKYSKIFDLVTVFGFRGFDRTDLAA

SEQ ID NO: 209826 - protein, 86 aa, Triticum aestivum
  Clone ID: PAT_TA_104244.pep
EGCFSSSFVTTFSVFWVNKWFFSFAFRLHKCNCNCMRSLATKPVDKYTCLLHVDAASSCYTFILQRLLCSTVVHALFNAHVGSKSK

SEQ ID NO: 209827 - protein, 195 aa, Triticum aestivum
  Clone ID: PAT_TA_104245.pep
HYSYKRTTGASPVPGIERTAVNEEVIQPQPIVTESFAHPQASTFGSDVLQKDHSYLPADIPKPSSEPEAITLLDNLVEAEHNNSGLTLLQTHHSNLPAAQSKPTTEPTPITLPIAQSSPMECQEMAQSDKEELDKCVEMILFMSSDMPSNMNENQEIASHGIENNLALSHHIKEVLTENLEQSFALAEMQTQCTA

SEQ ID NO: 209828 - protein, 50 aa, Triticum aestivum
  Clone ID: PAT_TA_104246.pep
CIQRVYSLGRQARVILGNFIVMGIDHCNCCNSSDHVSYVSHFFATALASL

SEQ ID NO: 209829 - protein, 96 aa, Triticum aestivum
  Clone ID: PAT_TA_104247.pep
TAKWVARLLDGAFRVPGVRRMEESCAEWGRYYARRSGGGGEGQRPWRPCLGAVNVWYNDELCRDMGCDPRRKRMKGQGLLAEWFQPYGAVDYADIQ

SEQ ID NO: 209830 - protein, 84 aa, Triticum aestivum
  Clone ID: PAT_TA_104248.pep
SLAYLPPDDASFLQNLRLFLICQDNLILGGQRSDKDENGIPDYNDGGSDMDLLMLSAGILDVLEALPYTRGTVCYNAPMLLSDD

SEQ ID NO: 209831 - protein, 43 aa, Triticum aestivum
  Clone ID: PAT_TA_104249.pep
CDDHPLYDATTQKLMNTNKVEVHAPAMLRLICPMLVMDSDICI

SEQ ID NO: 209832 - protein, 178 aa, Triticum aestivum
  Clone ID: PAT_TA_104250.pep
MDKMALYDDDDSDAAREIGELTQLRKLNITVNCSQEVLQVLITALNRTYSLRQLSIFDRGDGKIMNILGEMTSPPLLLRSMKLRGEIDGMPEWIGSLMHVVKLHITFRMLSCDEILGILCELPNLLRLTLAYRSCINDALVISAKYRFPVLKQLSVDKPFSREEIIFEQGSMAMLEKL

SEQ ID NO: 209833 - protein, 147 aa, Triticum aestivum
  Clone ID: PAT_TA_104251.pep
KGSVWTQKSAWRDLVGGMGATSFSISQILPNISPAPPKLEPATETSVACTEARREVTSLGMTSLESPAAITQPSSEQNLLSSTGTPSAGTTIGSAGHETRGHDESNKVEEPCVVPKITISEVCPFMRNEESVQQWSKAKKVLTGFSK

SEQ ID NO: 209834 - protein, 98 aa, Triticum aestivum
  Clone ID: PAT_TA_104252.pep
LHFGIDRALFCCGTPPYQETHQLDRRSADKDQTDILVVVNNHAYITLVQTHHSPVNHNHIYIHAGKHKTRNTCTDSQRRSCPKEQTSRTYYSPTSANT

SEQ ID NO: 209835 - protein, 190 aa, Triticum aestivum
  Clone ID: PAT_TA_104253.pep
EVLDVYPLELRFPFVPNKEMRCHLTTTTKTDCFVFCMLVPGVPDRYSGDLVGIVPGMCTSVTPVVRQAEEELPSGTDELEVLFWLTGCNDPDKLALQLSALSVYPGSPSQYELKAAFHELGWELHRTTLTAVVVAPEDDDLALVVNTPCKEEEFFYSIDCMDVHPTEPWVAIFAKNRKGVYLWNWQTNEK

SEQ ID NO: 209836 - protein, 111 aa, Triticum aestivum
  Clone ID: PAT_TA_104254.pep
IRRKLLDLNEQSSPHISYFQQFLSNCSGGDRAPAHATRPHGNMGLDAEPPRRACTEPPEGPSGSPLPCIGFTRPPVTHEFTRQQPAGAVHTPPHAVMALPRILPLAVVQPL

SEQ ID NO: 209837 - protein, 85 aa, Triticum aestivum
  Clone ID: PAT_TA_104255.pep
RVTKTQSHSQAHMNCTDRCCICPSELPYIVMLRHHGHLLVVVGRVRRRLLGRLRLRPPLVASGRLFLPDDVVPPVLEEVDERHGG

SEQ ID NO: 209838 - protein, 207 aa, Triticum aestivum
  Clone ID: PAT_TA_104256.pep
VRHLSIIVDDKDVDDRITFGDYKYDLSALGKRLKVENLRTLMLFGRYHGSFAKTFGDLFKKAKALRTIFLSGASYSVEDILHNFSETIHLHYLRIEPLGNAGNINLPNMLYRFYHLEIINLEKWKDLVSIRHITNLVKLRHFLVPKGDPDGHSYISEVGKLKLLSELRKFEVGKENTGFELSQLEQLTELGGSLSIYNLEKCKKGAR

SEQ ID NO: 209839 - protein, 212 aa, Triticum aestivum
  Clone ID: PAT_TA_104257.pep
SLQLLCKDLNGFSSMRIQSLPRLKEVVLHDGVSQGTKEEWKGATKNHSRRPKLLFVTKQMVDDHFKPMGIEAAPEISPAATATDTMVVESEPAENSKSPVVPPTDTTLLVTTQPDAISTRESVQVVTTSETVDARDLIGTESAAENSTVATTTNTTKKIDVESEPVGNSESPAAPPTDTMLSMTTPPNVISTRGSVQLNGGCQHDDDGKDLD

SEQ ID NO: 209840 - protein, 86 aa, Triticum aestivum
  Clone ID: PAT_TA_104258.pep
FIYLFKRQAAAIASTFAYISIPSATVMYVKYARGKNMYAIVAEATELTSIRHGGHRTSPVRPCPSHYSRTPELPFKCPFNRYSVPN

SEQ ID NO: 209841 - protein, 50 aa, Triticum aestivum; identical to SEQ ID NO: 209828
  Clone ID: PAT_TA_104259.pep

SEQ ID NO: 209842 - protein, 92 aa, Triticum aestivum
  Clone ID: PAT_TA_104260.pep
YMIIWIAVFDSSKITSRFCHVLSNNRSPKIWWPVAAISTLLRPFVMAIRNLDCCRHEILTEFVIQRANPTSFCTVFACSRIIWWQKSYIVSH

SEQ ID NO: 209843 - protein, 88 aa, Triticum aestivum
  Clone ID: PAT_TA_104261.pep
YEYQGRANSNLGRLQMRVRFKFNRKLGFFTYLMPCANNERKSRSAPLFFQEKDSESRASRKVINCIYSCETEMHFTKLATMFIGIVAC

SEQ ID NO: 209844 - protein, 113 aa, Triticum aestivum
  Clone ID: PAT_TA_104262.pep
MSTSVTPSAPFRSDTIEPLTGSNFPRWKSQVELCLGCNEFDYALREEKPVAPVAGVTGYAELKKEYDVKMEKWNKSNHIALLIMKATISPDISEALPKKDTAKDFLTEMEEQF

SEQ ID NO: 209845 - protein, 129 aa, Triticum aestivum
  unsure (1)..(129): unsure at all Xaa locations
  Clone ID: PAT_TA_104263.pep
LWWSSAIGAEDVEKNYTSCNVSSSSSCRWMMENRGKQETYSREDRYASNDSQNFLSAARASAILGDLSPSSASCAFCVCCKGSGEEKRWRVASXECTLFFIRIVNQLGVDAWCVFRSFHCCVSFPNSQN

SEQ ID NO: 209846 - protein, 96 aa, Triticum aestivum
  Clone ID: PAT_TA_104264.pep
VHYDRCRSHQKRGLRSIKIVQGTTRFQHFSLSTWNVQREQLVLISYLISVSFFLSNKYQRQLHVLRKNICHSFFFCFQKQETTTSSVPKYFLHSKI

SEQ ID NO: 209847 - protein, 101 aa, Triticum aestivum
  Clone ID: PAT_TA_104265.pep
RPSPWSSSTSSLFKLGLSSARLASFDCTLLRSIVVTLVCSMGDAGSVCFDLPLSPASTRVSFCPSRSGCTISPVAAFTFCSLLRLCFTHQGDGSSIYKVYH

SEQ ID NO: 209848 - protein, 82 aa, Triticum aestivum
  Clone ID: PAT_TA_104266.pep
QRDELEERSAYHVTPRRYTWHKIIGLPAETPRGAITPSSQDSLTGTMPVRTAPTRTPMWVSTTTLNASRRRRYPVAHARRHR

SEQ ID NO: 209849 - protein, 147 aa, Triticum aestivum
  Clone ID: PAT_TA_104267.pep
MYSWEMLSFNIHDGFLEAIVRGNRSGLLTQADYNNLCQCETLDDIKMHLSATEYGPYLQNEPSPLHTTTIVEKCTLKLVDEYKHMYGHMIDNVVLIVTGTLHERDVNELLEKCHPLGMFDSIASLAVAQNMRELYRLVLVDTPLAPY

SEQ ID NO: 209850 - protein, 166 aa, Triticum aestivum
  Clone ID: PAT_TA_104268.pep
VILGASKQKSKILCASIEKLTSLRSLYVKCYWTIGLKWLHSISSVPPLLRSLSLFGVLGEMPGWFGDLVHLVKLLLWSSYLAEGGKSMEILGALPKLMFLYLGYGSYAAEKLVFKAETFLNLRKLEVYCENQPRELIFEVGTSPQLEKIEIIQGRLESGVTGIKHL

SEQ ID NO: 209851 - protein, 98 aa, Triticum aestivum
  unsure (1)..(98): unsure at all Xaa locations
  Clone ID: PAT_TA_104269.pep
PLPTNASVITELVAHCSRRSGRAATTAAASTASRAHGRAARPAMRAPVAIHRSESVRTCPLCLLSRAERGRKRACVRACXEQNDYTCNQQSTRLYFPP

SEQ ID NO: 209852 - protein, 171 aa, Triticum aestivum
  Clone ID: PAT_TA_104270.pep
SMNGGVSAIVDEIPYLTSFLSDRQYKNDFKMLGCIYKTPGFGFAFRLGSPLVRNISTAILNLEGGDEGSQIEEKWFGTTSPSMGVGAVLDADSAPLTLQNFSGLFVITGSISTLMLLISIVRLVYARCIKLGKANMEIISYDFVDEGALQNGMENNPNPSQQHIREAITDD

SEQ ID NO: 209853 - protein, 55 aa, Triticum aestivum
  Clone ID: PAT_TA_104271.pep
INNEYDTARSYSGIITLLFCWTKNECQTYSLLVVFNLIVHSFVCSSSTLLIPLIK

SEQ ID NO: 209854 - protein, 68 aa, Triticum aestivum
  Clone ID: PAT_TA_104272.pep
HDLMTEINWICSSGSFYIGIDRYRYRYRYNHIDAKAELLAPAASIKKRFSRPICLIWAAILPYSLINP

SEQ ID NO: 209855 - protein, 122 aa, Triticum aestivum
  Clone ID: PAT_TA_104273.pep
ISRAYDKHKSKISSKQRVLTFLLVSGDCVLVGLQPILVFMCKVDGKFQFSPISVNFLTEVTKVFFAMIMLMIESRKQKVGEKSLLSVSTFVQAARNNVLLAIPALLYAINNYLKFIMQVNVH

SEQ ID NO: 209856 - protein, 91 aa, Triticum aestivum
  Clone ID: PAT_TA_104274.pep
SYAPMIMKEIIYHAIFILKRKHLNVLVSIQERKIEEAGLGIDLPDCMMAIGRSVLSFFATTPLHGLRVIKIASMTCNRCMRNSNAFEALPK

SEQ ID NO: 209857 - protein, 186 aa, Triticum aestivum
  Clone ID: PAT_TA_104275.pep
TASPGGFEAGGTAAASLDRGRSGHLVGAEGVLLPDSISPPSLLPPMRSILYRHSSYALMPPPLAVASLVASPVRARASAPVFPTSFAVDCASISSLSLTNSSLLLVHMMLMLMLGKLLVHPFMLMLMLGGVRFCWPNGLLILRMVLFLFFVFCIFPLLFCFFYISSSAFACYSYSEGYSLMRMLSD

SEQ ID NO: 209858 - protein, 113 aa, Triticum aestivum
  Clone ID: PAT_TA_104276.pep
VEKCMRNAHHLVSRLREKGVSAYLNDLTNTVVFERPRNEAFVHKWQLACERGIAHVVVMPSVRVEKLDVFVEELAVGRRMWHEGGGFSMSCVAEDTGEGNCLCDVHAKKSIAA

SEQ ID NO: 209859 - protein, 70 aa, Triticum aestivum
  Clone ID: PAT_TA_104277.pep
KANPLATILSAAMLLKYGLGAETAAKRIETAVTETLDNGFRTGDIYSPGTTLVGCKRMGEEVLKALESQK

SEQ ID NO: 209860 - protein, 72 aa, Triticum aestivum
  Clone ID: PAT_TA_104278.pep
YVSNVFIIFDCCMLYYLLFCTILGFIFHFYIIYGTNLLTGSPIQNCCYFAYFSVSNKWNIKGSPNGMKPSGT

SEQ ID NO: 209861 - protein, 117 aa, Triticum aestivum
  unsure (1)..(117): unsure at all Xaa locations
  Clone ID: PAT_TA_104279.pep
GTTWLXKSLAFTTVHRAAHPPSSADHPLLXRNSHGCVRFLEGIFFGRSVDEARDVLAAACPSPPRLLATHCHWAYSQLPECVTGSCRIVSICREPKDVLLSRHWLLKKVVAYGATSD

SEQ ID NO: 209862 - protein, 146 aa, Triticum aestivum
  unsure (1)..(146): unsure at all Xaa locations
  Clone ID: PAT_TA_104280.pep
ASKHSTSGKLELPSVSSALVLAAAIGTIEALALFLGSGLFLKLMGVSPVXSPMYKSARLFLSLRALGAPANVIMLAVQGIFRGFKDTKTPVLFIGLGNLSAVALLPLLIYGFKLGITGAAISTVASQYIIAILLMWSLSKRAVLLP

SEQ ID NO: 209863 - protein, 80 aa, Triticum aestivum
  Clone ID: PAT_TA_104281.pep
EGDNKSGSLKLIRLDASHPPIQFVWFGKALKHFTNYSYKINLGFVFYSFRSHLVRIIQTKAKSFGLQGIVIDRICMVHES

SEQ ID NO: 209864 - protein, 83 aa, Triticum aestivum
  unsure (1)..(83): unsure at all Xaa locations
  Clone ID: PAT_TA_104282.pep
QRASRSTTKGRNKNGQHSDHHVSLMYIHICSNFLFAVVNYICSNSFLYSNSIGHACTSYGSANAATEMCQQSTRDHLAXKKKK

SEQ ID NO: 209865 - protein, 90 aa, Triticum aestivum
  Clone ID: PAT_TA_104283.pep
RGAVDPTKVVTGKRKNPLSMEGTGKKERVKVVAVCVLLVVMLSAQQLQVADAVSVFCKCYVSTTPTAGSDAPRCSYYREGGCGRRRHTRW

SEQ ID NO: 209866 - protein, 198 aa, Triticum aestivum
  Clone ID: PAT_TA_104284.pep
WSALFTRLQTRQAVKFVNSLVVVMSLVSVKYGPGVLVSSVDTIQPNLFTTILQRFWIPNLKLIKGSLEIKLTAVASTKLLCESAVLLDAAAAQTWGKLLDSTVTLLSRTEQDGVQQEQNDGADAVDSQRTSGYSVSFVRLQYAGKSEDDLLKDINDPKQFLVTSLASLSAQSPGRFGPIIEQHVDPANKSALLQLCAA

SEQ ID NO: 209867 - protein, 96 aa, Triticum aestivum
  Clone ID: PAT_TA_104285.pep
IVRQYVLQITNLCGIFTFQITGQTFYSSTTCNWLKQLVLSFSDYTVIRPHKESSSFLMMCGPKSSCTQELAEIRSIASLSLIIKIADLVASPSINH

SEQ ID NO: 209868 - protein, 27 aa, Triticum aestivum
  Clone ID: PAT_TA_104286.pep
IIAWRCLVIAQEAGVYLIKLLISALSQ

SEQ ID NO: 209869 - protein, 217 aa, Triticum aestivum
  unsure (1)..(217): unsure at all Xaa locations
  Clone ID: PAT_TA_104287.pep
LYIVALGNGGTKPNISTMGADQFDNFDAREKIHKLSFFNWWMFTIFTGILFSSTVLVYLQDNVSWSVGYGIPTLGLVVSIVIFLVGTPMYRHKVPQGSAITRIGKVLAAALCKRRLPLPADSDELHELEHEAYTRKRKFRMESTNDMWFLNKASVKDVGGASSTSKWSLCTVTEVXEETKQILKLVPFVVTMFIPCTLIAQTNTLFVKQGTTMNRHM

SEQ ID NO: 209870 - protein, 99 aa, Triticum aestivum
  Clone ID: PAT_TA_104288.pep
SDYLNKMSARVPKIKPGRATVDYLTKIQTSTRFWGGLLLSLLATSSLLLDRYLRQINEGFSIGFTSVLIIVGSIIELRRSYQAYNVMPALSKVLKRYGA

SEQ ID NO: 209871 - protein, 79 aa, Triticum aestivum
  Clone ID: PAT_TA_104289.pep
HKLQRSLIYISLLLLIYETRGPVKRTHCLVVSPNLELCRPIMFLLFAIHASSWQWSGGHGVGLGSSQLLLFLSQKKKKK

SEQ ID NO: 209872 - protein, 145 aa, Triticum aestivum
  Clone ID: PAT_TA_104290.pep
LNRVLVSPNSGFSVGSVGMARLADFSFCRYIRLPLSCPITSHPIVRINRLLHFASFICVLGASPCCGHVVLLRPCVLQMLQNLLLFAQAFIQRLVPRVHRPPCSPHLQGCSQSRRRLLCPDILSCALSTVTACSATLVACLLVAR

SEQ ID NO: 209873 - protein, 34 aa, Triticum aestivum
  unsure (1)..(34): unsure at all Xaa locations
  Clone ID: PAT_TA_104291.pep
MSIHLKSHYQTFVLCPGXQTVLCQPSGGKARLTK

SEQ ID NO: 209874 - protein, 150 aa, Triticum aestivum
  Clone ID: PAT_TA_104292.pep
FPVALAAREAVSRKRARRASVTNGALLQEIGCRCCRSTTCARIGVQCSKIVQQPGSDANKLTRVVDVNGSSTVIEQASSVNGQLKHSKSQQRNKLLVGSNYQAVVPQWTGVPPENYGDPETLKWLGTKIWPPENEKKITPTYHDRIGKGR

SEQ ID NO: 209875 - protein, 29 aa, Triticum aestivum
  Clone ID: PAT_TA_104293.pep
LNIKNHDNLTINSQRHGTGCKAPQRLTQL

SEQ ID NO: 209876 - protein, 59 aa, Triticum aestivum
  Clone ID: PAT_TA_104294.pep
SEVWFSQVQDEIHSSFKNLCKGTLVTEFEFNGTRAISLQQTGTTTKIVYVFVIINCSPL

SEQ ID NO: 209877 - protein, 105 aa, Triticum aestivum
  Clone ID: PAT_TA_104295.pep
HHHCRSNQTPTEEKKETDSFFCSVSHKDFVFFLRPCRSPLIANSQRRETCKSHEIALTSARSAATHLTVAVEFSTDREPPTNTRRLLHGSGRSELHASSIMDSFR

SEQ ID NO: 209878 - protein, 137 aa, Triticum aestivum
  Clone ID: PAT_TA_104296.pep
VYTDSTLFNGKFELKPFSLVNAQTLQVITVTIPSGSSQKVELYSPPSSPWELQRLQNWLQNAREELWTPEQPKSPEPTRTEGFYRLFATKNNEKTAFHLNGLGGGVKVGTEVGIYSGASNTENALWQLTSDTALCAP

SEQ ID NO: 209879 - protein, 114 aa, Triticum aestivum
  unsure (1)..(114): unsure at all Xaa locations
  Clone ID: PAT_TA_104297.pep
ALGSYTICPFPTLTILYKYSVLQNRPNHLPLNLCILHYFARFQPPGSQSSNCCFREDLCNVQSSAPCDISIFCSRYSWVWYSVYGLVVNTALWLFALFLLLIQRLSCXKKKKKK

SEQ ID NO: 209880 - protein, 182 aa, Triticum aestivum
  Clone ID: PAT_TA_104298.pep
IGVTKECCKSFIAYKSLRNLGTQNLRSVTVWHGSGFLLEPWYPAPRSLEKLITWRSAVPCVPEWVGSLVNLQKLRLEVESLGQQDLCILGALPVLLTLDLEKTTKSSEGKLNVSGGDGFRFLRNLRYNMMLMFAQGSMPRLERIKIYLAKTESLIGDTYDFGLENLPCLIYVECRVSGNASA

SEQ ID NO: 209881 - protein, 159 aa, Triticum aestivum
  Clone ID: PAT_TA_104299.pep
WYGWIGENDTEPDPSPIEFRRQAHRLLWDALDYFVSVQADAFFPGFHNDGSGWPDYSSLIMGHRLYQTPSGITYRPDRKTVATLFENVSDHLYHPPRNWTMAARQHLNNSAGIEGIKMSAMMSKPASFLAHPLPECSCRTAKSPVVQPVKDKHGALLFG

SEQ ID NO: 209882 - protein, 57 aa, Triticum aestivum
  Clone ID: PAT_TA_104300.pep
MRNVQRFYYHVSDKSQWSSGGGLAVEALGGVERILVKGFRLYSFQLPDNNAPGIVIY

SEQ ID NO: 209883 - protein, 173 aa, Triticum aestivum
  Clone ID: PAT_TA_104301.pep
PIYFFYELFPTIVSSDSHDAIPFVGTIIRAMQVIYVDRFSPASRKSAVNEIKRKAAGNSFPRVLLFPEGTTTNGRFLISFQHGAFIPGYPVQPVVVRYPHVHFDQSWGNISLIALMFKMFTQFHNFMEVEYLPIVYPPEIKQENALHFAENTSYAMAHALYVLPTSYSYADSM

SEQ ID NO: 209884 - protein, 62 aa, Triticum aestivum
  Clone ID: PAT_TA_104302.pep
SIVHEVFNCLSPVVTTFLYYTTCAFATYELQVWPTFVDGRACSLVSPRIIISKQPNKKKKKK

SEQ ID NO: 209885 - protein, 121 aa, Triticum aestivum
  Clone ID: PAT_TA_104303.pep
RWDFAIMFKNGPPPQPAHWKHSRRIYPSLPISGTDHRRSQHTEYCPGSLVPYWLAASATVVTCSLRSGRQRAPWRDREKNVRLAMEAARTRRGGEDRRRTSFVFPAAAPHRDRSAVPAALH

SEQ ID NO: 209886 - protein, 185 aa, Triticum aestivum
  Clone ID: PAT_TA_104304.pep
GQGFLGGHAVGGLRIYQHPVTEESSCSPSSPRLPATGASDCHESSARHLFDGMLEMAAASDRDPFGDLPDELLSRVLSFLPAEDALQTCVLETRWRDLWRRLTSLRFVFDGPTFPRYNRFKRLVKLLICLRGNSPLIRCEIDAYPDDEPENMFTNTRLLIDYALACEAEELIVRAADIQYDLPVF

SEQ ID NO: 209887 - protein, 157 aa, Triticum aestivum
  Clone ID: PAT_TA_104305.pep
EHLKNGTIRSLLLELVLSLRLLIYQYGIVYHLHIVHENKSFMIYALSWLVIGIVLVSLKVVSLGREKFVTKFQLVFRILKGIVFLVLIGLMVVLFVGFDLAVSDVGASVLAFIPTGWFILLMAQVCGPLFRRLVIEPLGVLCCSCCPGGACRGPCCA

SEQ ID NO: 209888 - protein, 90 aa, Triticum aestivum
  Clone ID: PAT_TA_104306.pep
ALQTMMAVATSRLARKGVTRQHNFPVSLLIILMQGAHHRDIFWGSLFPLFIILEVSRKLKLEIWSDGPIIVELHHSLLFFGVKLNYIIHE

SEQ ID NO: 209889 - protein, 177 aa, Triticum aestivum
  Clone ID: PAT_TA_104307.pep
MQSLKVLHLHFEDYYFVDGMDAENESKKTIIATSLTNLGNLLSLTVCDGPEFVRESLCPMPLSLQKLKVLNSSIPHVPNWVGSLINLQKLRLELVRAEQEDLYILGGLPVLHCLILRIDGHEIRSTSLTEELEVTRVIVCGEVGFPCLRIFIFDSQCAVMNLTFAAGAMPLVDDLLI

SEQ ID NO: 209890 - protein, 195 aa, Triticum aestivum
  Clone ID: PAT_TA_104308.pep
MIDVLPCPTIGLRSESNMLEMMVAELNSNDNGHSNSMPTDSSNRAVQQVPDRETSSDVEEVIIGRTEEKQKILSILSEHITEKMVILPIYGIGGIGKTTLAQMVFNDQQFEDYTRVWVYVSPEFNLHKIGNSIIMQLTDKISNISTKQMLHNRLKELFAGKRILIVLDDLWEENPKEFDKLKVMLGLGVGRKVII

SEQ ID NO: 209891 - protein, 70 aa, Triticum aestivum
  unsure (1)..(70): unsure at all Xaa locations
  Clone ID: PAT_TA_104309.pep
MYIAQLTKSNXQESRIHKASSRRVMKLDSIQQLHHLKHKWQQRSHNSSTKKRLPGKQITYSITKVAMLLM

SEQ ID NO: 209892 - protein, 99 aa, Triticum aestivum
  unsure (1)..(99): unsure at all Xaa locations
  Clone ID: PAT_TA_104310.pep
VLSFQVHPXANVNLYNGQFYGFCGSRTTKFPSNLVKDPCHNGSHLASTYSALATLKIVCFDVLNLDSEVLLLSMKKLPRPDGSFMPTHIGAETDLRFVY

SEQ ID NO: 209893 - protein, 105 aa, Triticum aestivum
  unsure (1)..(105): unsure at all Xaa locations
  Clone ID: PAT_TA_104311.pep
QVIVNPMAVHLNXRLFEDPLKFNPWRWMDESKRSAMLKNFLPFGAGIRVCPAADFVKLFVTLTLHILVTEYRWEEMKGTDEFRSADVMFPQGYHIRLRPKDDQMN

SEQ ID NO: 209894 - protein, 160 aa, Triticum aestivum
  Clone ID: PAT_TA_104312.pep
MSGEVECSVCHAKVAVPAAAVSKAYDSHRSTVSSRQRALNVLLVSGDCVLAGLQPILVYMCKVDGKFKFSPVSVNFLTEITKVIFAIIMLFFQARRVKVGEKPLLTVSTFVQAAHNNVLLAVPAFLYAINNYLKFTMQLYFNPATVKMLGNLKVLIIAVL

SEQ ID NO: 209895 - protein, 66 aa, Triticum aestivum
  Clone ID: PAT_TA_104313.pep
FFFFFFKGKASSSFFHLRVCLGWSPCSRNCTCEDPVQKHKVRISSRAQCEFRAWHLPLPLYCTFNK

SEQ ID NO: 209896 - protein, 149 aa, Triticum aestivum
  Clone ID: PAT_TA_104314.pep
NDQLVSIVGSKLVQHHEEFDLVNDELTMFREKVCEQELLILEFKGEASSMKSCLDEAIHQIHVCKQEIVGLTESLASMSVALEESKEQNALLDATIWEMKRTAAPHTDGHIGDDAGSLEQFTLVSMQKLSKAYSDFESRLTQSMKQNDI

SEQ ID NO: 209897 - protein, 208 aa, Triticum aestivum
  Clone ID: PAT_TA_104315.pep
MEAVWGRHKVSKLLASSFFLLGFGSNDLFQSRPKSQADVAGLYATLVSNYSAAITELYGMGARKLGIISPGPVGCVPRVRLLNATGACNDGMNRLTVGLAAAFKSGLAAALSPTRLPGLAYSLADSFAGTRANFDNPQAAGFVNADSACCGSGRLGAEGECMRNATVCSDRDVYAFFDNVHPSQRAAELGAQALFVDGPTQITTPISF

SEQ ID NO: 209898 - protein, 89 aa, Triticum aestivum
  Clone ID: PAT_TA_104316.pep
SRTTTRRGRSPSVAHWLPGPGRQISGRRRPARAQGWMRTAAGCSPRSSPARALTVAPTRRKKTKLARRRWRRCTKAAMASDTDDSGRIA

SEQ ID NO: 209899 - protein, 71 aa, Triticum aestivum
  unsure (1)..(71): unsure at all Xaa locations
  Clone ID: PAT_TA_104317.pep
TVFYSRSNRPFLAILFIKMFDVLLDTRVAVCEELRXFFTLYTQFFSTYPLAKEVPMKIRYIIVSADLRIPY

SEQ ID NO: 209900 - protein, 120 aa, Triticum aestivum
  Clone ID: PAT_TA_104318.pep
LLTQKDCTSISTTTFGYSDYWIVPCKTTPTEPNASAAMRPNHTMVKKTGLKRKLKNGSIIGAMNNHESSRIFPFFFLLKKNLRQPEGLVMESCYTRQFMHDVCTTRQSSRPCMQQTAAQR

SEQ ID NO: 209901 - protein, 196 aa, Triticum aestivum
  Clone ID: PAT_TA_104319.pep
STLDNAAPTPKMNHKETRQGWRHEGSPNEPPDTRHRIRAAPHRGFDFTAPGSRGIPMDTPEKKSRLPRPKPRLRRCSPPLSLPQKPPCTSSHRKHQRDQILQDGALKRGTALKTTTPPDLVAGSGLSPEGLDPGVEAVKIPDNASKEDSDAHRRRRRRPVSTGQAFTRCSHSHAAGRGRPVPPLDRAPPTQRARHC

SEQ ID NO: 209902 - protein, 128 aa, Triticum aestivum
  Clone ID: PAT_TA_104320.pep
SAAKTADSATTNMSLRKLKSALKEGLEELEAKTVDSVIIEELEESSEGSEVSQHAETIVKTLHKFTITEEKNEECAKQNVALTNMSLRKLKSALKEGLIAAKEGKNLAITADEGSRVALAELDDNAEC

SEQ ID NO: 209903 - protein, 98 aa, Triticum aestivum
  unsure (1)..(98): unsure at all Xaa locations
  Clone ID: PAT_TA_104321.pep
TYILNRDMDTISRLVERVRDEGEYMLALLQLCVAEEAAAGAGAGKGRLVREVLXQLCKNEESFRQQLDELEEHLFLCFMTINKARSMVIKFMATAASR

SEQ ID NO: 209904 - protein, 118 aa, Triticum aestivum
  Clone ID: PAT_TA_104322.pep
GPHYEVETGRRDGNVSMLEEALTNLPPADGNVTVLTQYFAVKNLTMKDMVVLSAAHTIGVTHCSSFSKRLYNFTGAGDQDPSLEPAYGKTLTTKCPTEKMASVVPMDDVTVDKFDLGY

SEQ ID NO: 209905 - protein, 84 aa, Triticum aestivum
  Clone ID: PAT_TA_104323.pep
KRRTQTCIIFLRYSQILFFPVCMHKLYPHVLCTGSFVIPCSLHSQARPLSGFISLYSAAKLKSTPTCLKMLVIYFWTSGKCKQY

SEQ ID NO: 209906 - protein, 199 aa, Triticum aestivum
  Clone ID: PAT_TA_104324.pep
AATSGLTMRDGRAVVNDLQFTDNSSWVRCRKFRIGARVVPGSYEGARVAEAMTEAFNVRDHRGELYRKHYPPALTDDVWRLEKIGKEGAFHRKLRQNGVETVQEFVRMLTVRPEMLRAMMGDGMTDRMWEVTTSHARTCDAGDKVYAYAGQHGATVYVNSLCQLVRLEFAGVECAAQQLTRAQKAYVHQLCVEAFEQRH

SEQ ID NO: 209907 - protein, 84 aa, Triticum aestivum
  unsure (1)..(84): unsure at all Xaa locations
  Clone ID: PAT_TA_104325.pep
LTEQCLXKRNGGTASIPSIKQGEVLPLRAPVFSESFKLLRRAQAVAAKRKGGTASKQAIKQREVSPIPAPVISLSTVFNGLQRD

SEQ ID NO: 209908 - protein, 69 aa, Triticum aestivum
  Clone ID: PAT_TA_104326.pep
RHHFQKLFFTSGTNKGCHDETSEFSSLWANLVQYLCKYVQIQFLMHKHGAARYIGQISSYGFICKSYPN

SEQ ID NO: 209909 - protein, 83 aa, Triticum aestivum
  Clone ID: PAT_TA_104327.pep
SVHGSRRGRMSTSVSTCQRRQTGRSMLTPAWMSWRRPPPVTSSFMWPAPPATSLASILPATAVGMTELSCRTTPTRTRSSTVF

SEQ ID NO: 209910 - protein, 72 aa, Triticum aestivum
  Clone ID: PAT_TA_104328.pep
SRGVTQHSFLLLCSYPLVSLFFRDFFGFGFGTAQMTRRRGVLSVLHGPPPRKSPLTWSNSIEDLELPEEVFG

SEQ ID NO: 209911 - protein, 124 aa, Triticum aestivum
  unsure (1)..(124): unsure at all Xaa locations
  Clone ID: PAT_TA_104329.pep
LVVTGWVPQISVLAHDAVAAFLTHCGWNSTIEGXLFGHPLIMLPISSDQGPNARIMEGRKVGMQVPRNESDGSFSREDVAVTVRAVTVEEDGRRVFTASAKKMQEIVADGACHERCIDGFIQGL

SEQ ID NO: 209912 - protein, 162 aa, Triticum aestivum
  Clone ID: PAT_TA_104330.pep
KKFSSVLMLRLAFQSLGVVFGDLGTSPLYVFYNAFPHGVNDDEDVIGALSLIIYTLTLIPLVKYVFVVLRANDNGQGGTLALYSLLCRHAKISTIPNQHKTDEDLTTYSRQTYEENSLAAKIKRWLETRAYKRNCLLILVLLGTCTAIGDGILTPAISVLSA

SEQ ID NO: 209913 - protein, 110 aa, Triticum aestivum
  Clone ID: PAT_TA_104331.pep
MSGPYDQYNQGYQQYPPQGQYPPQQQGYGQQGGYQQQGYPPQQGQGYYDQQQQGYQQQGYNQQYGAPAHGGFQHGQQVAPYDHQQQGYGPAQQYPPQGQYPGQAPSGQFP

SEQ ID NO: 209914 - protein, 120 aa, Triticum aestivum
  Clone ID: PAT_TA_104332.pep
ELRRPVRGLPQVHGGDDRRVARRQRRRRRRWGAQRGELAGDVPRAQLAAALPGDPRGLRRRAGDALPLNSIGCPAAPVRSMLIGLTLWSESEINGTRSSWTCAMLRAYVRCLHRSFMAGS

SEQ ID NO: 209915 - protein, 125 aa, Triticum aestivum
  Clone ID: PAT_TA_104333.pep
SFGVVVLEVVTGAMAVDMRSPEVLLVRKVQVGQEQDVRGVEALADRRLDGRLDRRELVRLAKLGIACTRSDPAARPSMRKVVSILDGNDEVLRKFERRMESREEWERKNAAALSLVRRLQALGIH

SEQ ID NO: 209916 - protein, 158 aa, Triticum aestivum
  unsure (1)..(158): unsure at all Xaa locations
  Clone ID: PAT_TA_104334.pep
MINHRSLSEKKINHRWVDPAISQTLRARWIKESDFNDLVEETWQQAYASAWRKKNYIKKLNDGDGNSVEGTTPLSQHIHNYFSNLFSLEVQQVDPEIMQEVQTKVTNQMNDFLIXPYTHDDVRKAVFSIGDLKAPGPXDGLHALFFKKYWHVLGDAIS

SEQ ID NO: 209917 - protein, 63 aa, Triticum aestivum
  Clone ID: PAT_TA_104335.pep
NDVLVAPLRYRPPLSLLFRSIINGNVCVAGDALHPTTPDLAHGACIALEDAVVLTRCLCDAMD

SEQ ID NO: 209918 - protein, 70 aa, Triticum aestivum
  Clone ID: PAT_TA_104336.pep
VQSEVLMRKDASTFTFRQGWAFPRKIYFNGDECRMPPPDSYPYLPNSAPASLVSSASVVVAVAFLVLLMA

SEQ ID NO: 209919 - protein, 69 aa, Triticum aestivum
  Clone ID: PAT_TA_104337.pep
FFVEAAELERAVRSLMGGASEEGRKARRTAAETSAACREAVGEGGSSCAALQMLVREILVSPTEGNHSR

SEQ ID NO: 209920 - protein, 75 aa, Triticum aestivum
  Clone ID: PAT_TA_104338.pep
IFRVTSACSFPYKVFEHTNPWVILQAILTQSMIGSHSNVLYIVIVTTIWRIVILVVNFTCKITRTLTPSEQRYHA

SEQ ID NO: 209921 - protein, 153 aa, Triticum aestivum
  unsure (1)..(153): unsure at all Xaa locations
  Clone ID: PAT_TA_104339.pep
TASKYSRVRKXTLGIGGGGDLIAVIRASGSITRTRSGLSVSSSGIIAEQLIKKIRTVRESEKYKAVILRIDSPGGDALASDLMWREIRLLAESKPVVASMSDVAASGGYYMAMAAPVIVAEKLTLTGSIGVITGKFILQKLYERIDFNKEILS

SEQ ID NO: 209922 - protein, 100 aa, Triticum aestivum
  Clone ID: PAT_TA_104340.pep
ENVGQLCTSKRFLPVTMMAPSLRPLSASVQSTLSSSPQRKMKFAGARRRRTSKSSMQGCQLCIVQLRSLVKLEVSYRVSCEKFVQPNLRGCRPEMSLHQI

SEQ ID NO: 209923 - protein, 134 aa, Triticum aestivum
  unsure (1)..(134): unsure at all Xaa locations
  Clone ID: PAT_TA_104341.pep
LRRNKHGNGIPLPGGDQGFCTGRGSHKFLQAVMQGRMXWFTQAWSTPPSTCGVRVHIMLHMTLAKKLHAGLHRSRHSVSALGQARPFVMSAIAGCPAIDRRMTSTAHMATILSGNAAIVGWTKELVAWLASYED

SEQ ID NO: 209924 - protein, 88 aa, Triticum aestivum
  Clone ID: PAT_TA_104342.pep
CDYLQLLSCFRRLVSRAILVMFPRLQILVMFQLSSGFFGFACMPCYFCLLALWFSVSAPFSSCLYSDLMNTYGLLALLEVILNFVWVS

SEQ ID NO: 209925 - protein, 196 aa, Triticum aestivum
  unsure (1)..(196): unsure at all Xaa locations
  Clone ID: PAT_TA_104343.pep
STTGDKEFNDEVETLSRMRHPNLVTLIGVCREAKALVFEFLSNGSLEDCLQGEHQREPLSWRMRIRIAADICTGLIFLHSNKPKGIAHGDLKPDNVLLDNSFVCKLADFGISRPLDLTNTTVTPYHRTNQIKGTMGYMDPGYIASGEITAQYDVYSFGVVLMRLLTGKSPLXLPNEVEAALSNDMLQDIIDTSAGE

SEQ ID NO: 209926 - protein, 63 aa, Triticum aestivum
  Clone ID: PAT_TA_104344.pep
VNLYFVGGLFRFLFSVENPVLDFYAIFCCYRYETLFYYPQDKHVSDAKQGNIHYLFVILTILR

SEQ ID NO: 209927 - protein, 103 aa, Triticum aestivum
  Clone ID: PAT_TA_104345.pep
HPCSYDDVISPVSGEQGAGFEPSRDDSDLSGTRKRRDRSKTIVSERKRRFRMKEKLYELRALVPNITKMDKASIIADAVAYVKNLQSHARKLKEDVATLEARP

SEQ ID NO: 209928 - protein, 71 aa, Triticum aestivum
  Clone ID: PAT_TA_104346.pep
RLYPPQHLPHIYSMPHHANQRLPWRSFLHCFRRWEDRSRPELKLLHGLTWNIARVQSKNQCGACQADGESC

SEQ ID NO: 209929 - protein, 54 aa, Triticum aestivum
  Clone ID: PAT_TA_104347.pep
ACRGPCSAAAGPWSRPPPRRQRGRPPPPQPPRPPPPSRRPPHPSPLSDPRCLKP

SEQ ID NO: 209930 - protein, 149 aa, Triticum aestivum
  Clone ID: PAT_TA_104348.pep
RSGQSQTSADMEAAIGAANWLVGKVLTKLSDELVAAYVASSELGLNSEQIKTKLKYMQGLLHAAQDTDVSSNPGLQSLLEDLSKKADEAEDALDELHYFMIHDQLDGTQEAAPELGDGLRGHALHGRHAARHTIGNWLPCFSCSRTQAE

SEQ ID NO: 209931 - protein, 55 aa, Triticum aestivum
  Clone ID: PAT_TA_104349.pep
SMMFYEGHLSPNVNAFILNATNVLKLDHICFMKAILVQMLTHELPIRSSSYAELK

SEQ ID NO: 209932 - protein, 47 aa, Triticum aestivum
  Clone ID: PAT_TA_104350.pep
CGSVAMWRKTRFWPVLKCMGTLTLMVSRQEGKGGSASRKMQRGSRRG

SEQ ID NO: 209933 - protein, 97 aa, Triticum aestivum
  Clone ID: PAT_TA_104351.pep
FLLRWLTTTPSPARGSLSGPRASVGEVVGGVTTMTKPGASHRRLRPAPRACAAASQVLTIAPSSRDRYDQAQSSAPQVLARRRRLPLARWVRRNLRD

SEQ ID NO: 209934 - protein, 64 aa, Triticum aestivum
  Clone ID: PAT_TA_104352.pep
QLTTWYATCMPSHHFYFLKKIQKQSHICLVPVPDQGESKCNIISLLASKAWPDLVETRNNVCLS

SEQ ID NO: 209935 - protein, 172 aa, Triticum aestivum
  Clone ID: PAT_TA_104353.pep
KNRINVFLVDFSFIFQVPHTTFLLTHACFLFYHMASNITLRKLRHSTANLSMSLQWLFEVAWILALAYFIAYLETLAISNFPYYEFIDRDIMYTVGSLFYALYFLVSFPMFSRIDEKAEKWSLSRVAIDALGAAMLVTIILDLWRIFLGPIVPIPESRQCAQPRLAWFQVHT

SEQ ID NO: 209936 - protein, 54 aa, Triticum aestivum
  Clone ID: PAT_TA_104354.pep
KYRGSNPAWNHFMQGVFMFCNHTFTIYVIGNMWSKGCSQGVWCFHVGGDFFTNN

SEQ ID NO: 209937 - protein, 133 aa, Triticum aestivum
  Clone ID: PAT_TA_104355.pep
AGCAKLNVDAAVSRRGFGTIGVICRDQQGGYMGASAIVFRYIADPTTLEALAIREAMDLADDLYAQRIHVASDCKVVIDDIQKKNLSSYGAIVQEIISHSLSFTFCNIVHERRSSNFEAHNLAKHALTWELAA

SEQ ID NO: 209938 - protein, 182 aa, Triticum aestivum
  Clone ID: PAT_TA_104356.pep
IIGCEVISLESYYKPEQVRDYKYDEYSSLDIALLTKNIKEIRNTHKAKVPCFDFEKFKRNGFKEFQVSEECGVVIFEGVYTLHPAIRKSLDLWIAVVGGVHSHLIARIQRDKNRAGFSISQNEIMTTVFPLFQQYIEPHLVDAHLKIQNDFDPVLSPESSPFVLKSTKQVSYQDILKVLDGS

SEQ ID NO: 209939 - protein, 194 aa, Triticum aestivum
  Clone ID: PAT_TA_104357.pep
GRTEDAFRESVASLKRNKLGLKGILHTPISRSGHQSFNVAMRQELDIYASISLIKNIPGYETRHKDVDLCIIRENTEGEYSGLEHQSVEGVVESLKIITRAKSERIAKFAFSFALANGRSKVTCIHKANIMKLADGLFRSTFHQVAKDYPTLETNDMIVDNASMQAVSRPQQFDVMVMPNLYGGILSNIGAALV

SEQ ID NO: 209940 - protein, 50 aa, Triticum aestivum; identical to SEQ ID NO: 209828
  Clone ID: PAT_TA_104358.pep

SEQ ID NO: 209941 - protein, 181 aa, Triticum aestivum
  Clone ID: PAT_TA_104359.pep
IQYPSLYRIVQRREVFVASVFQSIPLNIQFRRTLAGNRWEDWLRLVRRLMEVQLSQQPDELRWKLTKFGVFTVKSMYIDVINSNSIPTSKHVWAVKVPLKIKVFMWFVHKQVILTKDNLIKRNWTGPTRCSFCDRDEKIKHLFFDCPLAKVLWQTVHITFNIDPPNSVNALFGTWLNGIEP

SEQ ID NO: 209942 - protein, 110 aa, Triticum aestivum
  Clone ID: PAT_TA_104360.pep
GPRTLFPGAVHYAPLVRPRSDRGRGAGRPAPHAGTRCGAPPSLLLLRLLQETNIRCWSPAWPARGCSPALTCSHVSVSSMKMYIQAYVFINSNSSSLPLGTCWLWRSLRF

SEQ ID NO: 209943 - protein, 89 aa, Triticum aestivum
  Clone ID: PAT_TA_104361.pep
MANYRLGGGGNGHYEMAAAAAAAWREPESPQLSLMSGCSSLFSISGLRDDDTDLHLLAGARSLPSTPVSFGGFPGGYEVDMELRQGGGS

SEQ ID NO: 209944 - protein, 52 aa, Triticum aestivum
  Clone ID: PAT_TA_104362.pep
GMAACKSDRSVNHRINLKCNPINYTYPKAWRSLHVERHWRTRSYTILTGHKI

SEQ ID NO: 209945 - protein, 178 aa, Triticum aestivum
  Clone ID: PAT_TA_104363.pep
IYASHTGSTISRKRVRTRKQFIYPVLRPIENKLQQMEPPEDSSPMLPSSSPKRTNLGADHIKKLQQTSSNSVTKVGFSKSVPFSFPSENASYQEKGSPPSEESKCQTRSPNLLDGGALSKSNSDEKRAAMSLTHWLKPSSTDNENQGVVTSSASDQPRDENTLFTESPVFTAASGMDA

SEQ ID NO: 209946 - protein, 82 aa, Triticum aestivum
  Clone ID: PAT_TA_104364.pep
FLFHSFLAYPSHSLKIRMCSDLFTSLYFPSSQRVDLLLPNRFLLLLLCLIITQIFFRGSLITQFRDSDVDLNYFSLSSDAPV

SEQ ID NO: 209947 - protein, 104 aa, Triticum aestivum
  Clone ID: PAT_TA_104365.pep
TSKRAKLESGHSSPSDDLMTHMLAEGLADEEIIDNVMFMMVAAHDTTATLLTFLLRHLGGNRDAYGRVVAEQQEVARSKAPEEALSWDDLGKMKYTWSAAMDTL

SEQ ID NO: 209948 - protein, 52 aa, Triticum aestivum
  Clone ID: PAT_TA_104366.pep
YGPLVSLPSGLSSFSVTQSTSTSGYGTHTSTSSDVSTIGSKDSSSLLKHQYS

SEQ ID NO: 209949 - protein, 108 aa, Triticum aestivum
  Clone ID: PAT_TA_104367.pep
DRRRGAAADLSRQPSIQEFVHVPGETTQSNEHMGLVTPPATLRGANTCAYGPDVNPDVPADDSGSVIVVPGWKKRLSHAATGECLVHVLSICSPLPPERISPCVRQSL

SEQ ID NO: 209950 - protein, 55 aa, Triticum aestivum
  Clone ID: PAT_TA_104368.pep
MAMVAQAGFGLTRVVMLVGAGVAGSVVLRNGRLSEILTEIQEFLEKGEMGKGGGG

SEQ ID NO: 209951 - protein, 47 aa, Triticum aestivum
  Clone ID: PAT_TA_104369.pep
KEWRLNRKHINHGDAIHHARITAASSCARSARTWSPPLSAKEAPAAA

SEQ ID NO: 209952 - protein, 50 aa, Triticum aestivum; identical to SEQ ID NO: 209828
  Clone ID: PAT_TA_104370.pep

SEQ ID NO: 209953 - protein, 100 aa, Triticum aestivum
  Clone ID: PAT_TA_104371.pep
LSQRAKEVDVVLQHLLEREERCCPEGSPVVGSGHSATTSHGGGALEGAAWVLGLCHAHPAVPPLVSLLLPCFFLPLILLVFFQEHARTTMVPPRRTPTLA

SEQ ID NO: 209954 - protein, 110 aa, Triticum aestivum
  Clone ID: PAT_TA_104372.pep
MGRHSSSSGKTEAGGEQYRKEEKHHKHMEKLAKLGAVAAGAYARHEKHEARKDPEHARSHKMKEKIAATVAAGSAGFAIHEHHKKKEAKKHARHAHHHRYNHGCICTCRP

SEQ ID NO: 209955 - protein, 71 aa, Triticum aestivum
  Clone ID: PAT_TA_104373.pep
DVSSSPCVLCFFRDAKKNQNQTEYSFGQEKGNLLDESCSDMFPLLATCRNGIRSEQHVDSFITRAKKKKKK

SEQ ID NO: 209956 - protein, 97 aa, Triticum aestivum
  Clone ID: PAT_TA_104374.pep
TCQVGREGAAAGASATSCAGKLRSGSAKPPPACCGFLCRRSASSDPTIFRLFEEEECSNLVSSLPFSLDSAVQALSSVSISRRRPTSPPTGTAPAAS

SEQ ID NO: 209957 - protein, 76 aa, Triticum aestivum
  Clone ID: PAT_TA_104375.pep
VAYSQKSVKDSRDSEWSGVKNSHPTKHGENFLWSGVFVAGLYGQKTVLLFLLVLPLYLGLFENKDFKVYCLLILLM

SEQ ID NO: 209958 - protein, 88 aa, Triticum aestivum
  Clone ID: PAT_TA_104376.pep
NFTVRYAYRMIVKTKLSRENWLEEGEGTFDGAEENRGWTSLWNIWAPSKLKVFLWRLARHSIPTAQLLHHRNVSTMCVCSLWGAKDTW

SEQ ID NO: 209959 - protein, 152 aa, Triticum aestivum
  Clone ID: PAT_TA_104377.pep
RSSWSDLPTDLLLRILQRLQLQESLAFALVCTSWSWAAAAAGVPCSCRPWLMSWTHLVEESQPKINWSSTVTCKFRHLVDVNKSYDVDFPKGCFVACAGASHGWLVLVNELSNLLLFNPFTSDMVSLPPITDFSFVEAIYDNQGTHRSLSFF

SEQ ID NO: 209960 - protein, 217 aa, Triticum aestivum
  Clone ID: PAT_TA_104378.pep
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTLDEMEGPLEVGADGTLKFEEKDGIDYAAVTVQLPGSERVPFLFTVKQLVATGK

SEQ ID NO: 209961 - protein, 81 aa, Triticum aestivum
  Clone ID: PAT_TA_104379.pep
EDIYRQVLAIGSFGRLDNDGDGRREFGRQTALHTYLGDVDDIPGRKATLLDAGSILTLPMLFLHGVILFPGATLPLKLIEA

SEQ ID NO: 209962 - protein, 102 aa, Triticum aestivum
  Clone ID: PAT_TA_104380.pep
LYFGRMSLMMNTWDSHIELIELKERAGHLLNHRRHLRLQVSLHGAHKLHPFHRWHQRKHCRPTATHTTTTIFPIDVPRSQPRIDQSAPNLSHEFCFGSERPA

SEQ ID NO: 209963 - protein, 82 aa, Triticum aestivum
  Clone ID: PAT_TA_104381.pep
DTSQHWLPPPPQVPCPSEIGDMPSLRVIQLYNNSLTRRTIPSSLGNLSWMTTLSLAANHLDGSIPEGIGNNAHLEFLPGHEQ

SEQ ID NO: 209964 - protein, 154 aa, Triticum aestivum
  Clone ID: PAT_TA_104382.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYPDPLI

SEQ ID NO: 209965 - protein, 183 aa, Triticum aestivum
  Clone ID: PAT_TA_104383.pep
PAVDAVYLPLPTSLHVQWATAAAARGKHVLLEKPTALCAADLDAILAACDASGVQFMDSTMWMHHPRTAKMRDLLPADVGDVRVINSLFSFRANEDFLQNDIRVKPDLDALGVLGDAGWYCIRAILWAVNYELPKNVIALPDPVKNQAGVLIACGATLYWADGKTATFHCSFLANLTMDLTVV

SEQ ID NO: 209966 - protein, 87 aa, Triticum aestivum
  Clone ID: PAT_TA_104384.pep
MAPKAAEKKPVEKTPAGKKPKAEKKVPASKEGGDKKGKKKAKKSVETYKIYIFKVLKQVHPDIGISSKAMSIMNSFINDIFEKLAGE

SEQ ID NO: 209967 - protein, 55 aa, Triticum aestivum
  Clone ID: PAT_TA_104385.pep
GTSPPPAPSPPAALATERGKQEAAADELPTEPRRRQDLFRNPSARSWIWEGRARG

SEQ ID NO: 209968 - protein, 101 aa, Triticum aestivum
  Clone ID: PAT_TA_104386.pep
FFFFFFFFFFFFCQRWGVPGLPFFMQGIGHYPSTSGWAYKPLSFHFKTQVNKKKTQGSTPDHLPTLFTLTRGKHFMFKKQTTLTHLAYHTYSGIFIHFEPQ

SEQ ID NO: 209969 - protein, 66 aa, Triticum aestivum
  unsure (1)..(66): unsure at all Xaa locations
  Clone ID: PAT_TA_104387.pep
DIFLGALPEGLXNAGKCIELDPTYLVGYTXLKVQALMQNYESAMATYIEGLKCDPNSTIVIDGFKR

SEQ ID NO: 209970 - protein, 85 aa, Triticum aestivum
  Clone ID: PAT_TA_104388.pep
NTDSAFQSATHSALLSALSENMNFMEVPKADECQTPSGSHQSSYLPDATSSSRNGCDASKQHDTEPVSKSIDSDAVNNEPVVNCG

SEQ ID NO: 209971 - protein, 52 aa, Triticum aestivum
  Clone ID: PAT_TA_104389.pep
GALWNPETPPPCIVIPPGTRPPGEEADALFVRRGDGTVGSRPAGQYAPAAAA

SEQ ID NO: 209972 - protein, 69 aa, Triticum aestivum
  Clone ID: PAT_TA_104390.pep
AGAMLCIRSPAPAGKRHHRHNPPHGCWMNSLCYSLLIRPHLLRFPSDKLIQAETPMPSQQRTQAGSSLP

SEQ ID NO: 209973 - protein, 38 aa, Triticum aestivum
  Clone ID: PAT_TA_104391.pep
LEIKKFMQTSYAVCWVCTKNVAFLTNTQRVTLLCGTTA

SEQ ID NO: 209974 - protein, 23 aa, Triticum aestivum
  Clone ID: PAT_TA_104392.pep
ELTPRFCTNLLIYKGEIVESYNF

SEQ ID NO: 209975 - protein, 103 aa, Triticum aestivum
  Clone ID: PAT_TA_104393.pep
ECLMMVKHKNIVRFLGYCADRQGSMERCNEKFIMADVHQRLLCFEYLPHGSRYEYITDTTHRLQWRDRFQIITGICQGLHHLHQNNIVHLDLKPANILLDANM

SEQ ID NO: 209976 - protein, 66 aa, Triticum aestivum
  unsure (1)..(66): unsure at all Xaa locations
  Clone ID: PAT_TA_104394.pep
SARIKGAICIKCNIKLYTXHTHTHTHTQLKCSFIIHVINKQSREWSFLYSNWPASHFHNNIDKLRA

SEQ ID NO: 209977 - protein, 172 aa, Triticum aestivum
  Clone ID: PAT_TA_104395.pep
DEKPKVKKVEAEVFPDAKDAELLNQTATEPGSWRTQAAESNTETNERTNASSSVPAASHSWKLCDVDAGADYIPCLDNVEAIRKLRSDKHYEHRERHCPEEAPTCLVPLPPGYRSPIRWPESRDQIWYSNVPHTKLVEYKGHQNWVNVSGEHLVFPGGGTQFKRGALHYIDF

SEQ ID NO: 209978 - protein, 156 aa, Triticum aestivum
  Clone ID: PAT_TA_104396.pep
TPAGLSPRLPFNARPPSHQLPNLACTTPCPDQQQQAEETSAAARSTATTSSSRVNQHAAVATVGGVIPSTYSSITDYLHGLLDPAELAKHLDVPPCYPTMRDAIGAVATPVTPNSSTSGEAAGAESHGCKRGSPSPEEGDEDRSADHGSCRSEKKK

SEQ ID NO: 209979 - protein, 87 aa, Triticum aestivum
  Clone ID: PAT_TA_104397.pep
SRPTPRRSLTPTVSEELSNGVQRQHRLDLHRRSTILSGQRQNGARPVYQRPERPSSTPRSAIWKRSNSSYSCTPYGCAAAESTHHQV

SEQ ID NO: 209980 - protein, 113 aa, Triticum aestivum
  unsure (1)..(113): unsure at all Xaa locations
  Clone ID: PAT_TA_104398.pep
RHARDVHSQIQGHVQQMGLNLSSXGDDMVQFRRCLTAAFFLNAAMRQPDGSFRALATGQSVQMHPSSVLFRTKPDCVVFNELVRTTQNYVKNLTRIDPLWLAELAPQYYATED

SEQ ID NO: 209981 - protein, 80 aa, Triticum aestivum
  Clone ID: PAT_TA_104399.pep
CIESLDATEPPRYRAHVCSSSKTLCPRMLSYFNYIGFRPLKLQESDLAVQIAQKTIAQGYDGVISCSCNQSIQGQLLITL

SEQ ID NO: 209982 - protein, 179 aa, Triticum aestivum
  Clone ID: PAT_TA_104400.pep
RTFGLSMGVNGYTISKHVINMMGKAIISEQRDAHFLKHVLHSELGKMLQGPSPCRESISNYLSEPNQGFKLENMDAVLVPLLNSKTWYLLVANFWKRRFEVLSPMGCTDELITQAQSIVCNFREDFHSAYPQLHSVKIKDMDITFHTISNSDNESDSGIFIMKALDLYDGEEHIFFNDS

SEQ ID NO: 209983 - protein, 127 aa, Triticum aestivum
  Clone ID: PAT_TA_104401.pep
TGGVGRREEPGAHPSSHGCPVDLEVPVAGGSSDASRRRTRSMDIVIMVTLSQCIIFGSHIPQGAPSSDSMSDDLRNKRRNNPAEEFGEEEQEKNTFILIGMETPVRIECIIANQLLCMVSGHACLFL

SEQ ID NO: 209984 - protein, 176 aa, Triticum aestivum
  Clone ID: PAT_TA_104402.pep
YPRAARRPHARQTRSDLDGAAATKCAPPPPYAHRPRQIHGNSFQKKLSLMFGMRSESGPKGSGDGGPTQRASALAALSSAFNPSSQDKQSTDRPQSSGDGGPTQRASALAALSSALNTSGKPKSPQSQSRAGQGSQRAAAVSALSNVLAAESPRIDAEGEAAGSSEFEMVDEGGAN

SEQ ID NO: 209985 - protein, 186 aa, Triticum aestivum
  Clone ID: PAT_TA_104403.pep
MRRGDGEDDARHHRRIPRADEIDAARFPMTICYSDDDEEIDLKSPSEIVALHAACRDRITEYDPKKRARVLTRFCGVNLAGFDLDRESKVGLGPLLEDVTPQLWKFRAETSYNVVSVKIIESDLGYPISVFGTVLARDTIDYRCVYLFRRERDDPQIISSKEDMLALVGPRRGLVAFDHIHFEFNL

SEQ ID NO: 209986 - protein, 128 aa, Triticum aestivum
  Clone ID: PAT_TA_104404.pep
SHSLNRRGGWVRSPRSFLPPHPSPCRSRQSLVLNPTFSLPLDLPRCSLRLAPPSHPHGGVRGRDDDRVIRQPRRRGAVGPRSRGALRPAEHGPGIVRVGDGPVDVGPLGATRGKGSHGSHEMQLLLVE

SEQ ID NO: 209987 - protein, 163 aa, Triticum aestivum
  Clone ID: PAT_TA_104405.pep
MLRVVSTLRPLLRSPLLRSPLLPGPKPLPRPRRPPRPFRALSSAAPLAASPPSAPAPAPGEVEISEEHLIRCAAARRAPLRVAVLVSGGVDSSVALRLLHAAGHSCTAFYLKIWFQEDFRNFWSECPWDDDLKYAHAVCDKIDVPLEVGHLSDEYWNHVVSHM

SEQ ID NO: 209988 - protein, 202 aa, Triticum aestivum
  Clone ID: PAT_TA_104406.pep
KPSIYWVDAQDIAHDHDIESEDWHIAIEALCEVLPSLEPVIVYFPDSSQWLSRAVPKSNRGEFIQKVDKMFDQLTGPVVMICGQNMPAAVSKDKDKEPPTLMFQNLTRLSSLPSSLKRWLKVQNDSRPSDISKIFTNSFIVPLPEEGEQLRVFNNQIEEDRKIIISRHNLVELHKVLEENELSCVELMHVKSDGVVLTSKSG

SEQ ID NO: 209989 - protein, 175 aa, Triticum aestivum
  Clone ID: PAT_TA_104407.pep
MAATSPAPMRAVAAAFTPPPLSQRITRISTVSAVHLHQCRAAHRWRPAQCRGKPAVSGVAEDDEEDTSREALNLEEKEEESAGAGSWGLGWFRLDEVGMDILGIAVPAVLALAADPVTALVDTAFVGHIGSVELAAVGVSISVFNLVSKLFNVPLLNVTTSFVAEQQAVDAKYSG

SEQ ID NO: 209990 - protein, 67 aa, Triticum aestivum
  Clone ID: PAT_TA_104408.pep
RNCFCSTDTIFAYLTIQEKTELTSLCAPFCLTSSIFRSYKGKRVLTYDHGYPFRKYCSRPVNVMNIV

SEQ ID NO: 209991 - protein, 151 aa, Triticum aestivum
  Clone ID: PAT_TA_104409.pep
MHARGEHDHIAGILKYDLGSNCLSLIDMPLPGAVNVGDVILMAMEDGSLGLAHASGSTLYLWSSSSQMGVATWTQRRAIDLKSLLPIQNPMEGLRLIGSMEGSDIIFVLTDLGIYQINLNSLQWNKIWKRQKFFALIPYMSFHNPQERMTP

SEQ ID NO: 209992 - protein, 51 aa, Triticum aestivum
  Clone ID: PAT_TA_104410.pep
YNLSLKLRHLLWIGGSSSFSIERTYSLRPIVTSYFLHIDCNNIFILWTEGE

SEQ ID NO: 209993 - protein, 64 aa, Triticum aestivum
  Clone ID: PAT_TA_104411.pep
SVIQWYHILPPSGFIRPSSILRQTLTIHLANKNKNICYKKYTLGFVFERAWPKYNFCDIWFTFY

SEQ ID NO: 209994 - protein, 132 aa, Triticum aestivum
  Clone ID: PAT_TA_104412.pep
MPVTDGDHGASVLRFGLPELEAATCRFGESARIGIAGIGRAGVYRGSLRGVSVAVRVISPDAAVGEARFAREADAIGRLSHPSLVALVGTCPEARAVVHELVPAGSLEDRLDQGGEGTLPPLPWMARCRVAH

SEQ ID NO: 209995 - protein, 59 aa, Triticum aestivum
  Clone ID: PAT_TA_104413.pep
TKTTTLILKRREYCLFVAFETQKTATLYNSFLQTHTTFFVSYYLCLLACNINRVDTQGG

SEQ ID NO: 209996 - protein, 154 aa, Triticum aestivum
  Clone ID: PAT_TA_104414.pep
MECGHCGEGLSIPRGARAVQCAHCRGVTRVGRRHGFVGFVVNMITNMAGGGRTRPATPPRLREAVYPRVQGDKRALLVGISYAGTHLPELSGPVTDVKSMSFLLTQKYGFPSQCILVLTDEERDPYRTPTKSNILLAMRWLVHGCSSGDSLVFH

SEQ ID NO: 209997 - protein, 182 aa, Triticum aestivum
  Clone ID: PAT_TA_104415.pep
RTIPHPIRPNPHQAALRERERERERERGMGRARRGTAAKGKRRPRAAAKAAAVAGDGHEETKDGPEKAAGGGGGFFCCYLLRSLCPRSKSRTYIGFTVNPRRRIRQHNGELRCGAWRTKRGRPWEMMLCIYGFPTNVAALQFEWAWQHPTESLAVRKAAAEFKSLGGIGNKVKLAYTMLNLP

SEQ ID NO: 209998 - protein, 151 aa, Triticum aestivum
  Clone ID: PAT_TA_104416.pep
QCKRQTNRLLLCVCELAVHIFLGCFIQSQLCPRTHPHSTDHYSGESGGVRNHEASRRSARLQPPHPLPLPTTPGSTCHGAGAGSPPQVQRDGVQRLGSAVRGLRRRGRRRRGRRGARRPRRVGGGGGVPLLPQRGADGAVGAAAGVVAAAG

SEQ ID NO: 209999 - protein, 77 aa, Triticum aestivum
  Clone ID: PAT_TA_104417.pep
VVNLAELDPGRPGPRPAVVLDAVAVSSHWSETRGLSRAYPGMSPVGTTCTASCWPLTASSWSQLLRDSKLAALKKGD

SEQ ID NO: 210000 - protein, 62 aa, Triticum aestivum
  Clone ID: PAT_TA_104418.pep
GTCRENGVRHDDQGSAGYALLISETSEKVSEERLISLLKQINTHTSKQTKVAVESLHIRKFT

SEQ ID NO: 210001 - protein, 169 aa, Triticum aestivum
  Clone ID: PAT_TA_104419.pep
GGLSLALQEDSAKTGKVTSAGMFFLGFPVYRFEHNNSAAAAKDPDSAFFKRLDGFQPCEVNELKEGTHYFAVYGDNFFKSATYTLEVVCAEPFSNEKEKLRSVEAKILAKRSELSKFESEYREVLAKFTEMTSRYAQEMQTIDELLNERNAIHASYTNSPTLKRSSSDS

SEQ ID NO: 210002 - protein, 70 aa, Triticum aestivum
  Clone ID: PAT_TA_104420.pep
DLAFGIKYLMRRQGNLHVGGVYAGSNCIELKGPEFMEELIVLRGRIDLCFLFSKKSFPGFLELAGFSQVD

SEQ ID NO: 210003 - protein, 81 aa, Triticum aestivum
  Clone ID: PAT_TA_104421.pep
NGLYLEGGRRLTFNISNSFPSLGVGVSQAVARVSHHALQLDFLPLHDHCLDKRSPRWVDCRTLAWYLVLNYLLTLITLILI

SEQ ID NO: 210004 - protein, 148 aa, Triticum aestivum
  Clone ID: PAT_TA_104422.pep
DDGDLQTVGRYDFDGQLECPMIAHPKLDPATGELHALSYDVIKKGWGKYFYFKADGTKSAEVEIPLDQPTMIHDFAITENYVVVPDHQVVFKLQEMLRGGSPVVLDKEKTSRFGVLPKCAADSSEMVWVDVPDCFCFHLWNAWEEEET

SEQ ID NO: 210005 - protein, 125 aa, Triticum aestivum
  Clone ID: PAT_TA_104423.pep
SRSPMKSLARRPRRPPDPTACSCRKGRLREEMAGWVRPSACPDCQTRRRCHSTTCRQTCRCLMAAGRWRTMCLAPSGRHRRPSSSSSSQRARCLHSRSPSFVSCSFLSFFPASQISVVSDLLVLF

SEQ ID NO: 210006 - protein, 167 aa, Triticum aestivum
  Clone ID: PAT_TA_104424.pep
MGQGTEVKTREDPKVEIQEKGEVFFFYRPKVDKEEAHSPDDVQRMYVVLRPESGPGRAVEEKQAPDSGKEGKKRKTRHGGDEKGQADGGNEGGHGKEEVNVEEKPLLRLIVMGKKSLPDPAKHGRPFWGYVDLVTTDVEDIKDALKGAEYDTATRGKRHLAAARAMG

SEQ ID NO: 210007 - protein, 119 aa, Triticum aestivum
  Clone ID: PAT_TA_104425.pep
LGSPPAPRLLPCCADPPSVLGHEPPDAGAPEGHAAAAAAGAVRLRAGLLPRRAGRLRRARRGRGAKCPPTPSPSYSNMDSQFGSSLDMPGMDDYLQLQHDSVACRVRAKRGCATHPRSI

SEQ ID NO: 210008 - protein, 149 aa, Triticum aestivum
  Clone ID: PAT_TA_104426.pep
PPAAAPGFDGAGKAQWRESTPETMAKGRARVDLVVGMAWRGSPLQTVAWQDAGGRRGCGLRRKWGSQGGTWRSTARSRLPVEAGEVKEWCARAGWWWSAAASAGVGVLHARRRHGQDWLHLAASGSAGTWRRWLGWLGARNSRRQTRAR

SEQ ID NO: 210009 - protein, 163 aa, Triticum aestivum
  unsure (1)..(163): unsure at all Xaa locations
  Clone ID: PAT_TA_104427.pep
EDRGEGRDDTETSARQHHGHGHLLSYARRTPPPRPLLGGRCPRRRXPLRRWTSSAAAWAASTSRRSSARPRSASTLPPPAAPRAARRSSRRSRPGWRRPTPRRRRPASSPRSPSTRSASRRRPRRRTPTPGRACGRACSLCRRRPGSAVGGAVRRRGAIQRRA

SEQ ID NO: 210010 - protein, 176 aa, Triticum aestivum
  Clone ID: PAT_TA_104428.pep
LKSRNIPHNVLNARPKYAAREAEIIAQAGRKHAITISTNMAGRGTDIILGGNPKMLAKEIVEDNVLPFLSHDTPDVETEGESTSHKGLSKIKLGPSSLALLAKAAIMAKYVHKSESNEWSFQKAKSAVMESIEMSNTIGLEKLQERVAEVTEMYPLCDAIALAYATVLKDCEIHCF

SEQ ID NO: 210011 - protein, 161 aa, Triticum aestivum
  unsure (1)..(161): unsure at all Xaa locations
  Clone ID: PAT_TA_104429.pep
MAVGKNKRISKGXKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQI

SEQ ID NO: 210012 - protein, 154 aa, Triticum aestivum
  Clone ID: PAT_TA_104430.pep
MAAPPALLTAARLGRGLGLLASVRYYGAIPVPFSVSSPRRRLPAPPPRHVSSSVRRLAATAVSEPQTDSESGTATVRKGRIYHETYGCQMNVNDMEIVLSIMKKEGYNDIVPDPESAEIIFINTCAIRDNAEQKVWQRLNYFWFLKRQWKANVA

SEQ ID NO: 210013 - protein, 186 aa, Triticum aestivum
  Clone ID: PAT_TA_104431.pep
DIAKWSCFFRPQLENDVTFGQTQMSPKEADDAENYFTNTIDDPQDSERTSTVALEDEDDLTLHKAYMSPEDISEVENSLADDSASDLPHMPENHCFSEKVSPESQDPLSSEVILVHPVGLKTENDLDDAKSSLYSTEANLAEPCGIAHEGTQQQDETMLGFEEANSEDHYDNSGSLDIPDVTVAES

SEQ ID NO: 210014 - protein, 95 aa, Triticum aestivum
  Clone ID: PAT_TA_104432.pep
VTNPNPIPLDFVAIWCSIRSSRGATCSGPICVLLFVNFRGVSFTDTSLAHAVIVLSCDFRDLREASALAGCFSAILRGFHPRVLLCEAIDPCSVW

SEQ ID NO: 210015 - protein, 68 aa, Triticum aestivum
  unsure (1)..(68): unsure at all Xaa locations
  Clone ID: PAT_TA_104433.pep
VIMIGTDLFLEDQEAGLIQGTVLAAVDVGVVGAEVTLAVMVMVAVVEDXPTVPMDASTPTCPTHATLS

SEQ ID NO: 210016 - protein, 103 aa, Triticum aestivum
  Clone ID: PAT_TA_104434.pep
SAAAVSQKTGGSSSSSVHRKLHSPKSQSLAKPSPPLPHSPVRFPSSDRELHLHSSVPHSDRAAGGPTMAATHHPASPTGAGKSPSSSPSPPTPVRLAAAQAAA

SEQ ID NO: 210017 - protein, 179 aa, Triticum aestivum
  Clone ID: PAT_TA_104435.pep
EPFSNLRAVNLSGNFIVHISPGSLPKGLHSLDLSRNKIANVEGLRELTKLRVLNLSYNRISRIGHGLSNCTAIRELYLAGNKIGDVEGLHRLLRLAVLDLGFNRLTTAKALGQLVANYHSLLALNLVGNPVQANVGDDALRKAVTDLLPQLAYLNKQPLKPREAATDSVARAALGTAGR

SEQ ID NO: 210018 - protein, 64 aa, Triticum aestivum
  Clone ID: PAT_TA_104436.pep
KLPRGPRTTIIALSPITSCMYTCRCADAPAAGRGAATARMTATAAASAKDVGLSLKQAWRDEWK

SEQ ID NO: 210019 - protein, 60 aa, Triticum aestivum
  Clone ID: PAT_TA_104437.pep
QRSIGKQSSSSSSLTSPYSSIYLSLGFLIHRSSLKCGHGEGAPELGRAVSGDGGGGGPRR

SEQ ID NO: 210020 - protein, 130 aa, Triticum aestivum
  Clone ID: PAT_TA_104438.pep
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESG

SEQ ID NO: 210021 - protein, 130 aa, Triticum aestivum; identical to SEQ ID NO: 210020
  Clone ID: PAT_TA_104439.pep

SEQ ID NO: 210022 - protein, 60 aa, Triticum aestivum
  Clone ID: PAT_TA_104440.pep
NSPRILHAPISLGGPHPKNSLTRRSAYRSAAAPAAPVCLPGAQTPWTCPADRPPAAADAA

SEQ ID NO: 210023 - protein, 133 aa, Triticum aestivum
  Clone ID: PAT_TA_104441.pep
SRRSWCSGRPCGTSSRRRPSCGCAACWRASPPRSGRPRPPSSSTRPTAPAPAPPTTSTTPRSSTSARAASPPPPPCASTSRASRSAPSPRSRTRTPRTTPSRASASSGPPQPRAPVPAPAPRLRARHLHPPHH

SEQ ID NO: 210024 - protein, 52 aa, Triticum aestivum
  unsure (1)..(52): unsure at all Xaa locations
  Clone ID: PAT_TA_104442.pep
PAVSFGPALVSWEWGYHWVYWVGPLICSGLSSVIYXLLFISRTHEQLPTTDY

SEQ ID NO: 210025 - protein, 104 aa, Triticum aestivum
  unsure (1)..(104): unsure at all Xaa locations
  Clone ID: PAT_TA_104443.pep
PPSIPISGEVSRSSIHPRLRPAGQRFSSVPISIAICGARFADKQWREGRGKGNCSVRRCKRDGEPAGRRXDTTSTLVSTRRLVTEVPLLDQSLPLQLVYPVVTE

SEQ ID NO: 210026 - protein, 81 aa, Triticum aestivum
  Clone ID: PAT_TA_104444.pep
FKTIVIMLSGFLVFKSDPGLTSLYGAVIALGGMSVYTYLGLKESPTGGKSIPSTSRQSSLSLKSKVIIDGEKPETRPVDSV

SEQ ID NO: 210027 - protein, 126 aa, Triticum aestivum
  unsure (1)..(126): unsure at all Xaa locations
  Clone ID: PAT_TA_104445.pep
MVAHRFHQXQVVGRALPTPGDEQPKIYRMKLWAAGEVRAKSKFWYFLRKLKKVKKANGHMLAINEIFEKNPTTIKNYGIWLRYQSRTGYHNMYKEYRDTTLNGGVEHMYTDMASRHRVRAPCIQII

SEQ ID NO: 210028 - protein, 156 aa, Triticum aestivum
  Clone ID: PAT_TA_104446.pep
MAAHVLAFPWPLQGHINPMLHLASALLDAGLRVTFLHTEHNLRRFTRVPPHHPRLRLVSIPDGLPDHHPRSVGGLMELVESMRTAGSAAYRALLLRMVDSDDDDAVTCVIADGVMPFAVSVAEELGVPALAFRTESACGFLAYLSVPRLLELGEKP

SEQ ID NO: 210029 - protein, 115 aa, Triticum aestivum
  Clone ID: PAT_TA_104447.pep
MAAALSLRAPFSLRAVAPPAPRVALAPAALSLAAAKQVRGARLRAQATYKVKLVTPEGEVELEVPDDVYILDQAEEEGIDLPYSCRAGSCSSCAGKLVSGEIDQSDQSFLDDDQM

SEQ ID NO: 210030 - protein, 190 aa, Triticum aestivum
  Clone ID: PAT_TA_104448.pep
LLSKHSQWESCMATQFQKKTSAGRPCFMPWPSFACSPDGVTLKHTWMVPQVIYAMKSLSGNLNSLRAFSSYFPNLQLKSRFSQTNVHLKLPWPSDSCNCRAVQVCSELPKVEYFEHQFMGVCEHHVAVWDYAVLGCIPISDKLQGIIHLMHMSVRWIFLSQEEFKGSGRVSIDFHTNNAWERCSIFLGNC

SEQ ID NO: 210031 - protein, 98 aa, Triticum aestivum
  unsure (1)..(98): unsure at all Xaa locations
  Clone ID: PAT_TA_104449.pep
LRARSNCLDGRKMKSETDGLQQEKDKVSASAPETAAFHGTAPASLPAQEAAAAVSLPAAASVGGGVRRAEQRXRREHAALGAGEXDNGVGDDVDAAAP

SEQ ID NO: 210032 - protein, 119 aa, Triticum aestivum
  Clone ID: PAT_TA_104450.pep
MAKPRRGRSGSRSSSGSSSRSASSGSSRSRSRSRSLSSSSSSPARSRGRSPPAAKRSSPGAKKGRGPSPPVKKGAPSRKGRSSSPPPKKASPPRKASPPPQSGVLHVDHLSRNVNEAHL

SEQ ID NO: 210033 - protein, 130 aa, Triticum aestivum
  Clone ID: PAT_TA_104451.pep
ARGNMQHVTSLSFLILAYSNYLSHAGAHVSCGAGRSAPPTKLRQVAKRQVDYILGDNPLRMSYMVGYGPRFPRRIHHRGSSIPSVAAHPARIGCKAGAAYYASAAPNPNLLVGAVVGGPSDATDAFPDAR

SEQ ID NO: 210034 - protein, 164 aa, Triticum aestivum
  Clone ID: PAT_TA_104452.pep
MAMDAMSSAVLQGAWRKGPWTALEDRLLTEYVQQQGEGSWNSVAKLTGLRRSGKSCRLRWVNYLRPDLKRGKITADEETVILQLHAMLGNRWSAIARCLPGRTDNEIKNYWRTHFKKARPSRRARAQLLHQYQLQQQQQHRQYLHALHLLQQQQQEMQMQLQME

SEQ ID NO: 210035 - protein, 135 aa, Triticum aestivum; identical to SEQ ID NO: 182694
  Clone ID: PAT_TA_104453.pep

SEQ ID NO: 210036 - protein, 189 aa, Triticum aestivum; identical to SEQ ID NO: 171981
  Clone ID: PAT_TA_104454.pep

SEQ ID NO: 210037 - protein, 175 aa, Triticum aestivum
  Clone ID: PAT_TA_104455.pep
REEGKGREEETTEPSARTRQQAPRSRAGAEMGLTFTKLFSRLFAKKEMRILMVGLFAGGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGL

SEQ ID NO: 210038 - protein, 160 aa, Triticum aestivum
  Clone ID: PAT_TA_104456.pep
GTSRLLLPSGSRRRRSSSRFDSGSSGAFPLPAVAALPSGAVGSVGRRSPRAIRQEEEEGQRIQAGTLLLASAADDDARRETVDGDRAGAVRRRRGLLQGAPEDLRRLVRPRRPRCAGSGVAVLASPQVRVTSPGRPSAAARTTTLPRGVAIYWRSFRPSS

SEQ ID NO: 210039 - protein, 85 aa, Triticum aestivum
  Clone ID: PAT_TA_104457.pep
PPRRPSSDRPNQSALQIACSLLPQITTIGDGRLEEAAPPAGLGFTASTRPGSTRVSFPPIAAGGPRLSVQFKYSCITWDCRRYAH

SEQ ID NO: 210040 - protein, 159 aa, Triticum aestivum
  Clone ID: PAT_TA_104458.pep
GTREGTSTTVFVFYRHAVAAIFLAPFAFFLEIRQGSAPPLTFRLSVKIFAHAFYGMAGTINLYSIGLNYASATSSSAIFNIVPVVAFILAVMFRMETLKLKSVHGMAKASGILLCIGGVVALALYQGPQLKSLNHHPLLHSTGTAVHARPEKNWALGIF

SEQ ID NO: 210041 - protein, 145 aa, Triticum aestivum
  Clone ID: PAT_TA_104459.pep
RFTRAQPPARSTHGVVAAPSSSTSVHTARCTSPPLAVAIVTCPSNLTVVPSATHRSVRCSSTESLLELAAKAGSSRSRTPWKHGVAAAGSPSSSILQHYVPAKKQSEQLRKPKKVSWIKILAGSSKNKCQFQQNHGSPSPKCSRT

SEQ ID NO: 210042 - protein, 150 aa, Triticum aestivum
  Clone ID: PAT_TA_104460.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHSVRDEDAKFKLCKVRSVQFGQKGIPYLNTYDGRTIRYP

SEQ ID NO: 210043 - protein, 93 aa, Triticum aestivum
  Clone ID: PAT_TA_104461.pep
ALLAWLPLPSARSLAFLDQFHAQTTPPVGNPRALSTPRPGSQQANAAARAGPARALPGPLPRRRGAGAGGPVLRDGLLDRRRGAGCGAAARRR

SEQ ID NO: 210044 - protein, 127 aa, Triticum aestivum
  unsure (1)..(127): unsure at all Xaa locations
  Clone ID: PAT_TA_104462.pep
EGKDPNKPKRXPSAFFVXMGEFREEFKQKNPKNKSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 210045 - protein, 124 aa, Triticum aestivum
  unsure (1)..(124): unsure at all Xaa locations
  Clone ID: PAT_TA_104463.pep
SDDSSSGSMKAMGTTSYSSPSSXALCLNHKGEGSWRHLHDGRRVQDGEEGHHGNRPGTMHIPVVDGGQLVPVLLYQPGGVEAVGEVSIPALQRGGRNVLLLEVTLARPTHCTRVPPDITPTARR

SEQ ID NO: 210046 - protein, 71 aa, Triticum aestivum
  Clone ID: PAT_TA_104464.pep
KHIHYARRMVRNVLFPILPFYLHIRAVCLVFSQDEYSTHESNILGIIDAHIIPGPGIVDGLRLKVCYVLHT

SEQ ID NO: 210047 - protein, 154 aa, Triticum aestivum
  Clone ID: PAT_TA_104465.pep
SDMSLSVSTQLSGGGRCEWGSRNGLSGLLAQKSNALRPAFWHMIREILKFKEDALKYLEDHESNPDLNRHETLGQFIQTHGYSQLFQEAYLIPICASIWSCPSQGVLGFSAFFVLSFCRNHHLLQIFGRPQWLTVKGRSHTYVNKVREELESMG

SEQ ID NO: 210048 - protein, 51 aa, Triticum aestivum
  unsure (1)..(51): unsure at all Xaa locations
  Clone ID: PAT_TA_104466.pep
RQPRRLRRRQLEGVNGGAPXWPVILVTDPFFYLSTKVLSLAPEYPRSRSIA

SEQ ID NO: 210049 - protein, 61 aa, Triticum aestivum
  Clone ID: PAT_TA_104467.pep
GHVAEHDEHQGDQHGQQEPLGVQPHAAIAAAAVVVAAAAAADAAARSRPHGGDWHRGIVVR

SEQ ID NO: 210050 - protein, 203 aa, Triticum aestivum
  Clone ID: PAT_TA_104468.pep
ALSRPPVSAHLLRLRRRRTNRGSSDSSDQERRAGRKSTYAGGDEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTC

SEQ ID NO: 210051 - protein, 121 aa, Triticum aestivum; identical to SEQ ID NO: 167940
  Clone ID: PAT_TA_104469.pep

SEQ ID NO: 210052 - protein, 159 aa, Triticum aestivum
  Clone ID: PAT_TA_104470.pep
MGEVMEMTEVLQSVSDLPVQDPPGEEFSAADLMWVKYASSEHHCDDVALIPYDRMEAFISGECNNPEYPTRFHIERGRKRERGTLKEVRSDDYLLYRMYWCSFGPENYGEGGTILPSRRYRLNTRNRAARPQSMRGCTCHFAIKRLYARPSLALIIYHE

SEQ ID NO: 210053 - protein, 77 aa, Triticum aestivum
  Clone ID: PAT_TA_104471.pep
GTLTSQFQLSSKQYYVLQRYVLLSRLIATGASAPSLLMKRHHKLLQSNQMDGQRRIEGLSHKRWKRPTGPAGNSYKV

SEQ ID NO: 210054 - protein, 111 aa, Triticum aestivum
  Clone ID: PAT_TA_104472.pep
LCLAVAAACLAYLCYHPRPPSFHLQPVSTTRFRVGNSSAVSAVDVTAAVKVVSWNPNDKIAFEYGDGEGRVYLADSDGDITLGWAPVGGFEHGARRVAVVGFVAAAKGVVV

SEQ ID NO: 210055 - protein, 151 aa, Triticum aestivum
  Clone ID: PAT_TA_104473.pep
AAASFSRSRLSAASSSPLALRSASSYATFVSSSFLAASAAAAASLASLRAPPIACSRAASSSSWLSRFTFRCANSPSCADSFSAASRCCSSTSAFARRKALRSSRSCSRSSARDRRASCLRPRSSSARFSMSTPAFATSASRDASLACRAR

SEQ ID NO: 210056 - protein, 173 aa, Triticum aestivum
  Clone ID: PAT_TA_104474.pep
LQLLGVLISPKEDRHHMDKKWWERQEQGDQVASVLDIGQVGPRATCRCQVIRSVGQWSAGTTQIEGSIHNAYFSLIEKAEHFVYIENQFFISGLSGDDTIKNRVLEALYRRILRAEREKKRFKAIIVIPLLPGFQGGIDDGGAASVRAIMHWQYRTICRGPNSILQNLYDVIG

SEQ ID NO: 210057 - protein, 158 aa, Triticum aestivum
  Clone ID: PAT_TA_104475.pep
MGRSPCCDGEAGVKKGPWTPEEDKLLVDYIQEKGHGSWRRLPKLAGLNRCGKSCRLRWTNYLRPDIKRGRFTDDEEKLIIHLHSLLGNKWSSIATKLPGRTDNEIKNYWNTHLRKKLLGMGIDPVTHRPRTDLSLLAGLPGLLAAAGNFGGAGSATGA

SEQ ID NO: 210058 - protein, 163 aa, Triticum aestivum
  unsure (1)..(163): unsure at all Xaa locations
  Clone ID: PAT_TA_104476.pep
APPHEPPTQPERAPAEEGVAPEKNGVGSGGEKEVASEGSGAGAEVGAAVETNGVAVDVWICHQCRQRKTGLTAACRGSKKNGKCTLRYCKNCIRNRYPLIADEVLKEEAXECPKCRNDCNCSKCKKRRGEEPAGPMVHSVKRPKGDLRRIESTDALKDEIVIP

SEQ ID NO: 210059 - protein, 141 aa, Triticum aestivum
  Clone ID: PAT_TA_104477.pep
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRFVMESGAKGCEVIVSGK

SEQ ID NO: 210060 - protein, 179 aa, Triticum aestivum
  Clone ID: PAT_TA_104478.pep
GLAGIDALLSAPGCANISTRADFDARVPASARRDINASCYRELGAVPVCTTCTTSLSKTAAAYLLPGSPDGGNNVTGCVQYPFIYTGAAASLRGPDDPDTADCLYLLKANSQPSKGSGAPAWLYGVVFGCVAFVLLVAAAAGSCFFVWRRRRRAAATALAADSRSKRSHAMESITGSTT

SEQ ID NO: 210061 - protein, 112 aa, Triticum aestivum
  Clone ID: PAT_TA_104479.pep
MVAVASAASRSSSSSSFDASAFEAERLRLDADARASMVTTAAGAQAEADPRAWKWKIRKRVWDVLEAEGVARNPRPVHHRIPNFDGAAAAADSLGRLDVFQNAQCVKVNPDS

SEQ ID NO: 210062 - protein, 52 aa, Triticum aestivum
  Clone ID: PAT_TA_104480.pep
TGSNYLLFYLRLTTSHGCIYHMICPHLTCSYGFIWSMLTSSSHLIYTSHKDF

SEQ ID NO: 210063 - protein, 170 aa, Triticum aestivum
  Clone ID: PAT_TA_104481.pep
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLP

SEQ ID NO: 210064 - protein, 165 aa, Triticum aestivum
  Clone ID: PAT_TA_104482.pep
ERSRPPQLLPVKGADASAAGKHASEDGAVSAGRGVIYYDPKPGDLVVGVVVGGDARAIYVDVGAGGEPALMLTKEAAPASSEEFAYLACDVASGGAREFAAEGRVGVAAGGVGARVGRTGKEKCAPVVGVGTVVFAEVLGRTLGGRPLLSSRRLFRRVAWHRVRQ

SEQ ID NO: 210065 - protein, 49 aa, Triticum aestivum; identical to SEQ ID NO: 147490
  Clone ID: PAT_TA_104483.pep

SEQ ID NO: 210066 - protein, 178 aa, Triticum aestivum
  unsure (1)..(178): unsure at all Xaa locations
  Clone ID: PAT_TA_104484.pep
APPPTFLRGEEASSGSSSARARFERLIRRVQAEVCAALEAVEEGSGGGGVVFREDAWTRPGGGGGISRVLQGGHVFEKAAVNVSVVYGVMPPDAYRAARPDAAAGVEKAGPVPFFAAGVSSVIHPNNPFAPTLHFNYRYFETEAPQDAPXAPRQWWFGGGTDLTPSYIIEEDIKHFHS

SEQ ID NO: 210067 - protein, 197 aa, Triticum aestivum
  Clone ID: PAT_TA_104485.pep
MIVFVLDLDAQTPAWREIASDGPPLPRSWHSSCTLDGSKLVVSGGCAESGVLLSDTFLLDLTKEKPTWKEIPTSWSSRLGHTFSVYGKTKIFMFGGLAKSGSLRLRSSDAYIMDFGEENPQWRQLATTGFPSVGPPPRLDHVTVSLPCGRIIIFGGSIAGLHSPAELFLLDPAEEKPTWRILNVPGQPPKFAWGHST

SEQ ID NO: 210068 - protein, 77 aa, Triticum aestivum
  Clone ID: PAT_TA_104486.pep
FFTLSLLISPWASSKQGDTSIKPEVSACSLPTVVSKLCFCSVISASFSFFFSSFLLFLSFFTCLCSWHPQNKAPSSP

SEQ ID NO: 210069 - protein, 150 aa, Triticum aestivum
  Clone ID: PAT_TA_104487.pep
AALGQGKKTPTPELGEVVTSDISGRRTMSRSSDSGRMGNDEKEDLELGKGDYMDVDRGEASVNGSANLLSSDSEDEVRRSETPEPVKPAHRCINMLQGCRSVDVFERLNKINEGTYGVVYRAKDKKTAEIVALKKVKMEKEREGFPLTSL

SEQ ID NO: 210070 - protein, 133 aa, Triticum aestivum
  Clone ID: PAT_TA_104488.pep
CCVDEVGASNIDAQCVVHYGHSCMSPTSNLPAFFVFGKAPLDISLCCRSLLDCSRESSKPVLVLCGLEYAHALDDLKRATMELCKSDCQNSEIHYAEVLCSEMSPSSSSTGEEQCPQCNGSTHNDGLPADNDD

SEQ ID NO: 210071 - protein, 105 aa, Triticum aestivum
  unsure (1)..(105): unsure at all Xaa locations
  Clone ID: PAT_TA_104489.pep
APWRLPGPHRLLRLSRRLHASAGAGAAQGKFLLPGASAAVLLMLGVLHAKRMYDDKQLVXMKEQGIEPEFSPDLKASFLRLLPLRSMSRVWGSLMEVEVPVFMRP

SEQ ID NO: 210072 - protein, 81 aa, Triticum aestivum
  Clone ID: PAT_TA_104490.pep
MATCWLLLLLWAFLWPAASAVPCHPDDLHALRGFAGDLSGGGVLLRTAWSGAWCCSWEGVGCDSASGRVTVLRLPSRGLTG

SEQ ID NO: 210073 - protein, 88 aa, Triticum aestivum
  Clone ID: PAT_TA_104491.pep
CQVKSVSSLGGAGYRVSREDGSEETYDSVILGVHAPNALKVLGLEATNRERRILGACQYVLLDIYLHSDQNLMPRNSSAWSACNFLGT

SEQ ID NO: 210074 - protein, 133 aa, Triticum aestivum
  Clone ID: PAT_TA_104492.pep
TRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFHNTQGLIFVVDLTDRERVV

SEQ ID NO: 210075 - protein, 55 aa, Triticum aestivum
  Clone ID: PAT_TA_104493.pep
VNGRWAMLGVAGMLIPEVLTNAGLLNTPEWYDPGHETYFSSSSTLFFIESILFHY

SEQ ID NO: 210076 - protein, 151 aa, Triticum aestivum
  unsure (1)..(151): unsure at all Xaa locations
  Clone ID: PAT_TA_104494.pep
NNLFSGPFPAATLLIPSLVYLDLRFNGFSGELPDEVFAKNLDALFLNNNQFEGQIPETLWSSPATAITLANNRLTGPVPTAYGYGGRVRELLFLNNKLTGCVPEALXFLPYIEVLDLSNNLLSGHLPSTLSCLSGIEVLNIAHNQFTGELP

SEQ ID NO: 210077 - protein, 146 aa, Triticum aestivum
  unsure (1)..(146): unsure at all Xaa locations
  Clone ID: PAT_TA_104495.pep
MAVVGEEYCDXQERLLTVRKTSHFSPGDGFAAYDNRTGGLAFRADTYGRGHGGGAASPGELALLGPAGEPLLTVRRRRPSLHQRWEGFLGARADGQKSLFSARRSSILGGAGRGAVVELLPSPASAAAAELRVEGSFGRRCCRVVA

SEQ ID NO: 210078 - protein, 107 aa, Triticum aestivum
  unsure (1)..(107): unsure at all Xaa locations
  Clone ID: PAT_TA_104496.pep
MALSSAPPCPGQEPPSGKQLSYQPAAAVRSINWTYAIFWSLSTGLRPPGVLTXKNGFYNGEVKTRKIISSTMTELTADELFLQRSEQLRELYESLLSGKADHRAKRP

SEQ ID NO: 210079 - protein, 128 aa, Triticum aestivum
  Clone ID: PAT_TA_104497.pep
MYQWRKFEFFEEKGAGRGGGGGAPAVPAEIAGRVTCSSGGRGRVAIGCDDGTVGLLDRGFRLSYGFQAYASSVLFLQQLKQRNVLVTVGDDDQASSQSSAVCLKVFDLDKVQEEGSCTTTPFCVQILR

SEQ ID NO: 210080 - protein, 60 aa, Triticum aestivum
  Clone ID: PAT_TA_104498.pep
QNFTVRAFPTVSVQKDSTVLYGDQVVPYSVQVNSGAYLLFRLVSGDPRKMKLYIYNITRM

SEQ ID NO: 210081 - protein, 153 aa, Triticum aestivum; identical to SEQ ID NO: 109663
  Clone ID: PAT_TA_104499.pep

SEQ ID NO: 210082 - protein, 54 aa, Triticum aestivum
  Clone ID: PAT_TA_104500.pep
LLNRNPFDPQQSTIASKITNLANKVTNKVRSRVKMDENGMVREGGSGESQCSDR

SEQ ID NO: 210083 - protein, 108 aa, Triticum aestivum
  Clone ID: PAT_TA_104501.pep
NRQRRLRSISGHPPPAHRCPASSSSAPPPQALPHFFSFPWRPKVMAMTVRARGNPVDSGNTVRHRNMWSRLHLAAHWLVGINNDEHGQKQPFLGSGSPAVNLMFKSYL

SEQ ID NO: 210084 - protein, 94 aa, Triticum aestivum
  Clone ID: PAT_TA_104502.pep
KSVAAVGKAAGERWKSLSESEKAPYVAKANKLKGEYNKAIAAYNKGESAAAAAPKKAAAKEVEEEDEEESDKSKSEINDDDDDEGSDEDEDDDE

SEQ ID NO: 210085 - protein, 162 aa, Triticum aestivum
  unsure (1)..(162): unsure at all Xaa locations
  Clone ID: PAT_TA_104503.pep
GPHRFSYXDLFRATEGFKNKNLLGVGGFGKVYRGVLPASKCEIAVKRVSHSSKQGMKEFVAEIVSIGRMQHPNLVRLLGYCRRQGELLLVYEYMPNGSLDRYLYSQPQEADDKHNGTLNWVQRLGIIKGIASGLIYLHDEWEKVVVHRDIKASHVLLDSGMN

SEQ ID NO: 210086 - protein, 72 aa, Triticum aestivum
  Clone ID: PAT_TA_104504.pep
SPKDQIHLPKQLKYEENHLSVPAPVASPATTLRLSSSATARCALAGGRRYNRSSNQTWRIPFLSLAMHGLSV

SEQ ID NO: 210087 - protein, 95 aa, Triticum aestivum
  unsure (1)..(95): unsure at all Xaa locations
  Clone ID: PAT_TA_104505.pep
TVQKLLHSYVKNEETLLKTFPKMSPAAWKAIIGHAMTCEVGDTLYMHEIKETNMEFFFDAILQLVGVKFGDCYKPLXKIHQPEKNLVETLKQKAL

SEQ ID NO: 210088 - protein, 62 aa, Triticum aestivum
  Clone ID: PAT_TA_104506.pep
TSSLAPSVAWFHITGNHCVETIFKQHRLYKYNTFCHWALLNQKAQAWSTRRNIAEENEVPET

SEQ ID NO: 210089 - protein, 106 aa, Triticum aestivum
  Clone ID: PAT_TA_104507.pep
GSHPHPSGAGRRKKHSTAAVARLSHSLEVEDDAVAKGLTSSPMLLPDDVLEMVQSRLPLASFSVTTRVHWWPSPRAHPRARARRQAQADDHATYIPPSSGRRPRER

SEQ ID NO: 210090 - protein, 157 aa, Triticum aestivum
  Clone ID: PAT_TA_104508.pep
NYICSNIGELLPKLHTLVLMSNDITTLAEIDPLAALPNLKSLYLLENPVTETADYRLYVIHMLKHLMSLDFEKVKPQERTTAEYKFHSKEAREEVKKTSAKAYTPMKPVGAQYITEKSCPKAVSPVPSIKVLSTGQMAAEFAFFEPEIDMAEALEKT

SEQ ID NO: 210091 - protein, 49 aa, Triticum aestivum
  Clone ID: PAT_TA_104509.pep
IFIFFLNRAKICFLSDSCHNGRVMFSLFDEWKPEVPLSKKKKKKKKKKK

SEQ ID NO: 210092 - protein, 155 aa, Triticum aestivum
  Clone ID: PAT_TA_104510.pep
EHGSAAAASAAAAAPPEAAAAADSPAKEEAQSAAAAAAAPGGEADAAGETVVLDAAAEGGEEEEEGECGFCVYMKGGGCKEEFVGWEKCVEQAEAEGGYVVERCHDATAALRRCMDKFPDYYEPILRAERAMAEDLEAFKASEASEPSPASPPPP

SEQ ID NO: 210093 - protein, 53 aa, Triticum aestivum
  Clone ID: PAT_TA_104511.pep
ADPFLAAAAPPLLTDLGGISLRPPHQNQEHRLVPSRKIEFAETETQATETKAC

SEQ ID NO: 210094 - protein, 168 aa, Triticum aestivum
  Clone ID: PAT_TA_104512.pep
SPPPPATDPEPGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLV

SEQ ID NO: 210095 - protein, 114 aa, Triticum aestivum
  Clone ID: PAT_TA_104513.pep
MEHKETGCQSREGPILCVNNCGFFGSAATMNMCSKCHKEMAMKQEQAKLAASSFDSIVNGGDAAKEHLAAGSTAVAVAHVEAKTLITAQPADIAGPSEAAMENPKGPSRCSTCR

SEQ ID NO: 210096 - protein, 179 aa, Triticum aestivum
  Clone ID: PAT_TA_104514.pep
FRDRRCTSFTHHQYWHNQGDTDCHPQETGRRPDKIIFHSDREDEEHPSLLLVSVYGTIREACTSLDEGYVPLIVIDDSQEKNRSLSPDINEKPENKSASQVMTHLTVDSPIGPIPMQIDLNSKSYKLKQKLEEVLDTSLEHFYMRGNGITLKNNDPLKTYGLRDNSTIQLLPRLLGGCR

SEQ ID NO: 210097 - protein, 64 aa, Triticum aestivum
  Clone ID: PAT_TA_104515.pep
KIIILISLPLLLDEGSSILCPVLRTRPSLWKIRHTTNESVRNGLKISIAVFASSVIAIKQNIAT

SEQ ID NO: 210098 - protein, 40 aa, Triticum aestivum
  Clone ID: PAT_TA_104516.pep
TLISKHYTTTSSEMNLDLNCSSLSLALLYLDPNRVRRKRK

SEQ ID NO: 210099 - protein, 143 aa, Triticum aestivum
  Clone ID: PAT_TA_104517.pep
CPGPAACAEGRRHTHQPEAPRPVPVARILTSSGTLAAATGRLPCSDGELTCALFRVALSFMAETTQSTCSISSRWQWMRLVLLHGCGRDLLHRRRRRVSEARATGVRGSGEDEATGGGEAAWQEGRGREGKRGGRRRGMEPYC

SEQ ID NO: 210100 - protein, 108 aa, Triticum aestivum
  Clone ID: PAT_TA_104518.pep
LVADDEAVLRAPHERLLHELIHQLRRHRQLLEPPLVTLRRCRHGRCCPNGGAPHRAQARRRQRPRGSHGAWAHGDHIDRAAQARSAGHGSAGKCVGGRHGRSPVVVGV

SEQ ID NO: 210101 - protein, 76 aa, Triticum aestivum
  Clone ID: PAT_TA_104519.pep
ASVRILFIQVWPIEGIKKFETLSYLPPLSTEALLKQVDYLIRSKWVPCLEFSKVGFVFREHNSSPGYYDGRYWTMW

SEQ ID NO: 210102 - protein, 80 aa, Triticum aestivum
  unsure (1)..(80): unsure at all Xaa locations
  Clone ID: PAT_TA_104520.pep
PLLYLQKTLCFLGCDAVATTVCHLLLGRPWQYDRSVIHNGRTNHYSFKWKGXRNVLRPMTASQIIVNKSQASTFACYMGV

SEQ ID NO: 210103 - protein, 113 aa, Triticum aestivum
  Clone ID: PAT_TA_104521.pep
LCRSLANAGRLSSSEETCGDAPWCWVDPALRIRIGDLPAGGRASSGRRGERGPDLPSPLPTVPLSHKPQSDPSVSHLLFCFRVFYSMFLRSANDSFLPTTCIWVAVILLLFSL

SEQ ID NO: 210104 - protein, 73 aa, Triticum aestivum
  unsure (1)..(73): unsure at all Xaa locations
  Clone ID: PAT_TA_104522.pep
VQRRPRRAGFDICPCRLLDPMSPMTTMRQMLDAMDRLFDDPVGXRTARRSPAAATEMPRMAWDIMEDDKDVKM

SEQ ID NO: 210105 - protein, 169 aa, Triticum aestivum
  Clone ID: PAT_TA_104523.pep
PPIPPPPPPPPRPQLTPAPSLSVSSGSMGLFGSAGAPPPPPPPPPPPSKRTCSPVRSGSCVRRVPEVVEFYHSLMRRESKRDGGSGADAASGGGAAATRDMIGEIENRSAHLLAIRSDVETQGDLIRFLIKEVEGAALVNIEGVVSFVKWLDDELSRLVDERAVLKHFE

SEQ ID NO: 210106 - protein, 94 aa, Triticum aestivum
  unsure (1)..(94): unsure at all Xaa locations
  Clone ID: PAT_TA_104524.pep
MAPKRGGKAPVPAKKKRXDKVVNPLFEKRPKQFGIGGALPFFXDLHRFVKWPKVVRIQRQRRILXLRLKVPPALHQFTRTLDKNLATYLFKMLL

SEQ ID NO: 210107 - protein, 197 aa, Triticum aestivum
  unsure (1)..(197): unsure at all Xaa locations
  Clone ID: PAT_TA_104525.pep
IGKVYNIICSFFGSMSNVPFTKRVLRGLCGKISREQADDDVRKTMDAFAELGAKDIGLYYRVQPDEDSRIRNLLWSTGSSRAQYHFFGDAITFDTTYRTDLYDMPFGLFVGVNNHFQTMIFGVVLVRDEIVETFQWVXEFIRMMGGKHPQTLLTDQCRSMEIAMEKVMPETTHRWCKWHVLKKAKESLGPYYTKRNK

SEQ ID NO: 210108 - protein, 188 aa, Triticum aestivum
  unsure (1)..(188): unsure at all Xaa locations
  Clone ID: PAT_TA_104526.pep
MLSYIILTSLLLDILVDCQGKGGSSRNRSSGHNRDQSSRQSSSRRSSVSSGSRXFDRDDMGKTRGYANFGRNKDKEREKDFDSRDRESRSVTADRDGFQSFSSCRPERDRLNRARSKADTSSKGVISLNNGSTSKSNTVGVAFEREFPQLSSEDKNGRQDISRVPSPGITTPIQSLPPFTPSDGWTSK

SEQ ID NO: 210109 - protein, 79 aa, Triticum aestivum
  Clone ID: PAT_TA_104527.pep
PVFGRCAAAYYAILGVVLLVAVPVELLTALCLRHSREGRLLAFASYLLPCAHVLLLLVISECYSWKLNLGVASISSLRK

SEQ ID NO: 210110 - protein, 199 aa, Triticum aestivum
  Clone ID: PAT_TA_104528.pep
HQSYSQPQPAHQMPHGAAIQHPVHASHQQLVGPQHPALVHPPQGQFPLQGQQPSMLAPQGSQHTPQHQQHGHQAQRPPMHPSIPSQAPPQGFPLSTPVPPQTGQSYQQGMHSSQQHIHPQPFQPHGPQYMQQQQQQHVPTSTSRSTSYVATPHQFQESGKSESAANATGNAEVGDNTNGGGEYSGIKPESLGDKNVNGE

SEQ ID NO: 210111 - protein, 53 aa, Triticum aestivum
  Clone ID: PAT_TA_104529.pep
VGTFVLVYTVFSATDAKRSARDSHVPILAPLPIGFAVFLVHLATIPITGTGIN

SEQ ID NO: 210112 - protein, 92 aa, Triticum aestivum
  Clone ID: PAT_TA_104530.pep
MHQQTGQKHRSPSAIVRERHHLPFHIYACMHAPIETHTRRSVSHDGVDDQRSCRSMEERGGRFEGWIIVRAGTRQSIIIRITSGVGEDKGKR

SEQ ID NO: 210113 - protein, 77 aa, Triticum aestivum
  Clone ID: PAT_TA_104531.pep
MASKQAVHMKHGQGETSYARNSSFQRAEQNRMKPLIEEVITDLCSSTSTLLHGKIVIADLGCSSGPNALALVSTAIN

SEQ ID NO: 210114 - protein, 139 aa, Triticum aestivum
  Clone ID: PAT_TA_104532.pep
LPNKAPESFPSHFSFSPTINLSPILVVWRLDGNLLASIPPLLLPFDASLRDVTRAELRFHRRPPRTLSCATKSGCVHSITLLMTLLAPEAAIPAAALDLKNSSRSGRRSSPRRSCWDGRHPRGPPVPLLQGPQEWSSHV

SEQ ID NO: 210115 - protein, 174 aa, Triticum aestivum; identical to SEQ ID NO: 133469
  Clone ID: PAT_TA_104533.pep

SEQ ID NO: 210116 - protein, 152 aa, Triticum aestivum
  Clone ID: PAT_TA_104534.pep
KRIDGVGLDVAGTEQIRAKLEKAMRDSRGILSEVKQAQIVQQCKTANLVWIGQGKLGPLQPHQMEAILGYPANHTDLPGIDPHDKVASLRYALQTDTMAYILSVLKDRYPDGLRVLSIFSGVGGAEVALHRLGIPLRCVVSVEESVVNRRVL

SEQ ID NO: 210117 - protein, 93 aa, Triticum aestivum
  Clone ID: PAT_TA_104535.pep
QRAAGRALAQSFAMATLSSSPTIVRHSLRLHEGGMTGCTRRRAGARMMFDEMAVRVLGCERARTNQVSVLCCPWSPKTAATNFECSRWFSLVT

SEQ ID NO: 210118 - protein, 143 aa, Triticum aestivum
  Clone ID: PAT_TA_104536.pep
PYVHGSREYVDGAAAYLSGWRGRRWRRRPARGSPGRRPSSATMPSPRTGASILTAAPSLDDPSCSSFRHHGGGVRGGHRVPGSSRGAAAGENPSWVRGRNWEGRGQGRNAMEAISYLGSAAIPYLGGGGGGDGGGRGERPPCS

SEQ ID NO: 210119 - protein, 75 aa, Triticum aestivum
  Clone ID: PAT_TA_104537.pep
MEIFYYVVFGGLAAVVAGLELGKSGKDRVATPTAFNAFKNNYVLVYSLMMSGDWLQGPYVYYLYTQYGFDKGDIG

SEQ ID NO: 210120 - protein, 201 aa, Triticum aestivum
  Clone ID: PAT_TA_104538.pep
GFLGTPTLSRLSSSFLATSFRGKQPPEIVKPLLPTTLIAATEDDHVDDARKSSHHYLPPSRKASSLFKIPEDQKPAGGGGGHEVGPYRQCSYTQGVLNGVNVLCGVGILSTPYAVRQGGWLGLVILAVLAVLAWYTGVLLRRCLDSKEGLETYPDIGHAAFGTPGRIVISIILYMELYACCIEYLILESDNLSKLFPNAHL

SEQ ID NO: 210121 - protein, 125 aa, Triticum aestivum
  Clone ID: PAT_TA_104539.pep
GFLSVPAFRPRCPSTFDLRNRAFAARRLSGLPTSRQSFGPNPQRKPISWVAPPRSLPPRRVGNKRSRRRRPAPPLRSTGMGNYLTSRITAEKHAHVKQTSKNRNGRPGLKFHDLPEVNETKLRLI

SEQ ID NO: 210122 - protein, 68 aa, Triticum aestivum
  unsure (1)..(68): unsure at all Xaa locations
  Clone ID: PAT_TA_104540.pep
SPRRRPRLSKVVAPCTYYGSPASKKSEKNKPHLMIVFIIVPVAPGRXLVMWAYPRNFGLWLHKITPRW

SEQ ID NO: 210123 - protein, 120 aa, Triticum aestivum
  Clone ID: PAT_TA_104541.pep
MSAPVVSATMGAMNPLIGKLAALMGDEYKKLTGVRKQASFLKDELSTMKALLEKLELMDELDPLAKNWRDHVREMSYDMENCIDDFMRDLGGADAKMGFIKKTAKRLKTLRKRHRIADRM

SEQ ID NO: 210124 - protein, 105 aa, Triticum aestivum
  Clone ID: PAT_TA_104542.pep
PTVFLECGCFPCLIKFNLTSCLGVTMQGFREYLKRHWKIDHESLLENMPQISSLIVMISGPYRWIVPSPSTTMLLPNLRRLLVADVPSSCDVSWPRLLLETAPSL

SEQ ID NO: 210125 - protein, 166 aa, Triticum aestivum
  Clone ID: PAT_TA_104543.pep
ARLPALRCLSLRMEDPEIQRQLVVGDDGFRCLTSFELFTEFLGHIVFQPGALPKAKQVRFSIGLRAAKEPAAGNGGDCFDLGLGNLRSLREVLVAAIRWGEDTEQVEDALEDALMHAIWAHPNCPSHQLITVPDMKRLMISLPAAIPNYGRMSERWSMAGDLLSDE

SEQ ID NO: 210126 - protein, 86 aa, Triticum aestivum
  Clone ID: PAT_TA_104544.pep
GLSDIFYLTTVRFRILLYVSITFLVYLIYLEEYLITRMYSTSCYFLIILMASKHRCSCLLLFMKATCLGGKLRLEGVSSHSLNFLA

SEQ ID NO: 210127 - protein, 57 aa, Triticum aestivum
  Clone ID: PAT_TA_104545.pep
NPVCPHPSRQLDRGRGDRLINNGTHRRLGPSPNWLVALHIRRVPKSLLWTQPNDLAN

SEQ ID NO: 210128 - protein, 72 aa, Triticum aestivum
  Clone ID: PAT_TA_104546.pep
PGLERAPLTEGCGGPVDDGHGVVDGGPPPEALGDYQRHFKQRVVSLLTSESGGGGEREDGIGEGFGGAADGE

SEQ ID NO: 210129 - protein, 110 aa, Triticum aestivum
  Clone ID: PAT_TA_104547.pep
MPPPRTLAVLLLAVVAVAAHGRLLASDGLPGQGSASDAAVLRLSSAGRPAGEAEEGGCEMTYGFLPCTETAGGNLFLALAYGFLMFKSATYLSAGSELLLEILGPGIVGG

SEQ ID NO: 210130 - protein, 138 aa, Triticum aestivum
  Clone ID: PAT_TA_104548.pep
PVPPSFAGKEVEAAPTAESCVNLGLEFFSKGRVRDALEQFDNALELNPNPTEAQAAFYNKACCHAYREESKKAAECLRIALRDYNLKFGTVLNDPDMAPFRASPEFKELQEEALRGGEDIGSGFRRDLKLISEVQAPF

SEQ ID NO: 210131 - protein, 130 aa, Triticum aestivum
  Clone ID: PAT_TA_104549.pep
MDAGSAGEAGRQEGTPMGPAAPFGRSSSSSGLGAKGGAAPHIFDGALRVEWFFSQPYRVKCAPLISACGSDVRRVRWGLQELKDLQSQLHQAADCCEKAFLATEKKQLILDSTKSYICYAVVAVIDHLGT

SEQ ID NO: 210132 - protein, 144 aa, Triticum aestivum
  unsure (1)..(144): unsure at all Xaa locations
  Clone ID: PAT_TA_104550.pep
IRARERALFFASTTMTIGNGQHTLFXWEDRWINGRAIREIAPLLYALIPKRRRKSRTVADGLHANQWATDIHGMIGIPEIGEYLRLWHMLAETSLSDAPDCIRWKWTANGEYSAKSTYLATFHGSTRCQAWKLTWKCWAPPRVR

SEQ ID NO: 210133 - protein, 84 aa, Triticum aestivum
  Clone ID: PAT_TA_104551.pep
MDYSTSLLRPHRQRPRLLQRPFQCHRTQLLGSRRRGAAAVGNHALGPNVSGWDEQRRRWLAQNKGFPATVPGGKPRILLVTGSQ

SEQ ID NO: 210134 - protein, 83 aa, Triticum aestivum
  unsure (1)..(83): unsure at all Xaa locations
  Clone ID: PAT_TA_104552.pep
IFPSSGTYFTLSLIGQCAMQICLIYGLNLLLYMSASYLMLFPSELXRFRGGFTTMSMLGLIHHQCSLVYKGLLIQHSTLPSSV

SEQ ID NO: 210135 - protein, 138 aa, Triticum aestivum
  Clone ID: PAT_TA_104553.pep
ASSLFALLHSPLLILALLVPIVSFVLFFAKKPQPSGSNGGPRLPPSPWGLPILGHLPLLGSLPHRKLRSLAEAHGPVMLLRLGGVPTVVASSADAALEVMKTHDLAFASRPAVRMAERLLYGRDMAFAPYGQYWRQAR

SEQ ID NO: 210136 - protein, 61 aa, Triticum aestivum
  Clone ID: PAT_TA_104554.pep
PRAAVDRWRRRRLLLRRIKPSQGLGRYKEGQTPTLAQSHGQQPGRSGFDSQVRALFLLYVS

SEQ ID NO: 210137 - protein, 85 aa, Triticum aestivum
  Clone ID: PAT_TA_104555.pep
QPSDDTPGELNRTSMIKAATTPRPPPSTLPSRHEPCLGQPPSPLVSATSSTRLASLPLLATPPSPCPRRPRPGALPYLWCHHPVW

SEQ ID NO: 210138 - protein, 105 aa, Triticum aestivum
  unsure (1)..(105): unsure at all Xaa locations
  Clone ID: PAT_TA_104556.pep
DVARLRVCDISWLMWSKGNYQVVGVAEENLRFQNNLPPPPRFISGEALWNPWCCAGRTMVAGLWGIXMDIEQSGXNGWQVLWPRSSSTHPHVHLLTWQLFTEVCC

SEQ ID NO: 210139 - protein, 119 aa, Triticum aestivum
  unsure (1)..(119): unsure at all Xaa locations
  Clone ID: PAT_TA_104557.pep
TVFSDNFVVLGTKVQFSTCFTPCTTLXRKERKTCTTTLKQLKSDPSLMQSTAQCCSCIRGNKSSAVPGENRGLYPIGMLIRGNLEHPLSKISRMKPIMIYLDHKILRTYDKRRIHHLNC

SEQ ID NO: 210140 - protein, 156 aa, Triticum aestivum
  Clone ID: PAT_TA_104558.pep
RSDLMNSIIGTAVSEDKNIRAASFECLVAIASKYYMHLKPYISGILKLTARAMEDDESVALQAIEFWCNICTCEQVEVQETYAEFDDANSVVNYHFIESTFRELVPMLLGTLLKQEEDKEQKGSVRKVSTSGMVCLGLIARILGDEVLPHMGKFID

SEQ ID NO: 210141 - protein, 103 aa, Triticum aestivum
  unsure (1)..(103): unsure at all Xaa locations
  Clone ID: PAT_TA_104559.pep
IHDVVLVGGSTRXPQIQQLLQDFFNGKELCKSINPDEAVAYGAAVQAAILXGEGNERVQDLLLLDVTPLSLGLETAGGVMTVLITRNTTIPTKKEQVFSTYSD

SEQ ID NO: 210142 - protein, 80 aa, Triticum aestivum
  unsure (1)..(80): unsure at all Xaa locations
  Clone ID: PAT_TA_104560.pep
VAANAVRTLEVATVYAGATTGDWGSRKRGGCILLNNFLFAGTDVWGGWNRXKFLFHWLQRGQMLMSFLLEPKFGFAGSVF

SEQ ID NO: 210143 - protein, 145 aa, Triticum aestivum
  Clone ID: PAT_TA_104561.pep
QQRTENSGRNRVGSFRYNDVDYSKPTVSKRYGHAHTVSGNYGHRSDSLEGGEPETIRMHRGENVQQGKFVRRDSNAVVDDRAAFKTFEAFTDVRNRPRALQMEIEERIQKLASRLNATDVNTPEWKFSKMIHDAQIKFTDHSILR

SEQ ID NO: 210144 - protein, 45 aa, Triticum aestivum
  unsure (1)..(45): unsure at all Xaa locations
  Clone ID: PAT_TA_104562.pep
GGKRLGRGTKITLFLXDDQLEYLKERRLKDLVKKHSEFIIYPIYL

SEQ ID NO: 210145 - protein, 164 aa, Triticum aestivum
  unsure (1)..(164): unsure at all Xaa locations
  Clone ID: PAT_TA_104563.pep
FMSQLNKALGHVSPLAICIDACKGLENAVKXIFPHADQRECFRHLMANFSKKFQGDVFGRMWPAARAYEPXVFNYHMNKILAEAPDVHEYLSRYHNLKWMRCMFDPSIKCDYINYNLAESFNGWIKDYKDLPPDELADTLRELVMKLHEKRRKIGMKLKGKIIP

SEQ ID NO: 210146 - protein, 50 aa, Triticum aestivum
  Clone ID: PAT_TA_104564.pep
IQPLNTYAVLHSVKVCHRRLLVLEHCHSHVRWIFSSSQEPSPPPHHGIHS

SEQ ID NO: 210147 - protein, 75 aa, Triticum aestivum
  Clone ID: PAT_TA_104565.pep
APPTPPPPTQQPTSDNSSSPTTRIYREASVEISHPVPERAKSKTEDHPTNVRVLHCRGAGGLSIFLLCKFAKIHL

SEQ ID NO: 210148 - protein, 100 aa, Triticum aestivum
  Clone ID: PAT_TA_104566.pep
YCTNSLDLARNSLFCSLSWQMTPMATGDQVVVLPLRHAPVSPCAPLHPPHASLCSPVSRPTTRRRLVLGGGGGGNRCLCEEACARTARGGGWYARDWVER

SEQ ID NO: 210149 - protein, 46 aa, Triticum aestivum
  Clone ID: PAT_TA_104567.pep
LSLSVAPPVGVPHLLPLADPCHGRGEPGSSLIAVADAALLFVYLPP

SEQ ID NO: 210150 - protein, 51 aa, Triticum aestivum
  Clone ID: PAT_TA_104568.pep
PPCRLLRLRSVRDSFSLASFKAYIAEFISTLIFSSRRRLPSPTLSERRRAP

SEQ ID NO: 210151 - protein, 52 aa, Triticum aestivum
  Clone ID: PAT_TA_104569.pep
LSARHQNVKSKIKSILQNIMYRTSELKKTSKFNHGNSSQVPNSFMLKKRDNL

SEQ ID NO: 210152 - protein, 57 aa, Triticum aestivum
  Clone ID: PAT_TA_104570.pep
CATMLVSIIEAVNSMIGYTPHLISSDSPEQEDITKLCTKYQFVWKQFRTPSVPKFLY

SEQ ID NO: 210153 - protein, 62 aa, Triticum aestivum
  Clone ID: PAT_TA_104571.pep
EDVGVQRHVLGRLQPPPVRARHPARLRLGEEQHGEHKCGIEPLLTSKSTHGQRSVDESTHAR

SEQ ID NO: 210154 - protein, 147 aa, Triticum aestivum
  Clone ID: PAT_TA_104572.pep
AYAATATSAIRNPRVFSFSTANASPRRLPVGVRKKPLRVVVTGGAGFVGSHLVDKLLARGDSVIVVDNFFTGRKENVAHHLANPRFELIRHDVVEPILLEVDQIYHLACPASPVHYKFNPIKTIITFFSISTVNVRVCLLLCIQLRI

SEQ ID NO: 210155 - protein, 63 aa, Triticum aestivum
  Clone ID: PAT_TA_104573.pep
KKTRISPRHIQLAVRNDEELSRLLGGVTIAAGGVLPNIHSVLLPKKAGKGAGTGGSASQSQEF

SEQ ID NO: 210156 - protein, 89 aa, Triticum aestivum
  Clone ID: PAT_TA_104574.pep
GGPRSRSGLSHHRPGDHARPRRCRPVNLHRPPSYLPLLFPLSFSLLSFLLSLPLPFPPLLSSISCAGRQGRGENKQLEMEQSRSPPSDK

SEQ ID NO: 210157 - protein, 51 aa, Triticum aestivum
  Clone ID: PAT_TA_104575.pep
MESSSSTAAAAAEHAGGAAAGEYEEVLARLSSLITQKVRADTGNRGNQWDL

SEQ ID NO: 210158 - protein, 153 aa, Triticum aestivum
  Clone ID: PAT_TA_104576.pep
MENLAVLKELTVRTPQHSKRLLTLNSLEKLEISKCENITRLAVGVHVQQLEQGQEEDGLLLIPAHLCDSLQELVIYKCPNLVLMDPLSFLPADGEGFQALRFLQRLKISECPNLLSPGSFSRYLFPSSLQKLFLHGVEGMGTLEPLSNLTSLM

SEQ ID NO: 210159 - protein, 127 aa, Triticum aestivum
  Clone ID: PAT_TA_104577.pep
GGLGHLLVFAFLFCVGAFMVAPVITDVTMAALCPGQDQCSLAIYLTGLQQAITGLGALVVTPVIGNLSDRYGRKALLALPATLSIVPLAIMAFNQTRPYFYAFYIAKTLTAMVSEGAMMCLSLAYVA

SEQ ID NO: 210160 - protein, 204 aa, Triticum aestivum
  Clone ID: PAT_TA_104578.pep
TILESNARALVPSKSKSSLSKTAGSSTMCVTSSVRQGYNWHISSNMLPAFGTFALASPPLLAMVPQTVLERWQRLHSLSLAGTALMASWSCRPLRLRTFCRRSGMLKPLLSRRPWSWREEKSTLVLGSLPCSWRCAARASSILTSSPGVHACSDGRGRGFLSGSAAGVDVVLPFFWGRSADGAVFLLRSGSWASASLLLADGVC

SEQ ID NO: 210161 - protein, 148 aa, Triticum aestivum
  unsure (1)..(148): unsure at all Xaa locations
  Clone ID: PAT_TA_104579.pep
VDFIFGSAXSLYEDCSIISNNKDITDMEVAQEGRASESRINSESSFSFKNCTIKGEGKPVFLGRAWGNFSQVVYSSTEMDSEIVPIRWGKGNMQKKHEKGIMQKPKRHLYPFPHPTTGMCTVSLLFLRPRHPHRAPLPLPSLRPHVQL

SEQ ID NO: 210162 - protein, 107 aa, Triticum aestivum
  Clone ID: PAT_TA_104580.pep
VLRSCAALVESLDTPGASLDVAAKVEQFILRPRAERLVTGGEKLPPWRSTFASAGLTPLQLSNAAEAQAECLLRRTANHGFHVEKQQAALALWWQRSELVSVSAWRC

SEQ ID NO: 210163 - protein, 186 aa, Triticum aestivum
  Clone ID: PAT_TA_104581.pep
SSPSRPPSPSLAMGSAASTDRAERRRRDRAPGHSGASDPPAAPPQDPSASASASEVDVSRKGCKVAPEPKDGEETAPLPGSPSFRIYCQKAARVDALVAEEADENADDDGFASAEDTTMAVRKDDPPHCSGDALLLADTTLAVRKNDPPHCSGDALLLADTTLAVRKNDPPQCSGELPKCKDGWLK

SEQ ID NO: 210164 - protein, 112 aa, Triticum aestivum
  Clone ID: PAT_TA_104582.pep
DEEAVGADLAGSGRERPEEEEGGGALAPGAARHDLGSRGRGDGPRERECHVGEDPGRDAEGAPDRQHRHEGRAHERQRRDDDPRRRWRRRRRLRRRRGRHISATAIDRCGKR

SEQ ID NO: 210165 - protein, 161 aa, Triticum aestivum
  Clone ID: PAT_TA_104583.pep
PGNTAASAPPVAGSSSASLQLVVSGQQGNPGEQPPRPLVSMTERARMARVPLPEPGTLRCPRCDSANTKFCYFNNYSLSQPRHFCKACRRYWTRGGALRNVPVGGGCRRNTKRSSKKSSRQGQGQGGGGAVAAATSSSSTTSTSTTTSAAAATAADVIASM

SEQ ID NO: 210166 - protein, 184 aa, Triticum aestivum
  Clone ID: PAT_TA_104584.pep
FDKFVNHLISLRGHLPLVSCEIQAYPTSDDYAGEPDEPLPNIYFDSWIQYALLCKVQVLKIIGDDVGAETELIVPLISQHLRSLEVHHVLVEKDFVDFSSCPMLEELKMQHCGLWVRKMSFPSLKRLWLTECNFPEAYRVCISAPSLVSLRLHDSGGKTPLLESMPLLDTASLDLSGRCNDKCR

SEQ ID NO: 210167 - protein, 115 aa, Triticum aestivum
  Clone ID: PAT_TA_104585.pep
AVSALLDLISALSAFVASTPPFPHSSRYGNPAFRLWHEKLGDSVNELIAPITATATSPSDLAGAEVELAPYLLDSFGNGTRIDYGTGHETNFAAFLYCLARLGLITEPDYPAVVL

SEQ ID NO: 210168 - protein, 118 aa, Triticum aestivum
  Clone ID: PAT_TA_104586.pep
AMNQTRQCKQACRRPEASDPPHLHPLLRASQHQPLHPRAHIEPHVEEPCRPAAAPARSASCRSGRRRPLRPRTQHHTRSGRGGPGSAAPPEVGSSRALAQPARRTTRWHPHEPDTRTP

SEQ ID NO: 210169 - protein, 73 aa, Triticum aestivum
  Clone ID: PAT_TA_104587.pep
CGAARASTTSPCRRLQLRHRPRATSRRARRRADGSRTSSRSPPPSASSKTMASRSPPAWPQAQPPVRAPPVQP

SEQ ID NO: 210170 - protein, 85 aa, Triticum aestivum
  Clone ID: PAT_TA_104588.pep
RLHPRTTATTASIHEIYRAFSATNKVKFTQNPNPYVSPLSCNSQDNKYNNQYIWTQLHESTSRNNSQGACSVYTPSQALSSPFHI

SEQ ID NO: 210171 - protein, 53 aa, Triticum aestivum
  Clone ID: PAT_TA_104589.pep
RDVLSEILIHDSLVGREFQSFKSEDDHAFLLDLVFWFKQSFRLLKHPCASFLV

SEQ ID NO: 210172 - protein, 86 aa, Triticum aestivum
  Clone ID: PAT_TA_104590.pep
GTRPRSHPSPRLSLLSHPMERERTRARLLPSRSPPPPPSDGAHRRPWPSPRPPSLAPPLPSPEGREEPEGGRSNAIQPRSTLGNQC

SEQ ID NO: 210173 - protein, 82 aa, Triticum aestivum
  unsure (1)..(82): unsure at all Xaa locations
  Clone ID: PAT_TA_104591.pep
SQPINHSQIAGAATXTSQPTDGRTWGAGEEGGPGGVEGAEAVGEAGEAEAGLVERRPRAVHRLQRDQRRDQLLAVDGDVDVA

SEQ ID NO: 210174 - protein, 119 aa, Triticum aestivum
  unsure (1)..(119): unsure at all Xaa locations
  Clone ID: PAT_TA_104592.pep
HRDFDDGWVVELALDRETGSRLESKDRYLFGRFDLDIRLVAGMSAGTRDHRFLQRKCTWISLVDCSFVLVSDCLINRHLRTTRPCYGGGAAEHHQPPLMREVARPXHGPGTCHGRVGRH

SEQ ID NO: 210175 - protein, 69 aa, Triticum aestivum
  Clone ID: PAT_TA_104593.pep
PLPAIDCMNCSIRTQFFKVIRMWACFYFSLYSFVFFWLQVTAAQKVQLTQMMHGKNCRSSIVFVFRFCN

SEQ ID NO: 210176 - protein, 133 aa, Triticum aestivum
  Clone ID: PAT_TA_104594.pep
CGEFNDWLVHIRRMSKQIGQVSISHASLARQKEEEMRARQREAEGHGHTGPDQHMYTLDAENTDEETALDFDLTPVYRTHHIHVCLGIGEKFRDYYYKNRQMQLSLDMQISTSQPFLESHQPFLAQVAGFFYC

SEQ ID NO: 210177 - protein, 190 aa, Triticum aestivum
  unsure (1)..(190): unsure at all Xaa locations
  Clone ID: PAT_TA_104595.pep
RRDDLVRSVGDFGGRITMRRTVKSAPQSIWYGPDRPKYLGPFSEQTPSYLTGEFPGDYGWDTAGLSADPETFAKNRELEVIHSRWAMLGALGCVFPEILSKNGIKFGEAVWFKAGAXIFSEGGLDYLGNPNLVHAQSILAIWAVQVVLMGFIEGYRVGGGPLGEGLDIIYPGGAFDPLGLADDPDTAAEL

SEQ ID NO: 210178 - protein, 190 aa, Triticum aestivum
  Clone ID: PAT_TA_104596.pep
QWRRFLAFRGMQAELFLPLVNARRNANRHLMLSGGLPAYLDHLLDARVPVDDDTADGKALRPLTDDELVSLLSEFLGAGPGTVVSSMEWTLAHLVLQPEVQNNIRREVHAVEGALSETRVRQMKYMHAVVLESLRLHPPIPVLLRDVPDQAVAEILGCAAAAVPTEGMRAHFNLGEIGRDKNAWTDPDAF

SEQ ID NO: 210179 - protein, 201 aa, Triticum aestivum
  Clone ID: PAT_TA_104597.pep
IVNFVVKPNRFSALKETSVKDYQNFNFSQPYSQASYYLSLILEEKKWPLAEKLQALSKLESDSLAKFVPHLLSKTYLECYVQGNIEPGEAESIVQEIEDTIFNTPNSVFKPMSPSQYLVKRVIMLEKEIKCCYQIEGLNQKNENSSVVQYIQVHQDDALSNIKLELFSLISSQPAFNQLRTVEQLGYITYLSLRSDRGVWA

SEQ ID NO: 210180 - protein, 177 aa, Triticum aestivum
  unsure (1)..(177): unsure at all Xaa locations
  Clone ID: PAT_TA_104598.pep
ANTLRSEEXGDIVSLKNYMNAQYFGEIGVGTPPQKFTVIFDTGSSNLWVPSAKCYFSIACYLHARYKAGASSTYKKNGKPAAIQYGTGSIAGYFSEDSVTVGDLVXEIIFGGMDPKHYVGEHTYVPVTQKGYWQFDMGDVLVGGKSTGFCAGGCAAIADSGTSLLAGPTAIITEINE

SEQ ID NO: 210181 - protein, 54 aa, Triticum aestivum
  Clone ID: PAT_TA_104599.pep
MAAPIPREWVGLQQFPAATQTKLHELLGKLKEENVSTLTILVMGKGGVGKSSTV

SEQ ID NO: 210182 - protein, 205 aa, Triticum aestivum
  Clone ID: PAT_TA_104600.pep
LHGQFYEGRLGTNVSAEVYGEVAKIDTNATLFMNEYGTLESALDLTAMASKYAAKMEQIRSYPGNAGIRLAVGLESHFETPNLPYMRATLDMLAQLKVPIWLTEIDVSPKTGPYQAEYLEDVLREGYGHPNVEGMVLWAAWHKHGCWVMCLTDNNFTNLPTGNVVDKLIAEWKTHPVAARTDANGVAELNLVHGEYKFTVTHPSL

SEQ ID NO: 210183 - protein, 66 aa, Triticum aestivum
  Clone ID: PAT_TA_104601.pep
SPRHVRDGGSGRRWRRRPFPWRLVLLEYAEEPEPLGRLDLHQLGPLNLHHEERGLLHLDLRGRGVA

SEQ ID NO: 210184 - protein, 144 aa, Triticum aestivum
  Clone ID: PAT_TA_104602.pep
FSRLQQQPAPRPHLPPPPHHHAAAYHDHDDSTAPAPDAGPGDLGSEEEKRDEEPAASAPSPLRAAAAYHDPDDSTAPAPDAGSGDVGSEEEEQDEELAASAPAPAPASDGDGDGEGRECDLFDGSWVRDPARYPLYEAAECPFL

SEQ ID NO: 210185 - protein, 136 aa, Triticum aestivum; identical to SEQ ID NO: 106789
  Clone ID: PAT_TA_104603.pep

SEQ ID NO: 210186 - protein, 180 aa, Triticum aestivum
  Clone ID: PAT_TA_104604.pep
NSESLSTKYCSGEDADADAGLNSDVYQLIHELLLHIHRSDPDLENSILVFLPTYYALEQQWIRLSSVRSVFKVHILHRSIDTDEALQTMKVSKSCRKVILATNIAESSVTIPGVAYVIDSCRSLQVYWDPIRKTDSAGLVWASKSQAEQRKGRTGRTCDGQIYRLVTGPFYNSLDDHEHP

SEQ ID NO: 210187 - protein, 178 aa, Triticum aestivum
  Clone ID: PAT_TA_104605.pep
MACEEPSKIVNIPSIVQELVTCVQEPPSQYVVPEQNRPGVACSEMPEPIPIIDLSRLPAPGNSSDEVAKMQSALENWGLFLAVGHGIEPSFLSEVMKVTKEFYKLPLEEKQKYSNLVDGEEFRMEGYGNDIVVSEKKTLDWSDRLYLVVEPESRRIYSLWPAHPPSFRDIMCEYTVRC

SEQ ID NO: 210188 - protein, 172 aa, Triticum aestivum
  Clone ID: PAT_TA_104606.pep
AAQLARVIIGIVEACHSLGVMHRDLKPENFLFVNQKEDSPLKTIDFGLSIFFKPGGIYSDVVGSPYYVAPEVLLKQYGCEVDVWSAGVIIYILLSGVPPFWDESEQGIFEQVLQGDLDFSSEPWPSISKSAKDLVRKMLNRDPGKRLTAHEALCHPWVCVDGVAPDKPLDSA

SEQ ID NO: 210189 - protein, 153 aa, Triticum aestivum
  Clone ID: PAT_TA_104607.pep
MPLAASTARFLLLSVLLLSSPAVTVVRARVTALIVFGDSTVDAGNNNAVPTAVRSNFPPYGRDFPGGRATGRFCNGRVATDFYSEAFGLRPFVPAYLDPDYGIQDFAVGVCFASAGSGLDVATAGVFSVIPLSKQVDYFRDYKARLAEHLGAA

SEQ ID NO: 210190 - protein, 113 aa, Triticum aestivum
  Clone ID: PAT_TA_104608.pep
MARGLKKHLKRLNAPSHWMLDKLGGAFAPKPSSGPHKARECLPLILILRNRLKYALTYREVQSILMQRHIMVDGKVRTDKTYPAGFMDIISIPKTGENYRLLYDTKGRFRLHS

SEQ ID NO: 210191 - protein, 156 aa, Triticum aestivum
  Clone ID: PAT_TA_104609.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLER

SEQ ID NO: 210192 - protein, 143 aa, Triticum aestivum; identical to SEQ ID NO: 179847
  Clone ID: PAT_TA_104610.pep

SEQ ID NO: 210193 - protein, 54 aa, Triticum aestivum
  Clone ID: PAT_TA_104611.pep
LHNFSIFFCNLIMCIFYKQYCILFMDFVIIISAVRFLYFFYVNIDSQRVPLNQF

SEQ ID NO: 210194 - protein, 61 aa, Triticum aestivum
  Clone ID: PAT_TA_104612.pep
LCTFMSSAPLPIELTVTIQKTKNNKVHQQTFDQYVQLAFYLNHHIKSLYLGQEEKKLSNRG

SEQ ID NO: 210195 - protein, 183 aa, Triticum aestivum
  Clone ID: PAT_TA_104613.pep
FLTTAVLMLVWLLRFRGGINIQSDDPEQIFNVHPFVMTWGFILLIGEAILVYTTIPMNHRAQKMVHMLVHLVAFILGVFGIYAAFKFHNVAVVPDLLSLHSWIGIGAISLFALQWLIGFAVFWMPGTHEHTRAAAAPVHVAGGLVIFLLAVCAAQTGLVQKSASATPGTEARLINVTGLFIVF

SEQ ID NO: 210196 - protein, 170 aa, Triticum aestivum
  Clone ID: PAT_TA_104614.pep
LLRQVDLTGGYYDAGDNVKFGFPLAFSSTMLAWSVLEFGGMMKGELQHARDAVRWGADYLLKATAHPDTVYVQVGDAGKDHACWERPEDMDTPRTVYKVDPSTPGSDVAAETAAALAAASLVFRKSDPAYSSRLVARAKRVFEFADKHRGVYSAKLSSYVCPYYCSCSGY

SEQ ID NO: 210197 - protein, 176 aa, Triticum aestivum
  unsure (1)..(176): unsure at all Xaa locations
  Clone ID: PAT_TA_104615.pep
VRYPDDPFDRXWESDSLRRANYLVDVAPGTERITTTKPVFVGTELEPPEKVMQTAVVGQNGSLNYRLDLEGFPGNAWAVSYFAEIEDLAPDETRKFKLVVPGMPLFSKPTVDVEENAQGKYRLYQPGYTNVTLPFVFSFEFKKTNDSSKGPILNAMEXYKHVQITMGSQDANTMSS

SEQ ID NO: 210198 - protein, 84 aa, Triticum aestivum
  Clone ID: PAT_TA_104616.pep
FLSHVFPADHEISTRSRVQCQAVFSYYVLHGTPTTGARQDILDFEEPVGSWLSLVTQTVFKLTVMHLRSIIYEPSFLGKITLAK

SEQ ID NO: 210199 - protein, 165 aa, Triticum aestivum
  Clone ID: PAT_TA_104617.pep
GGLGRCGMNNSDPVRAEEKTITEDDAAPAVKKQESMRRDGVDSPKVAHDKVEHPPHMAPLHEVPNEEAKDSQAAPSGNEGGSAPYDELFPMADKGMDFNWNGEMSAEKLAIARDMYASLPDAYKHGDAGDRQVVTGFMAFVMGVVAMFRVGKIAPKRAMDAAMGI

SEQ ID NO: 210200 - protein, 73 aa, Triticum aestivum
  Clone ID: PAT_TA_104618.pep
MGNVTSSVAARLAFFPPEPATYEVAAAEGGAGLRMTGVLPYANVDVHALPTRAGTRVVAAFWRYPSARLTLLY

SEQ ID NO: 210201 - protein, 117 aa, Triticum aestivum
  Clone ID: PAT_TA_104619.pep
MDVHSAPVAARRMWGYLRAVFFMMRKGKRKLLLGAHLLMKRRNKAVSRSVANLLSHHHHHGHHGGRALRRREYEFSCGDSPDPGSFSMRRLAFPCLGAADDVDQPGRLRAEHPAPAT

SEQ ID NO: 210202 - protein, 171 aa, Triticum aestivum
  Clone ID: PAT_TA_104620.pep
PCFLSVQVHHISLDLDEDLVAVLMQACLGGNAPAFQVTRLRDQLFRISVSHNRIVQALIAEPILTGKTHSIQFLPYPPPHSSSHPKPTDQRKLFDIGDRFGHADAFLRSQLRFSPSPGIDFELNILELFSSKVFGPPPDAATPSSIIFVHKADFMVDEILVATLLSFRFGG

SEQ ID NO: 210203 - protein, 163 aa, Triticum aestivum
  Clone ID: PAT_TA_104621.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQPFPQTQQPQQP

SEQ ID NO: 210204 - protein, 102 aa, Triticum aestivum
  Clone ID: PAT_TA_104622.pep
NTFLLVLTACCHCGLVDEGMNFLELMSKRYRIVPGEDHYVCVVDLISCSSRSCDEVVEWIRSSPFGSSKQAWETLVGKCAINGNAELMSKAEEQLAELDSPK

SEQ ID NO: 210205 - protein, 141 aa, Triticum aestivum
  Clone ID: PAT_TA_104623.pep
AAVGALRPPTNLKPHRRPPPGPSNPRRLHLPAPFPVCLTWCLASRLSMQPSPVLTSQVRRRRRSCPNGSVASSLSCGSSPTFDHNHLPLLIAVSSAPFPVSFNADIRKYVGGGATTYSYFPSLPTRSMLGTLPWISLPFTF

SEQ ID NO: 210206 - protein, 185 aa, Triticum aestivum
  Clone ID: PAT_TA_104624.pep
RRRAAHEFLLASALRACAQSRAARFGEQVHGVTAKLGLDANVFVGTALVNLYAKAGRIDAAMSVFDALPVRNPVTWTAVITGYSQAGQARVALELFGKMGLDGVRPDRFVLASAASACSALGFVEGGMQIHAYAYRTAAESDASVTNALIDLYCKCSKLSLARRLFDSMENRNLVSWTTMIAGYM

SEQ ID NO: 210207 - protein, 160 aa, Triticum aestivum
  unsure (1)..(160): unsure at all Xaa locations
  Clone ID: PAT_TA_104625.pep
TILILMTELGVQFTDSMSILVSSAVPEGKGVSSSASVEVATMSAIAAAYGLNITPRDLALLCQKVENHVVGAPCGVMDQMASACGEANKLLAMVCQPAEVKELVMIPSHIRFWGLDSGIRHSVGGGDYGSVRVXTYMGRKMIKCAXSDLVSVSSTSDAPA

SEQ ID NO: 210208 - protein, 166 aa, Triticum aestivum
  Clone ID: PAT_TA_104626.pep
VDDFTNGLRPDPQPDDWLSKARGFLYEIWTLRSRSSIAAQIADLKQRAQHVGDRRVRYGVRDPNPGTGKNGLGGYTIAEHQEITRRLIGIKEPVGVDIAKLEEWIRSEELKLGVLSIYGFGGVGKTTAAMALYRSCGVHFECRAMVTVSHHTDPDVVLCDILRQVK

SEQ ID NO: 210209 - protein, 73 aa, Triticum aestivum
  Clone ID: PAT_TA_104627.pep
PVREDTLSFKYISMCYLVQYSECGLIYRFDNFVFEGCFFRQPSVSRQVHDRPLSLYAWLSCCLCFNVLCSSHL

SEQ ID NO: 210210 - protein, 70 aa, Triticum aestivum
  Clone ID: PAT_TA_104628.pep
GNPNPANALVALVNPDRAADKLPALRTTKGLGCMVLHCIARCLALYPGTVCASDGTLAPPCHPPETDITE

SEQ ID NO: 210211 - protein, 90 aa, Triticum aestivum
  unsure (1)..(90): unsure at all Xaa locations
  Clone ID: PAT_TA_104629.pep
TLVGIEGKEKGDDDAGYLGKGMRVTWGESSDLRRGRWRPMEGMGRRRPWEGRGGRRIGVGDAGDLXNGGWELLSPSSLSAAGDHRPLLGG

SEQ ID NO: 210212 - protein, 122 aa, Triticum aestivum
  Clone ID: PAT_TA_104630.pep
ALAGHLHTVHSVPVRAVQYGKASQLRLPVSAPRLVLLGDDDNRVFLLSVGALGAGVTAVSVVCARASAATRPRFACKLWVNLEAANCGKEDMVLVDMHMRSSSSPGAVVAAGEPTFLTVPPM

SEQ ID NO: 210213 - protein, 198 aa, Triticum aestivum
  Clone ID: PAT_TA_104631.pep
MGMKKLSFFMGLLMLALFPVLSRQDGFDQWVALQESKTSVATSTLDAKLSTAEASRLGNGVDPYTIFGAEDGMYKSISECISNIPNDNTRRHMFNLKPGTVFREKVFVGKDKPFVTLKSDPSNPAVIVWNDTAMTKGKDGKLLTSRGSSTVTIESDYFIAYGIIIKNDALPAKAGDKQVQATALHVTGTKAIFYNCTI

SEQ ID NO: 210214 - protein, 196 aa, Triticum aestivum
  Clone ID: PAT_TA_104632.pep
DGPHVKAESGTCNVCSAPCSSCLHRDLAPVDSNMDCGSSQTCCARSESRTNLLVRSGKGLRTKGGENDDELSATSSHASYSENGGHKAMARSIAADSEVNMPAKRRRLLSDTRSPREECHDDSNSCVTGTSAASKLLLDKKKDKLSTSASSRDLTVKDYKDKNIAGPNRLRNSLVEESTEKKRSDVHIAPPSSSDR

SEQ ID NO: 210215 - protein, 181 aa, Triticum aestivum
  Clone ID: PAT_TA_104633.pep
FSRPLLRAAAGAGAPACAPPRARAAVASVVCRLPPPPQTPCGLFQQRFGFASLPAAEAAAGRDPEAEVTAEEARRLMRMANVEALKRRLGDGEVIPYAELLRKCEEAGAARTRAEATALAGALDEAGVVLLFRDKVYLQPDKIVDLVRKAMPLALTPEDDPRKEELKQLQTHLEEINKLAH

SEQ ID NO: 210216 - protein, 160 aa, Triticum aestivum
  Clone ID: PAT_TA_104634.pep
MSPLFASVVVLAAVALTTNGVSANNEKLHCNLRTANISKEWVTMVDPCVKAMRDQINTELTASMTYLAMAAHFSTDSVNRPGFAAHFFKSADEEREHAIKLIEYMLMRGELTKDIGELIRNPVPVETAWTSGVAALKHALELETSVTNSIRSIVAVCEDP

SEQ ID NO: 210217 - protein, 158 aa, Triticum aestivum
  Clone ID: PAT_TA_104635.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEPAEGQEAEVAAAATEEAKKSNNV

SEQ ID NO: 210218 - protein, 125 aa, Triticum aestivum
  Clone ID: PAT_TA_104636.pep
MTPTVLMEFAPQRQIKRSYDEMAYRGVPRGYAETVGESGSPVRVDSQDSSAPKRKCISLNSDGFGVKREIFVPSKMSSSERRYLRKRFRSELDSVRDLLKKPEFLAIMPASRAPAYSSSAAPRAK

SEQ ID NO: 210219 - protein, 73 aa, Triticum aestivum
  Clone ID: PAT_TA_104637.pep
NKKSSCMGTAILIEKRTRNMGGDIAGWSARQGDCQLRRTRPNINRHRPQDRCKIHTGRPKPKTGCKTRRQIEI

SEQ ID NO: 210220 - protein, 132 aa, Triticum aestivum
  Clone ID: PAT_TA_104638.pep
AISCAPAPPTTPRHQPPCLPPPRSPPSAGSRPQRPPHFLDRPPTAPPHDAGLHGFDPPRRPAMPTSKAPAPAPPRNGWPRPCPLRPSLIPRDPRHVEPPPSDPPTAPLLPHCGPSRGEDGLCRAVNEGTSRA

SEQ ID NO: 210221 - protein, 81 aa, Triticum aestivum
  Clone ID: PAT_TA_104639.pep
STTTNMIPCSLLLAELVGCVLHYCLSDPSPPRRSDRQVRLHARMRQTMTMVKKILPEMYLGSAARKVQTAPAYMQWKRKVT

SEQ ID NO: 210222 - protein, 200 aa, Triticum aestivum
  Clone ID: PAT_TA_104640.pep
DPPAFVPVLPQPAELAAVVRRASFSLDVYRVLLAQIHDCRNGSVFVQVGTEGRAVMRVHTPLCPQRRVAFIPPLPRPALRPRGLCSFTQILSTEERGGLSYHYLYVESTVDKPETRLHIYVLQDGLWLPRAPLDMHQLPRPLLQPKPVLVDTRIYMPAGLSDIIVLDLTASSFSTIQLPRGTKHDECGGTTMLARSYDAS

SEQ ID NO: 210223 - protein, 146 aa, Triticum aestivum
  Clone ID: PAT_TA_104641.pep
HLGRKMMSWPMISQLFHHPSSLFVYQGNTALWKAVIWTCKRKIWMLFQQAHFRKGSVLSVLAHQMVFFLPKRALSHKSTFITVRRVVGGVLQVADEPSPEAISRAPKSLVSNVDEHDDRSKPPLIQQRGRFKVTPGNVELDKAHSP

SEQ ID NO: 210224 - protein, 140 aa, Triticum aestivum
  unsure (1)..(140): unsure at all Xaa locations
  Clone ID: PAT_TA_104642.pep
MSLIAGEEFQHILRVLNTNVDGKQKIMFALTSIKGVGRRFSNIVCKKADIDMNKRAGELSAEEMDRLMAVVHNPRQFKVPDWFLNRKKDYKDGRFSXVVSNAVDMKLRDDLERLKKIRNHRGLRHXWGVRVRGQHTKTTG

SEQ ID NO: 210225 - protein, 174 aa, Triticum aestivum
  Clone ID: PAT_TA_104643.pep
FTLGVKQMICCCNKMDATTPKYSKARYEEIVKEVSSYLKKVGYNPDKVPFVPISGFEGDNMIERSTNLDWYKGPTLLEALDQINEPKRPSDKPLRLPLQDVYKIGGIGTVPVGRVETGVIKPGMVVTFGPTGLTTEVKSVEMHHESLLEALPGDNVGFNVKNVAVKDLKRGYVA

SEQ ID NO: 210226 - protein, 167 aa, Triticum aestivum
  Clone ID: PAT_TA_104644.pep
DSSSSPSVSLSDESSEAEAQCCSSSSTAPSLHDTVDFSRTASDVSTFSERSVDHSGPFGTAAVSKLIGGRGSPAAALSRLSMKPRADVLDRRSAEDELDLVKERFSKLLLGEDMSGGGKGVCTAVAISNAITNLYATVFGNCHKLEPLPAGKKAMWRREMDCLLAVC

SEQ ID NO: 210227 - protein, 96 aa, Triticum aestivum
  Clone ID: PAT_TA_104645.pep
KNLNMKLNLLNFHFSSPSASRVYTIFDCCFSMMLPKIEHPGVGERDQEAEQSVVSPPSSSSLVRGDGERRSVWSSSIVDRVSFLSLLSHVSFSVAV

SEQ ID NO: 210228 - protein, 115 aa, Triticum aestivum
  unsure (1)..(115): unsure at all Xaa locations
  Clone ID: PAT_TA_104646.pep
AAPAASPPPCCRLPMAPMPATISATSSPLPVPPVPPSPRLRSAPSPXPLPRPCRTPPTRNTAPSRALPLRRRPPWPQPAKLEAPAAAPRRRALTPPLVQPWAPPASTFGLARVLL

SEQ ID NO: 210229 - protein, 130 aa, Triticum aestivum
  unsure (1)..(130): unsure at all Xaa locations
  Clone ID: PAT_TA_104647.pep
VGVPGWNLAFRRSLSPVEFEDWQCLTASFPSLLTNMDSVIXPYSALGRFSIKSLYSKLIGGSPTNRFSQIWKARIPPKVKIFLWQAFRGRLPSADQIHKRNGPGSLFCALCGELEDSAHIFFHCALAKLI

SEQ ID NO: 210230 - protein, 179 aa, Triticum aestivum
  unsure (1)..(179): unsure at all Xaa locations
  Clone ID: PAT_TA_104648.pep
STHLVTVEESKVSADSDDEFYDADKVDPSQEVQSGDVNAEIGNTNQEETYSLKEELECLVHGGLPMALRGELWQAFVGVGARRVEGYYGSLLASEGELXDGGCSDSLASEGVDERPEVLSAFSAEEKCKGQIEKDLPRTFPGHPALDDVGRNALRRLLLAYARHNPTVGYCQAMNFFAG

SEQ ID NO: 210231 - protein, 140 aa, Triticum aestivum
  Clone ID: PAT_TA_104649.pep
MMKGAGAMSTMKPPSSPMFCVREADGHGHHFLEECSLCGKSLSGDIFMYRGDTPFCSEECRHQQIEVDRARHRRKKHAAAHAVSAARKEQHRQHHHHHHHHHHHRQHQQPEPEPQPRAAMVGSAPWADAGFAARSPALRV

SEQ ID NO: 210232 - protein, 186 aa, Triticum aestivum
  unsure (1)..(186): unsure at all Xaa locations
  Clone ID: PAT_TA_104650.pep
IEDGYSALEYIDTQGYQLSPDARAQADLKFTYVVSCQIYGQQKQRKAPEAADIALLLQRNEALRVAFIHEEDGVSSDGQAIKEYHSKLVKADIHGKDQEIYSIKLPXNPKLGEGKPENQNHAIIFTRGDAIQTIDMNQDNYLEEAMKVRNXLEEFRGNHGIRYPTILGVREHVFTGSVSSLASFMS

SEQ ID NO: 210233 - protein, 103 aa, Triticum aestivum
  Clone ID: PAT_TA_104651.pep
IHKGSQCSHKYNNSSSHLQIKSLKDQYFAELGELFNKLSVKLQHVDNIIPPQNPSDKYDRMKSFKIMLDRILQMLLIIKSTIQPAMWDKVPQYEKQIISILNS

SEQ ID NO: 210234 - protein, 66 aa, Triticum aestivum
  Clone ID: PAT_TA_104652.pep
YTAISPALCYCLCLALRHPFVCTWTIEPPFRHPPPLCYFSLSSLSPQPKTGKTRYTEDSTSTTNEH

SEQ ID NO: 210235 - protein, 138 aa, Triticum aestivum
  Clone ID: PAT_TA_104653.pep
MAPAMRPEQEASCKATEDHRSEFDAAKPPPFRIGDVRAAVPAHCWRKSPLRSLSYVARDVVVVAALAAAAWRADSWALWPLYWAVQGTMFWALFVLGHDCGHGSFSDSGTLNSVVGHLLHTFILVPYNGWRISHRTHH

SEQ ID NO: 210236 - protein, 139 aa, Triticum aestivum
  Clone ID: PAT_TA_104654.pep
TATTPHLPYLAFKDPTSQDKISGKSSWMATILTNFDGATKSSRLKGWRRRCAAHWAAPRLRGTPGLWGRPAELACWRRTGRRRWGRRATVACRQCRGRRRSSCRDPRLPRGARPPCPWRVPRRPARSPSLRGSYPRLLL

SEQ ID NO: 210237 - protein, 78 aa, Triticum aestivum
  Clone ID: PAT_TA_104655.pep
QGTWMFNPGHGQDWLDLSGTPDHISRAEQLISDVFAKADAGSFGTISSCVEQFQMQIANNKDGRHTIITNSVFYKSTD

SEQ ID NO: 210238 - protein, 129 aa, Triticum aestivum
  Clone ID: PAT_TA_104656.pep
FLVRAATSLAAAASSATPVPTDVAVSLLAGSVHAAAFRHGHAADLHVQSGAVSMYAAVGDVGAVRAAFAEIMSPDVVCVTAMLGALSAGGDVDTARELFDRMPQQDHVAWNAMLTGYVRVGRAREALGL

SEQ ID NO: 210239 - protein, 147 aa, Triticum aestivum
  unsure (1)..(147): unsure at all Xaa locations
  Clone ID: PAT_TA_104657.pep
MVNVMMKTNPDPVVLAKAMKARKSVVQIYHVKKIDGKKCTTSSGTGFIIKTRDADCVVVTNRHVTAGKEPFDEANDKLFVRFIXGVVGVEDRPGLLRFYDFFVDLAFIEVQGLRGKMPPALRFTMASELQIGTSVVAIGYCNTSGVT

SEQ ID NO: 210240 - protein, 73 aa, Triticum aestivum
  Clone ID: PAT_TA_104658.pep
TGHRTAAPLRQADVRFELHAGSTEGGRVTGANPDPVERRTGIYSASRRAPVGFGGGEGAGRRRCSGEGGDGDA

SEQ ID NO: 210241 - protein, 202 aa, Triticum aestivum
  Clone ID: PAT_TA_104659.pep
SAPLLRRTAPVPAATAAAAAGPFCFQPCHSPASPRCPPGFSSPRFAREDLVLLLFPQLAGSTPDPVLPPGCSTSPSSPFVPDPLPEDPPAAPASVAPGPARKVCFAAAEDLLNPAPAKLIHGAPRSCLKTARSAASAGQGAARTPVPSNPATPRAMSIEPLGVDASSEEGWMLVKPPYWWRALSSSLRQSRQRSSPSFSPPS

SEQ ID NO: 210242 - protein, 142 aa, Triticum aestivum
  Clone ID: PAT_TA_104660.pep
VMVRIDGDLITINEHLTSADQQTSDPLTIADNGADEQRRESRAKRRTRERSCKGSMAAKKHHEKIGKRKSCTKVPRGERNALVDRRNESFAGKVKTQSVTSSSILEMSSTGQPTVVEAHGASTSSSTPEYTIRSEDDMDAYL

SEQ ID NO: 210243 - protein, 57 aa, Triticum aestivum
  unsure (1)..(57): unsure at all Xaa locations
  Clone ID: PAT_TA_104661.pep
GTTYLCTDXSTGVGWGCKSIAKRKLLTPEDVEDVRREIQIMHHLAGHDIVVTIKGAY

SEQ ID NO: 210244 - protein, 57 aa, Triticum aestivum
  unsure (1)..(57): unsure at all Xaa locations
  Clone ID: PAT_TA_104662.pep
PTHIIKKKNVKEWISGSICPIMQLWXAHXSTQTNKPISILQETPPYQIRASSYFLVG

SEQ ID NO: 210245 - protein, 177 aa, Triticum aestivum
  Clone ID: PAT_TA_104663.pep
NRVAVTVSPKIDAGILVARLRKSGKLAEPWPEEPKQQQEPPPPAESQSQETKNQADDASKPNEAAEKPAAEPSTAQPPAPEPEKTAEETPPPAEENKGPDEAKAETGPQQQPSEANEKAKQQQQQEQHDHHDKPMDARVTMEYDDARSRGVYGYRGPPPVHASDTAAAGARHELQRG

SEQ ID NO: 210246 - protein, 74 aa, Triticum aestivum
  Clone ID: PAT_TA_104664.pep
SRPSNSSSTFNMTPCSWSCYPAPRRLQALSCVHCLESIPRHSLVEVAQALRPAPRVSTPQKLATISITLLCRRR

SEQ ID NO: 210247 - protein, 148 aa, Triticum aestivum
  Clone ID: PAT_TA_104665.pep
FQVLVLQYYKQPPKLLLESLSITGTTKKGQLLQVLTKHNDFLQLAKITLTGTRLKQDDLKVLNKLPNIVCLRLREKAYIDIKLTFENDKFKNLKCFLVEGSNMTDILFEGGALKLEKITLCSTDGIQSLSGVEALPELKEVELNNNNN

SEQ ID NO: 210248 - protein, 114 aa, Triticum aestivum
  Clone ID: PAT_TA_104666.pep
LITSYRVNFPTDCQSDRTSFSDEVSQYQDAYDARLDIASSINRTYYSAGYGSAYSLNSSRADVRSDRANMLRVSTGDSSRISISSSIPSSSSQGSGPDDIESLGDVYVWGEVWT

SEQ ID NO: 210249 - protein, 78 aa, Triticum aestivum
  Clone ID: PAT_TA_104667.pep
HFLFPCRTPKLSLAFKMCHLNHRWTVSDSVLFITCISCLNSFQFCILTEQPHTISCICLLLAWVQSAFAIRYTETKFP

SEQ ID NO: 210250 - protein, 169 aa, Triticum aestivum
  Clone ID: PAT_TA_104668.pep
HGAAAHVRLHQPHPRLPLPRHRPARRPPRLHGVDRISRLPRALLRNIVSRLPVTDAARTAVLCSRWRTVWLSAPPVLVDAYLREDDYAWPPTPANSPAITAAVSRILEAHPGPFRHVHLVCSHMNAYRARLARWLQLLAAKGVQDLGLVNRPWPWDVPLPDALFAINTL

SEQ ID NO: 210251 - protein, 181 aa, Triticum aestivum
  unsure (1)..(181): unsure at all Xaa locations
  Clone ID: PAT_TA_104669.pep
RTSRRTQCKCKNSXCLKKYCECFASGRYCNDCNCKNCYNNVGHEAARQVAIDAAMERNPMAFMPKIGNIPPHAAQNREFKVAEGPLVGKHMKGCHCKRSECLKKYCECFRSNILCSENCKCMDCKNYESNEDRKAIRRITRHQQHLVYAHHMQNPATMGITGPYAALSPAAEKLSNLSVAS

SEQ ID NO: 210252 - protein, 77 aa, Triticum aestivum
  Clone ID: PAT_TA_104670.pep
HTSHPYHRIRPNSRCEATPLLPQHLAVMLQLLQDTDPSHDQEHADQPPTPTRMKKKHQHHHHSSWPGTAGHRQGWRR

SEQ ID NO: 210253 - protein, 65 aa, Triticum aestivum
  Clone ID: PAT_TA_104671.pep
SLSGGYNKACNPEGVPSCNRQKVISFVLCCLVSFCSCRGRNTNTLVGGTLHLFISGLTVFNGVQL

SEQ ID NO: 210254 - protein, 116 aa, Triticum aestivum
  Clone ID: PAT_TA_104672.pep
RAVEDVITRGETKYLEFHIRTPYGHGRLARHEFMSFSRACPVAFRWLTMLTFDNIAFDDSDIPDLISACDRLRHLTLSSCRLVEFYSPLEIHTPCSRLQKLFFIDFDCRWIALMTL

SEQ ID NO: 210255 - protein, 143 aa, Triticum aestivum
  Clone ID: PAT_TA_104673.pep
MAASQSSIAMVPSRCTAETHTARGKVAFEIAGYSRLKGLGRGKCLRSSAFSIGGYEWCIRYYPDGCQGEAGDGYVSVFVVLLTKNAEVRALNNWMLVNGVSGQSIVVLSGKAPRVFDRKMPAWGVPKFMKTTAEVESVYLQND

SEQ ID NO: 210256 - protein, 203 aa, Triticum aestivum
  unsure (1)..(203): unsure at all Xaa locations
  Clone ID: PAT_TA_104674.pep
GDIELCRLFSLSEEFKYVSVRQDEKMELAKLLDRVPIPVKESLEEPSAKINVLLQAYISRLKLEGLSLGSDMVYIRQSAGRLLRALFEIVLKRGWAQLAEKALNLCKMIDKQMWNVQTPLRQFPGIPKEILMKLEKKELAXERYYDLSSQEIGELIRFQKMGKQLHRCMHQLPKLNLSAHVQPITRTVLGFELTITPDFLWDD

SEQ ID NO: 210257 - protein, 118 aa, Triticum aestivum
  Clone ID: PAT_TA_104675.pep
HHHHHHQLRGTAQLAVASLVSHGLALVSQTAAQTLNQHQNALLALPLQEQDRVLQALQQQPCEDGRQHSPGNYSAVAPGPASLPAQAQAQAEAEADADAAEECRHHRRRRRRHCDCGG

SEQ ID NO: 210258 - protein, 156 aa, Triticum aestivum
  Clone ID: PAT_TA_104676.pep
MAAAGDAGEKKMITLKSSDGEEFEVEEAVAMESQTIRHMIEDDCADNGIPLPNVNSKILSKVIEYCNKHVQAKPADGAAAAAGASDAAAPAAPAEDLKNWDAEFVKVDQATLFDLILAANYLNIKGLLDLTCQTVADMIKGKTPEEIRKTFNIKND

SEQ ID NO: 210259 - protein, 141 aa, Triticum aestivum
  Clone ID: PAT_TA_104677.pep
AASPPLRHVAMLPFMAKGHAMPLLHLARLLLGRRLASAVTFFTTPRNAPFIRAGLAGAGAGAAVIELPFPSEDAPQCTDELPSTTHLVDFVSAMAALGPAFADALAVVEPRPDLLVHDGFIVWAKDIADELGMPRLVTLGI

SEQ ID NO: 210260 - protein, 90 aa, Triticum aestivum
  Clone ID: PAT_TA_104678.pep
LPLPAVAAASSRHAAPLPPSDARPLPPPGTPGPLPPSGSRALSPRGSNPASPTDRCVAASADPLPSSGSWSMIPAHPAARLLPRVCINKK

SEQ ID NO: 210261 - protein, 136 aa, Triticum aestivum
  Clone ID: PAT_TA_104679.pep
QQLPSQQLPTCSKLLTNLFYWRKVTSLKQRMIFLGTREFLWMKLIWFLLVAFQLWLIQIYVGCMDSGKVTAFFILVDTFCQGNGEGIILLLSLNLINVSCKDVALSNVLNTSFVTNMEYRAVRFLSFELNFIYICH

SEQ ID NO: 210262 - protein, 176 aa, Triticum aestivum
  Clone ID: PAT_TA_104680.pep
ASAVTATPERVCSFEPSVWDDFFIHYEPQPLKTSEDCLRAKAQKLQEDVQMLFQTFTSVVQKMNLIDTLQRLGIDHLFEDQINTTMNEIHKKEFDSCSLYDVALRFRLLRERGLWVSPDVFSKFKGKDGRLNRDIISEPMGLLSLYNAAYLSIPGESELDEAIVFARHHLESMRGS

SEQ ID NO: 210263 - protein, 66 aa, Triticum aestivum
  Clone ID: PAT_TA_104681.pep
GGAGSGAVRGTARPTRRRRRRSRARRRRPPPRGRRKPSRWEEEEEADAAVRVLEFPLKKRESRGRK

SEQ ID NO: 210264 - protein, 50 aa, Triticum aestivum
  Clone ID: PAT_TA_104682.pep
ATRAFQYYLDRSTPHATGRWLGTLVVAAVYALRVLSIHGFYIVSYGLGIY

SEQ ID NO: 210265 - protein, 127 aa, Triticum aestivum
  Clone ID: PAT_TA_104683.pep
SCGRIHYGSAFGEPSGNADKVEDMGYILVKHGFNYHGKDLLYSGILGHPLETYIFMGPIYYQKLKHMVLDKMRARASGPRVTMTRKPTEGRSHNGGLRVGEMERDCLIAHGASMLIFERLLLCSDPY

SEQ ID NO: 210266 - protein, 89 aa, Triticum aestivum
  Clone ID: PAT_TA_104684.pep
DLCFLRRRPSVQVVLFCSVAFRLLLKHAADSLCLLPIWCSVLHLVHLTLHEPSLYSCMYLDVNFFNKLLKKADGSRLLVASYTPCPGNQ

SEQ ID NO: 210267 - protein, 176 aa, Triticum aestivum
  Clone ID: PAT_TA_104685.pep
GLVSEMMNKGIPRPDIAFFNSIINTLCKEGGVMDAQDVFDLVTAIDERPNIITFNSLIDGYCLVGEMDKAFGVLDAMKSVGAEPDIVTYNTLVNGYCRNGRIDDGLTLFREMPHKRIKPDTVTYGIILDGLFHAARTVVARKMFHEMIESETTVDIPVYNIILKGLCRNNCADEAI

SEQ ID NO: 210268 - protein, 91 aa, Triticum aestivum
  Clone ID: PAT_TA_104686.pep
ASDRTHSSGSLEPRVRNCQTAAAMGVEGPAISYLHEQGRMGRDMKVGNDPVDSYGSIKLAESGLGTCMYVTRCTQFFFLLWRGTSLLVLKR

SEQ ID NO: 210269 - protein, 182 aa, Triticum aestivum
  Clone ID: PAT_TA_104687.pep
RFDVAGQEGTLWWHAHVTSLRVTVHGALIIRPRSGPDSYPFPKPDKEIPIVIGEWWETDPFELDRRFANSDFADVPRSSTINGKLGDLNTCSGVTEDNYVLEVELGKTYLLRIVNAALHPQYYFKIAGHTFTVVAVDANYVKPYMTDTIVIAAGETVDVLVVAAAAPTGGRYYMVALGIMSL

SEQ ID NO: 210270 - protein, 167 aa, Triticum aestivum
  unsure (1)..(167): unsure at all Xaa locations
  Clone ID: PAT_TA_104688.pep
MAVGKNKRISKGXKGSKKKAVDPFTKKQWYDIKAPLLFTSRNVGKTLVSRTQGTKIASEGLKHRVFEVSLADLQNDEDQAYRKIRLRAEDVQGMNVLTNFWGMDFTTDKLRSLVRKWQTLIEAHVDVKTTDNYMLRMFAIGFTKRRPNQVKRTCYAQASQIRQIRRK

SEQ ID NO: 210271 - protein, 125 aa, Triticum aestivum
  Clone ID: PAT_TA_104689.pep
LNEHNKPFFDLCDGLFVNYTWKEKYPRDSAATAGDRKYDVYMGIDVFGRNTFGGGQWKTNVALDLLKKDDVSTAIFAPGWIYETKQQPDFQSAQNRWWALVEKSWDVLRGYPKRLPFYSDFDQGH

SEQ ID NO: 210272 - protein, 117 aa, Triticum aestivum
  unsure (1)..(117): unsure at all Xaa locations
  Clone ID: PAT_TA_104690.pep
AASSPVAYDRAADLRALDATFAGVTGLVASGLTHVPCIFRVPEGHHDKQDTTVLAGGQEEPGAIPVIDLGCGDHAAVVAAVRXAAAGCGFFQVTGHAVPEAAMAAATDAMRAFHAAD

SEQ ID NO: 210273 - protein, 88 aa, Triticum aestivum
  unsure (1)..(88): unsure at all Xaa locations
  Clone ID: PAT_TA_104691.pep
DHPMRIQTMTTSDTKDVAXTVEHVMRIAHKGADFVIITVHGKKEADACFEIKNTLVQKNYNIPLVADIHFAPTVALRVAECFDKIRVN

SEQ ID NO: 210274 - protein, 63 aa, Triticum aestivum
  Clone ID: PAT_TA_104692.pep
LAVVKNEHACFLFISILTELMNHDSCVSLAFFCLKSCATLCATYHLFMRDWVSQISSIVFHVS

SEQ ID NO: 210275 - protein, 132 aa, Triticum aestivum
  Clone ID: PAT_TA_104693.pep
PPWMCPKCSYLSRWSGLPQAMVGRGDVLPPWLAGGRCCKGGGSCGEPGRQHCDRAPPQVLQRSTKAKVRCCSPPVLQRSVKAGGGRRLLPVLRCSTQEEVGLLAIGVVLELLSRHQSCNGAPHEVAMEHHRS

SEQ ID NO: 210276 - protein, 33 aa, Triticum aestivum
  unsure (1)..(33): unsure at all Xaa locations
  Clone ID: PAT_TA_104694.pep
ACCCNCCXACCCNCCCNCCCGGRCNCCCGCICA

SEQ ID NO: 210277 - protein, 101 aa, Triticum aestivum
  Clone ID: PAT_TA_104695.pep
MSTDVVADVPAPEVAAAADPVVETTAEPAAGDAKPAKETKAKAAKAKKPSAPRKPRAAPAHPTYAEMVSEAITALKERTGSSPYAIAKFVEDKHKAHLPAN

SEQ ID NO: 210278 - protein, 145 aa, Triticum aestivum
  Clone ID: PAT_TA_104696.pep
PPLPLPLVPVVSPPADLLCSGPLPSPAGTMMHYLYQQEIQRENRRRSLLLRQMEEGHAELLNWPALIQRGRYAHHLGIITRCATAVLGLAILIYVLVLKYKYHLPELQDPIDMGACVFVALCFIPSGYLCTQDYSISKLGFLFAC

SEQ ID NO: 210279 - protein, 191 aa, Triticum aestivum
  Clone ID: PAT_TA_104697.pep
GPACLAPSPSGRAGRPAPRPPHCRAAGLAPSTPRPRPRPPRCDAPPCPAARLRALLPVAAPRSRAQPRPCARLSCTRAAAPLASCPWRSQNTPTPTRAGAASRRGFTAAPWPPSTTAPGLEHGQPIEVVIIDDDDEAAALPSPTPAVVEAEASDVVVDADTVGPSRLPSPPSRWRRSRAAAPAAQQRCSRS

SEQ ID NO: 210280 - protein, 103 aa, Triticum aestivum
  Clone ID: PAT_TA_104698.pep
ANLKKVGPYGYGSLDGNIVDIDWNKSPEELVSIEIWGNHNAGGMIYAMSFTYRDEKGDLVPVGPWGSKKGEKRTISIANNLVALRGSTSGSYVTSLTFKTSIT

SEQ ID NO: 210281 - protein, 126 aa, Triticum aestivum
  Clone ID: PAT_TA_104699.pep
MRPRRRRGGARSAQGSSHSSTSPRPSRSSMAMAVRAPTTTHPLPPPPPQPLARCSPRACTPGPTPSPPASANATSLPATATATTMTTALLPSTSGHSGSARPPFLTTTTTATMRTARRRRRMTAVL

SEQ ID NO: 210282 - protein, 132 aa, Triticum aestivum
  Clone ID: PAT_TA_104700.pep
RRRRSNRRTVDAVAAAEDELDNVDFSRRRRRATAFLRLLQAIRERQLQRLESAAALGNGGGLETEHYSPFGRSIFAAAPLGEHGMALGDYFLGPGLDALMQQLADSDAGRQGTPPAKKGAVEALPTVEVVGG

SEQ ID NO: 210283 - protein, 144 aa, Triticum aestivum
  unsure (1)..(144): unsure at all Xaa locations
  Clone ID: PAT_TA_104701.pep
MGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKXDKAAAHLKGGAKKVVISAPSKDAPMFVVGVNEDKYT

SEQ ID NO: 210284 - protein, 167 aa, Triticum aestivum
  Clone ID: PAT_TA_104702.pep
MGKEKTHINIVVIGHVDSGKSTTTGHLIYKLGGIDKRVIERFEKEAGEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARY

SEQ ID NO: 210285 - protein, 50 aa, Triticum aestivum
  Clone ID: PAT_TA_104703.pep
MSGTVCSMCGDVGFQDKLFGCARCRCRFQHSYVPIFSLFERVLFETLPRC

SEQ ID NO: 210286 - protein, 44 aa, Triticum aestivum
  Clone ID: PAT_TA_104704.pep
TFKQRCDRITAGAKNGKKFNSLCAYGRVGGVMVLEGDPESAKCI

SEQ ID NO: 210287 - protein, 147 aa, Triticum aestivum
  Clone ID: PAT_TA_104705.pep
PRRGLPSSQLDLRSSRRHHGVSVSLAAASSSAASPEVEKEPSSPSTTPPDESSALSAVAESVKVLKEAAKTRKVPADDVLAALAKIKKAKLDTSAFFETLGGTESPGRTWKLIFTAQGSKLGKGSYFPVTAVQRFDAAGQRIENGVY

SEQ ID NO: 210288 - protein, 98 aa, Triticum aestivum
  Clone ID: PAT_TA_104706.pep
MPPRTSPPVPRRNPRLTPTSPPTLRRNPKPSQPAPRINPKLPLMSLPALRRNPRLTPTSPPAPRRNLKPPLTSPPAPKRNPRLPPTSLPMPRRNQRMT

SEQ ID NO: 210289 - protein, 50 aa, Triticum aestivum
  unsure (1)..(50): unsure at all Xaa locations
  Clone ID: PAT_TA_104707.pep
GTAPAPPDAPRTRSGPRPCPPPRAPPSRPXSPPPPSPATAPPSPPEGRRS

SEQ ID NO: 210290 - protein, 68 aa, Triticum aestivum
  Clone ID: PAT_TA_104708.pep
LSSSIVKLHHLQGLRLLLTGLLYCTVTIHIFVINFSTVTYPKKISRAVLTPLAMEPRKTKLKPLNCPN

SEQ ID NO: 210291 - protein, 130 aa, Triticum aestivum
  Clone ID: PAT_TA_104709.pep
ESTAVFHTPSKPPSEEGATRATSRRPAARHRIEALKIRRKGTSHCGPSAEDHPVPRCLASLRSAIPGRPRQKGLATTNQPCARRETAAAVAMRSNISRRRRPSVHIHPATQQPKSKNRREDDTDGKTKDP

SEQ ID NO: 210292 - protein, 131 aa, Triticum aestivum
  Clone ID: PAT_TA_104710.pep
LKCQAKHDRFGGPIMAGQARCFGLAVNMFLDLERQYCESYTQGHVKRAYFVGPVSLPLPPAGASGGGEASCISWLGSMPRHSVVYVCFGTYASISNGQLGELALGLEASGKPFLWALRAEGWAPPAGWEER

SEQ ID NO: 210293 - protein, 189 aa, Triticum aestivum
  Clone ID: PAT_TA_104711.pep
SEGPMYHNGVYHLFYQYNPLGATWGTGNLSWGHSVSRDLVNWAALDTMLDPTALFDNNGCWSGSATILPGGIPALMYTGRIDAGKEVQVQNIAFPKNPVDPLLREWVKPAYNPIIRLPTDVPGDKFHDPTTAWVDHDGLWRIAVAAKVGGPSGIASTLIYRSKDFRRWKRNTLPLYMSHTADMVECPDL

SEQ ID NO: 210294 - protein, 99 aa, Triticum aestivum
  Clone ID: PAT_TA_104712.pep
RPGSQRGGDLPVERGEQWIRSVVGLKHQRRRFLLSFIKAEVVSSTSSLMVAVMLPGTPSTRRCCRCWWNYASRCWCNTAAHGAQRRRRATLLPSAHRVT

SEQ ID NO: 210295 - protein, 94 aa, Triticum aestivum
  unsure (1)..(94): unsure at all Xaa locations
  Clone ID: PAT_TA_104713.pep
RLYTPSSSSATAEAADGGSEPAASTFLSFSDPLTGDDGGAAGGGCASASRLPVDHEINSRIYLWRGHPWNMEVDAVXNSTNESLDEAHSNPGLH

SEQ ID NO: 210296 - protein, 164 aa, Triticum aestivum
  Clone ID: PAT_TA_104714.pep
KNAPICYVWFEPTPWMDITQGLLKTIYVNKMLKAGYIVKILIADWFAQRNHRICSNKYVIRKIGCYNIEMWKAAGMDLDRVELVWFSDVLERHASDYWPLALDVSKKCTLKRMASCCTETAPYDPRLPAAVIFYPCMQVAAILCPKLQADIWLFSMDQQEIVML

SEQ ID NO: 210297 - protein, 134 aa, Triticum aestivum
  Clone ID: PAT_TA_104715.pep
MAPQSLDLGLSLGLGLVSQPTLPSFWYSGGNVAADQEVGPTPTAAAVEERRCSPGSPASSGSGSGLKRGAERSAGSGDEDQDDDGGNARKKLRLSKDQAAVLEECFKTHHTLTPKQKLALANSLGLRPRQVEVW

SEQ ID NO: 210298 - protein, 112 aa, Triticum aestivum
  Clone ID: PAT_TA_104716.pep
GSTVECQVGCHGRIWLALLRKEGLKELEADIGCGPLELVHDLLNIIVAVARPAADFGILPDMLMCSSVRPSFARARCSCRFVVRSVPVCWVFVRCFAGCTSLQILHDQCAYL

SEQ ID NO: 210299 - protein, 85 aa, Triticum aestivum
  Clone ID: PAT_TA_104717.pep
LKVRPEEAFVAWNQMQATSMADTSRADYLRESIVWLAGASTTSDLTIAENPSNAKRINCGVLTDFDWVARKHATEVAGAARDAAK

SEQ ID NO: 210300 - protein, 177 aa, Triticum aestivum
  Clone ID: PAT_TA_104718.pep
VPRTDLQGTPVVDGVLSEMTSVTADLHSAAAFGATLLGDGEENVGQFLYLEAMEYHMWNTYDVHFYASFALLSLFPELELSLQRDFARAVLLHDPRPMRTLNGKTVPRKVLGSVPHDVGLNDPWFELNAYMIHDPSRWKDLNPKFVLQVYRGVVATGNVAFARAAWPAVYLAMAYMD

SEQ ID NO: 210301 - protein, 72 aa, Triticum aestivum
  Clone ID: PAT_TA_104719.pep
LGGGFGKGGGLGGGIGKGGGLGDGIGHGIGGGIGKGGGLGGGIGKGGGLGGGFGKGGGLGGGIGKGGGLGGG

SEQ ID NO: 210302 - protein, 121 aa, Triticum aestivum
  unsure (1)..(121): unsure at all Xaa locations
  Clone ID: PAT_TA_104720.pep
ECANGVKGGKKSSSSSSLMYEAPLGYSIEDVRPAGGAKKFSAAYSNCAKKPSXISFSLCSSLLCSLTRTATMAAPTSAIGFEGYEKRLEITFSEASIFADPHGRGLRALSRAQIDSVLDLA

SEQ ID NO: 210303 - protein, 178 aa, Triticum aestivum
  Clone ID: PAT_TA_104721.pep
NRPPLGRRIVGNEERQALPLNEVRDHVNDQHPSYTMQPKRAKLARLHRVTHSEEMQDGLLSHEVYGEAGHSELIDEATATHKNQRVGCSVSPQTVSIGERHMETPAQIIQQVHKQPFHDAVVHAEGSQLYCLDLDGVVHPPVDQAEHGEEASPEMINKTVLRESIRPTGCAVEPNSVN

SEQ ID NO: 210304 - protein, 122 aa, Triticum aestivum
  Clone ID: PAT_TA_104722.pep
MAFEKIKVANPIVEMDGDEMTRVFWQSIKDKLIFPFLDLDIKYFDLGVLHRDATDDKVTVEAAEATLKYNVAIKCATITPDEDRVKEFNLKQMWRSPNGTIRNIINGTVFREPIICKNVPKL

SEQ ID NO: 210305 - protein, 119 aa, Triticum aestivum
  Clone ID: PAT_TA_104723.pep
LRRKIQSPDYSLPDNAAQLLDALLVAARRFCLAPPRLLTQICLALAALALRAEGGVDGLFARMPHLPDPALLELLTVLPEEVAHDESGDTGVDSATRCRFARELLMHAPAVLEFLLAQS

SEQ ID NO: 210306 - protein, 82 aa, Triticum aestivum
  Clone ID: PAT_TA_104724.pep
RLINSHGSYCINQGSWTAVEHDWWLGRPPRQEQHQGQGWQWRQGRWQQRQSNGNARSLPSFPFFFENSPFLSCLAYSAAKIM

SEQ ID NO: 210307 - protein, 132 aa, Triticum aestivum
  Clone ID: PAT_TA_104725.pep
MADRANHPSVMQKFGGQFHLASSFSEGVRARNICPSVPSYERRFTTSSYMTQNLGISVPMMSSSPLFANAPPEKKGVKNFAIDFLMGGVSAAVSKTAAAPIERVKLLIQNQDEMIKAGRLSEPYKGIGDCFG

SEQ ID NO: 210308 - protein, 58 aa, Triticum aestivum
  Clone ID: PAT_TA_104726.pep
FSSCVLFSYLHDPLYASDNVYVLNICMISLFFMFLMRFIFSLWLNPGSPLKRHKPYVD

SEQ ID NO: 210309 - protein, 52 aa, Triticum aestivum
  Clone ID: PAT_TA_104727.pep
MFSKEEKMCSFLLNWLMLSLLKHGDNIKENIDDWPLIRKQRKIIILSHCLLY

SEQ ID NO: 210310 - protein, 189 aa, Triticum aestivum
  Clone ID: PAT_TA_104728.pep
RRRAPAPSESDIQRILDECFILLFETPSGFALFHSALSLINRPDSMEDIWSYFIYDCMAKLAITLKEFQTFEDKSSAINQNSGVNERLTQMIRTWIGGKKLAVGKPEYKEIIEERLKIDCLYNPAVMEVMWGIQNCMPSLVPGEKSQLAEEDRVPMSKGLRKVLKRYDCNVKTKIVSKQIIEMAAALFK

SEQ ID NO: 210311 - protein, 140 aa, Triticum aestivum
  Clone ID: PAT_TA_104729.pep
MRECISIHIGQAGIQVGNACWELYCLEHGIQPDGQMPGDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNA

SEQ ID NO: 210312 - protein, 205 aa, Triticum aestivum
  Clone ID: PAT_TA_104730.pep
LLLLLPPIPNQEEPGARRAKEEKRRSPSPARAQDSRRRDLGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATS

SEQ ID NO: 210313 - protein, 163 aa, Triticum aestivum
  Clone ID: PAT_TA_104731.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLSVDYGK

SEQ ID NO: 210314 - protein, 83 aa, Triticum aestivum
  Clone ID: PAT_TA_104732.pep
NYNFTRRESCAMLLKKRNAVACHHPCTLQDNKQNCTGHKIRSDLEAGKKTKPPAALCSRLEHRRFEGRAEADYSNAASYPPLI

SEQ ID NO: 210315 - protein, 160 aa, Triticum aestivum
  Clone ID: PAT_TA_104733.pep
SSSPIPPSLAAATIMPPSSPSYNHATGGSRRSWRHIAAGVPRKRLGDAATASRQEANGEHAVKMPPGGPTIRSMSSSEGRLLRRRGRRRTIEEQQRRRRGPSRSSRGGDEDHRGAAGDRRTPSSLPAAPSPSMDIVRMVNLVWRIIFRYHVCPSLQDSIR

SEQ ID NO: 210316 - protein, 127 aa, Triticum aestivum
  Clone ID: PAT_TA_104734.pep
PLTAGRAPWTAPSKQWRPPTTRWSTPRPPPSASPAGRRRSRTSTAASTPSATPATEPRASSSGRRRPRPRRRPPRRAVPRRARGRQGSPGRRRRPGGERDGPGKESPSDHAAGGRGQLAQSIHLVSR

SEQ ID NO: 210317 - protein, 95 aa, Triticum aestivum
  unsure (1)..(95): unsure at all Xaa locations
  Clone ID: PAT_TA_104735.pep
NGANLSSVSNGGKIMCMQVWPIDGIKNFETLSYLPPLSTDALLKQVDYLIRSKWVPCLXFSNVGFIFREHNASPGYYNGRYWTMWKLPMFRCTDA

SEQ ID NO: 210318 - protein, 133 aa, Triticum aestivum
  unsure (1)..(133): unsure at all Xaa locations
  Clone ID: PAT_TA_104736.pep
IPRRPGGTRVLATTFDSLGEAYDFYNLYSREXRLIVKRTKCMQEIVCGCSGKADVENTRSCCCEYPALVRLLWAEDNGXYIAEHRENHNHWISPNFVETVHXPLHKHIDVYSRDRIVVNASHLLSQGAAFFKL

SEQ ID NO: 210319 - protein, 101 aa, Triticum aestivum
  unsure (1)..(101): unsure at all Xaa locations
  Clone ID: PAT_TA_104737.pep
TKITRRVQMKLQRAEQSSWRSNDFGSLLAISDLEAIPSGHMITLYYKLKKCVKWKLVLKRIALFEPPTNFSHNMCHSSGNTNXDVQFFFPLQRTGPLARTR

SEQ ID NO: 210320 - protein, 45 aa, Triticum aestivum
  Clone ID: PAT_TA_104738.pep
ETRGLRQEERGLSSAWAPASFYSLSDCQIAGVNTPRHISLSDHQV

SEQ ID NO: 210321 - protein, 182 aa, Triticum aestivum
  Clone ID: PAT_TA_104739.pep
RGVNADADLLRAELRRMQCFLRDADAKRRAGGRDSERLKNWVVDVRDAAYDAGNALEEADFLARHRHMRRGFLGALPWLANLAALHTFGVKIRRVRARIRQISDSAVAYGITDLGEASALADVEEQEVTPYDLSWNSADSDFFVGFHEERDAIFKELLDPEISPICVVSIVGMAGSGKSTLA

SEQ ID NO: 210322 - protein, 108 aa, Triticum aestivum
  Clone ID: PAT_TA_104740.pep
NTNAISTELYTAPHFMQLSSSTIKYKLTYHTLQVTKHGIEVESKYKTPSAIPRRSTIRTSQLLIYPNKFFSSTTSQFLLVLILHTTIKFASYRLCFLPSTNKQQIPDL

SEQ ID NO: 210323 - protein, 184 aa, Triticum aestivum
  Clone ID: PAT_TA_104741.pep
MCSTKCRLLLRRLHDRHFSTAPPPNHRKSNPQVTIRWPERYRPSTDAGDTARAHEATVRRLAAAGDVDGVQYALQEMRLRGVACPEGALVAAICAFARAGAADRALKTFYRAHDLGCAAPTVRVYNHLLDALLRENLVGAVVPVYDNMRKAGVEPNVYTYNLLMKALCQNDRVDAARKMLDEMA

SEQ ID NO: 210324 - protein, 170 aa, Triticum aestivum
  Clone ID: PAT_TA_104742.pep
MAAKEPMRVLVTGAAGQIGYALVPMIARGVMLGADQPVILHMLDIEFAAEALKGVKMELIDAAFPLLKGVVATTDVVEACTGVNVAVMVGGFPRKEGMERKDVMTKNVSIYKAQASALEAHAAPNCKVLVVANPANTNALILKEFAPSIPEKNISCLTRLDHNRALGQIS

SEQ ID NO: 210325 - protein, 134 aa, Triticum aestivum
  unsure (1)..(134): unsure at all Xaa locations
  Clone ID: PAT_TA_104743.pep
TLFERARXWISTVSPFFLLPSSLDLQLGTPYPRSTDFSNDTWAVKMSGPALHMLLSKSCTCIDPRNSGADQQARVTGCAGRACVEHLRAWSPATARGRSGGSTTGKSQAAAPPTYHPVASRFHGGGEQFSWRRR

SEQ ID NO: 210326 - protein, 126 aa, Triticum aestivum
  Clone ID: PAT_TA_104744.pep
MEQKLNLSTPRLALVESGCSNSSKSDIDDDLVPMVAAVNCKRTFASVQGNFGSAMERAEEVLVKLPAEHPSFVKHMLHSHVVQGFWLGLPSVFCNKHLPKEDTTFVLEDEDGHNYDAKYLGAKQGL

SEQ ID NO: 210327 - protein, 160 aa, Triticum aestivum
  Clone ID: PAT_TA_104745.pep
SLVHHLIFSGDSDRCILSLLVLPAYLILKVHDNWRKRFEEIPRYLWLEEYCKQVRTCIEIALQCMDIERLNRPSMNHIVSKLIPIRRIGVRRGRATAAHYMTSSLKVDYTSAKFSTDLSLPIDINEMIDTPQMPSLEPEDSHIRTCELPFEFLREITNDF

SEQ ID NO: 210328 - protein, 148 aa, Triticum aestivum
  Clone ID: PAT_TA_104746.pep
MGISRDSMHKRRATGGKQKAWRKKRKYELGRQPANTKLSSNKTVRRVRVRGGNVKWRALRLDTGNFSWGSEAVTRKTRLLDVVYNSSNNELVRTQTLVKNAIVQVDAAPFKQWYLTHYGVEIGRKKKAAAAAKKEAAEGQEAEVAAAA

SEQ ID NO: 210329 - protein, 124 aa, Triticum aestivum
  Clone ID: PAT_TA_104747.pep
QTELPIVGVSIPVCKLNGQCMTLSLILFSFWNLKDNNFIIDIYLLDLERSALLHLYIYVHWVLFREVWIYTFMSSPLHDLFVSIICRSTNNFLIKEGRMDEAEDYLSSVKASNTAPLMVRIIAT

SEQ ID NO: 210330 - protein, 94 aa, Triticum aestivum
  Clone ID: PAT_TA_104748.pep
PLLNPQHTARRKDMMAWFASLVVLGSVYVAALAFRLLSHLTVCLRRCYGTWAVLTGPTSGIGWSVAMELARRGLNLVLVGRDPAKLRDISKTIS

SEQ ID NO: 210331 - protein, 52 aa, Triticum aestivum
  Clone ID: PAT_TA_104749.pep
TDATQVINEVEEVKKEYPDAYVRIIGFDNMRQVQCVSFIAFKPPGCEESGKA

SEQ ID NO: 210332 - protein, 179 aa, Triticum aestivum
  Clone ID: PAT_TA_104750.pep
TMFRKELLAALFLVLCASALSSEIEYDELFEASNGTAAFYAYPSVNFGVIPLANGLCNNRVSSTRRTVKEFIADAFENNSFGCAGYPGGPPVPTVPNPFTRPDPPPAANLPNYIVLPPIVNAPAPPAGRFLADERMTICDANDFNTVLDGNSKTTGLKSFLCRDFPGIFCSTNDGSDVP

SEQ ID NO: 210333 - protein, 160 aa, Triticum aestivum
  Clone ID: PAT_TA_104751.pep
PPQSCLPLLILSGDTYNEGYDYASQNVIDKLGVSGLSEGKIASSLVVFLAGSCTEGYINGFFDDDKLREGLKWMANSFPLQPDVILVKTHELLLNYLNPSLELLNKRVAPEVGPEHCISVFNNAVSQLGEEILAAAYISPNQWPTLEIDLLERSSSERMF

SEQ ID NO: 210334 - protein, 109 aa, Triticum aestivum
  Clone ID: PAT_TA_104752.pep
VSPGCIHSPVFFISEYPTLLAHVRCPARSAARSARSGRAHDAHLRTTRLPPNGLSMSTPLANNPTYTHAPPHMQHAQTRRPLSQLTSMHTPCSRTHTWAWLAPNMTIRC

SEQ ID NO: 210335 - protein, 86 aa, Triticum aestivum
  Clone ID: PAT_TA_104753.pep
LDLLSLRLPSCRRLRPHTRLLCDAASHPRSPPIFAPLPRCVVAESRLCGSVLGDLFHATLVRLASASGKDSSFTSCAPPLTHYRAT

SEQ ID NO: 210336 - protein, 156 aa, Triticum aestivum
  Clone ID: PAT_TA_104754.pep
IIEMEADRSKTMKSKHSHWRNYDDLNEYFWSRDCFRLGWPMRADADFFKTPNFVLNARDQTNGEHRPAGNDHWMGKVNFVEIRSFWHIFRSFNRMWSFLILSLQAMVIVAWNGGTPGDIFDAGVFKQVLSIFITAAVMKMGQAILDIVLSWKARKS

SEQ ID NO: 210337 - protein, 85 aa, Triticum aestivum
  Clone ID: PAT_TA_104755.pep
FVGRSRGRTFWQQVHESFHEQKHIAPYDMHIIHDRNVRSLSYRWYTIRPMITKFCHIVAQLEARWPLHAAKEEIASLTSSSSSTC

SEQ ID NO: 210338 - protein, 158 aa, Triticum aestivum
  Clone ID: PAT_TA_104756.pep
MRECISIHIGQAGIQVGNACWELYCLEHGIQPDGQMPGDKTVGGGDDAFNTFFSETGAGKHVPRAVFVDLEPTVIDEVRTGAYRQLFHPEQLISGKEDAANNFARGHYTIGKEIVDLCLDRIRKLSDNCTGLQGFLVFNAVGGGTGSGLGSLLLERLS

SEQ ID NO: 210339 - protein, 144 aa, Triticum aestivum
  Clone ID: PAT_TA_104757.pep
GSNEGTEAALDALGAELTTPLVADVMHRLRYEEKLAFRFFAWASQQDNYEHEHRTYNDMIDILSGTRYKSRQFGVLCDVLDHMKRHGTRSVPVEDLLGILRAYTEKHLTNLRKLAKKRRVRMRTPPETDALNILLDAFCKCGMV

SEQ ID NO: 210340 - protein, 119 aa, Triticum aestivum
  unsure (1)..(119): unsure at all Xaa locations
  Clone ID: PAT_TA_104758.pep
RAVDHRSLLLAFRAMLRAGVAPDHFTFPFALKALAQARXRTFPRAGGALRCLHAQLAKSGHGADVYVTSSLVHAYAAAAADAASARAVFDAARHRNVVTWTAMIAGHAAAGEARDAVAL

SEQ ID NO: 210341 - protein, 116 aa, Triticum aestivum
  Clone ID: PAT_TA_104759.pep
HNLTADEQVALLLYHGLTMAYSEELLSWVTRVHGEFSTLDGEDMLTIRHHRGRLMLSSWPPSSRNKTRITKTVVDDDHLAVYLIDAVLIPADPKRQRVVALIVIILVLVAGVLVAL

SEQ ID NO: 210342 - protein, 157 aa, Triticum aestivum
  Clone ID: PAT_TA_104760.pep
MADGEDIQPLVCDNGTGMVKAGFAGDDAPRAVFPSIVGRPRHTGVMVGMGQKDAYVGDEAQSKRGILTEAPLNPKANREKMTQIMFETFNVPAMYVAIQAVLSLYASGRTTGIVLDSGDGVSHTVPIYEGYALPHAILRLDLAGRDLTDSLMKILTE

SEQ ID NO: 210343 - protein, 90 aa, Triticum aestivum
  Clone ID: PAT_TA_104761.pep
AGGEGRRTRSGHGGGGHGGCGRAQRKRAALKGVGQGAAGACGARTRCARGGQAGRAAARAGGAQKQQRARAGGTGRGLQSRRVVAGGGTR

SEQ ID NO: 210344 - protein, 59 aa, Triticum aestivum
  Clone ID: PAT_TA_104762.pep
KIELPWLGKKMPCRMANLFQITKFAMVLRNKLAMVDGEKMPCNMSNLFNFTEFAILHKI

SEQ ID NO: 210345 - protein, 129 aa, Triticum aestivum
  unsure (1)..(129): unsure at all Xaa locations
  Clone ID: PAT_TA_104763.pep
VFWLVPQFALMGVADGFALVGLQEYFYDQVPDSMRSLGIGLYLSVIGAGSFLSGLVIAAADHVSSHGGRRAGWFXKDLSRSRLDLFYWLLAAISAVNLGFYVLVAARYSYKQTVKAKRVSASDVECATA

SEQ ID NO: 210346 - protein, 182 aa, Triticum aestivum
  unsure (1)..(182): unsure at all Xaa locations
  Clone ID: PAT_TA_104764.pep
FLPEGASTLHFQNPSAEIIRHRAIPNVFANLEQARYKQSHQQGSPLTPSWQHLPQDIHFYAGDWDELHTVLSVIQEDEVDALSGVGLGFCEDDFLDGCSSQDGNNICHETSSRRSTKLSGSRAWERGNEACTGDEGGXDIVLVNEIPYSASSLQNLYSLIKKVRKFLMLFSVSFCWEDTFLR

SEQ ID NO: 210347 - protein, 179 aa, Triticum aestivum
  Clone ID: PAT_TA_104765.pep
RKLQATARRPSFSSDLRRTPSSLCAESVTDCQSDCSDSWASALITELDQYKTETRSASLATTVDIAVMDDFLEMEKLASANGAVSRSNYAEDTGGQMEKARKMAAEKDKALHEAQRELRACRHRAMVAKERSVEMQRQLNLVNGERHAMEAEMQDAERKRNDLEGRLEMAHGEITSLLD

SEQ ID NO: 210348 - protein, 198 aa, Triticum aestivum
  Clone ID: PAT_TA_104766.pep
MKTFLILALLAIVATTTTTAVRVPVPQLQPQNPSQQQPQEQVPLVQQQQFLGQQQQHFAGQQQPFPPQQPYPQPQPFLPQLPYPQPQPFPPQQSYPQPQPQYPQPQQPISQQQAQLQQQQQQQQQQILQQILQQQLIPCRDVVLQQPNIAHASSQVSQQSYQLLQQLCCQQLWQTPEQSRCQAIHNVIHAIILHHQQQ

SEQ ID NO: 210349 - protein, 76 aa, Triticum aestivum
  Clone ID: PAT_TA_104767.pep
SPSSPLLSCALRLLSSSAPELLHGRSPVPPPLSRSRGGTGGRPWLPPLGRSGDAYGDGERDGWRDRTALAMLTRAV

SEQ ID NO: 210350 - protein, 160 aa, Triticum aestivum
  Clone ID: PAT_TA_104768.pep
RSSGGQTTLQSFLVKPRVADGEPNPYPPVAEDDEIPNSPPAPPKREIVRVTNKTIREKASAFSSVGSSAKRGADAGALDPAVFKRFNGSSPPAARAGGGAAAAEAGGDADDGDGGVRLDVEDIAAGGRRWESRKRKSPFGGNEGRTSSNAGHVVVLGDNP

SEQ ID NO: 210351 - protein, 92 aa, Triticum aestivum
  unsure (1)..(92): unsure at all Xaa locations
  Clone ID: PAT_TA_104769.pep
NFVKILLHGDEVAVHHVLEVLELFLILTTDAQTEFRTGILVRRKCSSATRLNSDRTQTTPLRPPPIYLRLXIWSLKRDLHSRSRLPPRTDWL

SEQ ID NO: 210352 - protein, 141 aa, Triticum aestivum
  Clone ID: PAT_TA_104770.pep
YQTLATGDVAASPTAGYKSLGSHAGVLDVCSIKDIGPASMGFPSLQDLHLYGGGHLDLQQQQPMESFFACSDGGGIGSLGKKRSNQYAGGKSPMMWGDDDDGDEDDKGDQLLQMAPPMMDDIDSMYEAKPMMTMSGDSAGN

SEQ ID NO: 210353 - protein, 157 aa, Triticum aestivum
  Clone ID: PAT_TA_104771.pep
MFCTRILLVIIRLFLSSTDKQNKGADADGLLIDDDSHGQVGDDTRCRLEIVGLPASKEYDMVSNQFVLQKVLMQIGGIQSRVHRLQERLSKARCKQAKLASFMDHDQVKVAEKRQRIQKRAFSPENDRYAKPQKKKKLNILLEQEDGPTLSVKPTLS

SEQ ID NO: 210354 - protein, 107 aa, Triticum aestivum
  unsure (1)..(107): unsure at all Xaa locations
  Clone ID: PAT_TA_104772.pep
GASGLPRPGAARPPWTPTPASPAAAPRPPPPAPSPXLPRGPQPAPPXPADSPAPPPAXPPSPSPPPLCSPPRHGWHRTSLTAETQPPVPTPSIWQRRWRLTGRPPRC

SEQ ID NO: 210355 - protein, 75 aa, Triticum aestivum
  Clone ID: PAT_TA_104773.pep
PLLHEAPVSHGKVTALLSCQTCTKNIPNRPLTSLNTLIGLILKVLVFIVFTKIKLIMQREFEDCHLKPKILLRIT

SEQ ID NO: 210356 - protein, 175 aa, Triticum aestivum
  Clone ID: PAT_TA_104774.pep
VTKCIQADPYDHIYHKLPRGYHFLERVPNCRHCNAKRFQYETPTFCCMNGKVKIVTPVVPDELRQLYMSQDPNAKYFQDHIRCFNSHFSFTSLGVILDRRFCNRRFGVYTFCAQGQIYHRIDQLVPKEDGPKHLQLYFYDTDADLQQRFLHSPNLDQTLIRKLVNILSSNPYAQI

SEQ ID NO: 210357 - protein, 200 aa, Triticum aestivum
  Clone ID: PAT_TA_104775.pep
MAMKDDVQFNDVLEVLKVYFFAPTYIDRRTENLFLVNAKQAIGVVIFYFVSIKLLKMYMADRKPYTLKTVSFIHNAFLVLLSTYMCIETFMANKACQEKSFLGSVWLPQIKVGAPFTPSCQRLVAILHIHYLSKVYEFIDTWIMILKKNDRQVTFLHTYHHATTFLCWYAGLVLYPGGSIYIVCALNSFVHIFMYLYYLV

SEQ ID NO: 210358 - protein, 116 aa, Triticum aestivum
  Clone ID: PAT_TA_104776.pep
REGKEREEESEQVRRQPRCSQIRRRCRPTLASECLCSACSAPTQWPAQDAALSPAPTLIPSPPLPSSCCSFWSRRCTNTSLLLWWTRSVPIWMSSNCFRWTRHEPSWVLLPPTPTP

SEQ ID NO: 210359 - protein, 146 aa, Triticum aestivum
  Clone ID: PAT_TA_104777.pep
MWRARRWPRPRWFSSDTAAVGADSGNPARRRVAALWGNGDHGRLGLGALESRWSPTACPFFLTRPADPPTSLACGGAHTLFLTEGGRVFATGLNDFGQLGIGSSMPHTLDPVEVSGFHEKVVQISTGNHHSCAVTADGELFVWGKN

SEQ ID NO: 210360 - protein, 41 aa, Triticum aestivum
  Clone ID: PAT_TA_104778.pep
TFGTHGISHMDLHGCDSLLNHFYAFNYSYHTTSLRFVFYRT

SEQ ID NO: 210361 - protein, 70 aa, Triticum aestivum
  Clone ID: PAT_TA_104779.pep
SGCFFRLYYHQIQAYSHVACSVKNGISECNICNTQCTASRVVFCRALLLYLIYSYLRKSINGFAAGAEIQ

SEQ ID NO: 210362 - protein, 131 aa, Triticum aestivum
  Clone ID: PAT_TA_104780.pep
SRLNSTNSSAAGWRILDTNQQPMGTEFYETMLIIKGARAETEDDLSQLFEDFGINGSQLAASFGPPTFVMDSNLTSDAAPVPSPLRVGPSAALTVDLIGTVCAIKDPAVMLHYIALKIVMDSTSSDFGTGG

SEQ ID NO: 210363 - protein, 102 aa, Triticum aestivum
  Clone ID: PAT_TA_104781.pep
EHRAMNASHHWKTSGMPWEARIKSQGLLLALSIPQDFRSGEKHPQRASNHPMESPLRLPKSEQMSNLSVWMRLHVETVLRIPCSHDHTDFPLNSSSSSTIQS

SEQ ID NO: 210364 - protein, 189 aa, Triticum aestivum
  Clone ID: PAT_TA_104782.pep
MPFAIDIAEELGIPALAFATQSACSYLALLSMPRLVELGESPFPTDDLVCGVPGMEGFLRRRDLPRGLYCAEQGDRDPWMLKLAEVTARSSKACALILNTTASMEQPALAHIASHTSDVFAVGPLHARSRLTASASLWQEDDGCMAWLDGHEDRSVVYVSLGSRAVITQEQFTEFLSGLVATGYAFLWA

SEQ ID NO: 210365 - protein, 67 aa, Triticum aestivum
  Clone ID: PAT_TA_104783.pep
QPIMQLVYTLYNANLLSCSMQICPLVSHITAHKTHRYNIMLWSIYLDSVLFPLVKSADLQILTVIAL

SEQ ID NO: 210366 - protein, 172 aa, Triticum aestivum
  Clone ID: PAT_TA_104784.pep
RHEVVSCLCLQQKRYSTTEDSRSDHRVAPYYSRRLSASVESSSCYGYDRSPKIVEMDTGRPKSRSSSLRTTSPGASEECYAHSVSSPLMPCRAPPRIAAPTARHFPEYEWCEKARPATAQSTPRYTSYAPVTPTKSVCGGYTYSNSPSTLNCPSYMSSTQSSVAKVRSQSAP

SEQ ID NO: 210367 - protein, 124 aa, Triticum aestivum
  Clone ID: PAT_TA_104785.pep
PCVSVGAESPLRPWGQGRWSSTGCAGRSSAGARMPLRQMPIARATDHAAEGGLPPLDADEAPCPWGPRVRPPSFFATRLSLIEETKVKRFKKSTRVPFLFSSRSVRWWISIYTLAVMGDNEFSV

SEQ ID NO: 210368 - protein, 127 aa, Triticum aestivum
  Clone ID: PAT_TA_104786.pep
KLQVLNGNYRIPEQPKYSTSVTGLIKYMLEASPNARPDITQVWFRVNELLPLELQKSLPDGASAAISMGLQDDGGYKRTHVTPKRNPPAPPREQSDNSSSHGSANAGDAPLCASWVTQHAQGSQVAD

SEQ ID NO: 210369 - protein, 122 aa, Triticum aestivum
  Clone ID: PAT_TA_104787.pep
MDDGVDLPSQFLFPHPEMPGAFSDLLGDAAATCTHTHTCNPPGPSAATHTHTCLHTHTHQLFAAGSEDDDAARPRRPLGNREAVRKYREKKKAHAAFLEEEVKQLRAANQQLQRRLQGHATL

SEQ ID NO: 210370 - protein, 37 aa, Triticum aestivum
  Clone ID: PAT_TA_104788.pep
NTPNIISQIQYKAPIVQITYTLQALHIISSNIYKLYT

SEQ ID NO: 210371 - protein, 168 aa, Triticum aestivum
  Clone ID: PAT_TA_104789.pep
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALAD

SEQ ID NO: 210372 - protein, 144 aa, Triticum aestivum
  Clone ID: PAT_TA_104790.pep
TCFLHITALRMNKMLSTDCLGRQEFHTFHKTTEILEDWQPQEIAFHETALGSTLVDHQNVHSTAAVSAVDIGMAEVSLLHGESDTSATGLLPVSFLSCSPRSMVPISVPSSSSLEAILTPNPMYSDVQLKEVMNYNATAMDEST

SEQ ID NO: 210373 - protein, 125 aa, Triticum aestivum
  Clone ID: PAT_TA_104791.pep
LAPLRHGLADAFRGADFFKTRRMHGLKHVDDSGWEFDYMLGDEIQIAHRKQRASYSPLRQALSLYPDRQVLKDNSFLEFHTLSYQEDQGLQHVVCIRHDRYWARASVALFSSNTMEWQIFPWVET

SEQ ID NO: 210374 - protein, 32 aa, Triticum aestivum
  Clone ID: PAT_TA_104792.pep
VLKKIRLARQTERCRKSAHQEMALIARLQHPY

SEQ ID NO: 210375 - protein, 65 aa, Triticum aestivum
  Clone ID: PAT_TA_104793.pep
FVCGGRECYSIRTDARHLRSMTTYPGLPGPAYPPPSAQRSEEDPAYPERGVDYESTCNGVIKLPS

SEQ ID NO: 210376 - protein, 176 aa, Triticum aestivum
  Clone ID: PAT_TA_104794.pep
MKTLFILTILAMATTIATANMQVDPSGQVQWPQQQPFRQPQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQQQQQQQQGMHILLPLSQQQQLGQGTLVQGQGIIQPQ

SEQ ID NO: 210377 - protein, 122 aa, Triticum aestivum
  Clone ID: PAT_TA_104795.pep
SAESPAAEAPPEARTKGRGLRRWRRIQREHRAEGAAAPATAAGGRGGANDDAAQLHKRRLPLGAAAPPKGKHEVAVEEAESSTASVESRFVPLEQAPAPAPAPAKLDPDLGLLVSSVGFSVG

SEQ ID NO: 210378 - protein, 62 aa, Triticum aestivum
  Clone ID: PAT_TA_104796.pep
PQPIERRSCCESTESAPFRNRRKTATANRSHLVRGRGTYHGRAERRWIGDDDGGEGEKCAPG

SEQ ID NO: 210379 - protein, 164 aa, Triticum aestivum
  Clone ID: PAT_TA_104797.pep
CGQSLLSLGIANCAWMTDASLRAVGSHCPNLEILSLESELVKNEGVISIAKGCRLLKNLKLQCIGAGDEALEAIGSCCSLLEILSLNNFERFTDRSLSSIAKGCKNLTDLVLNDCLLLTDRSLEFVARSCKKIARLKINGCQNMETAALEHIGRWCPGLLELSL

SEQ ID NO: 210380 - protein, 178 aa, Triticum aestivum
  Clone ID: PAT_TA_104798.pep
SVDARALAILEDASKLVGIHEPMAEIIKLLTQGASTDEKPKLVSIVGSAEMGKTTLANQVYQEFKEKFKCKAFISVSRNPDLMNIMRTIHSQVSGLHFDNTEAGSIQQVIMNINGHLADKRYFVVVDDIWNVEAWDIIKFAFPMTSSGSIIITTTRINEVAKSCCSSFSGNIYDIKPL

SEQ ID NO: 210381 - protein, 77 aa, Triticum aestivum
  unsure (1)..(77): unsure at all Xaa locations
  Clone ID: PAT_TA_104799.pep
PMSNLFSCLWFNEVNCFTSRDQLSFTYTCLKLTRMNAXKIFHLNMFKSGGGGAVRLETQAGDASGLGGEVDDTDKEQ

SEQ ID NO: 210382 - protein, 194 aa, Triticum aestivum
  Clone ID: PAT_TA_104800.pep
KQTDNSQRWIRFCNPELSAIISKWIGSDDWILNTDKLAGLKKFADDEDLQSEWRTAKRNNKMKVVSLIRDKTGYVVSPDAMFDVQVKRIHEYKRQLLNILGIVYRYKKMKEMSAKDRIKSFVPRVCIFGGKAFATYVQAKRIVKFITDVAATVNYDPDVGDLLKVVFVPDYNVSVAEKLIPASELSQHISTAGM

SEQ ID NO: 210383 - protein, 139 aa, Triticum aestivum
  Clone ID: PAT_TA_104801.pep
SEGLHNSKLRSRRRNKAPASDHDTENRQDHGGKDTVTVDNSEGIHNSKLRSSARNKTPSDHDNENRQNHDLNSKFALESNCGNGDLNSKFALESMKNNTDVLDKHGGIEGNGAGTLITLDPACFILSGHRHQRKDYRSI

SEQ ID NO: 210384 - protein, 146 aa, Triticum aestivum
  Clone ID: PAT_TA_104802.pep
MDASATVATGKGKKGAAGRKAGGPRKKSVSRSVKAGLQFPVSRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSPKEPKSPK

SEQ ID NO: 210385 - protein, 129 aa, Triticum aestivum
  Clone ID: PAT_TA_104803.pep
PPQTLPEVACPRCCCSPRAPHAGRKRQQRPKWWPRKPPAELGRRGWRGAGAARDRRQGDASLCIAAAAIAHPLRPPSAAPRHWPEDPCDDEGQRGEEEGGGRRRGGGEDAAEASGEKRGGARERMEGAG

SEQ ID NO: 210386 - protein, 122 aa, Triticum aestivum; identical to SEQ ID NO: 179533
  Clone ID: PAT_TA_104804.pep

SEQ ID NO: 210387 - protein, 121 aa, Triticum aestivum; identical to SEQ ID NO: 167940
  Clone ID: PAT_TA_104805.pep

SEQ ID NO: 210388 - protein, 114 aa, Triticum aestivum
  Clone ID: PAT_TA_104806.pep
MEKAQKRVAIVGAGASGLAACKHALERGLRPVVFESSGAIGGVWARALASTRLQTPRTLYEFSDFPWPPEVAEVFPDHAQAAAYLRSYAERFGVLDRVRFGCRVTGMEYAGVGE

SEQ ID NO: 210389 - protein, 153 aa, Triticum aestivum
  Clone ID: PAT_TA_104807.pep
MAVMGSGTWRKAYGALKDSTKVGLANFNSEYKDLDIAIVKATNHVECPPKERHFRRIMFANSANRPRADVAYSICTLARRLSKTKNWIVALKTLIVIHRLLREGDGSFKDDFLSYSYRGNILQLPNFRDDSSPLAWDSSAWVRLYAFYLHERV

SEQ ID NO: 210390 - protein, 112 aa, Triticum aestivum
  Clone ID: PAT_TA_104808.pep
RSLCFPPSRRATAVLRPAPPCSGPPRRAPSQPAGPTTASTASCMVWHASCTAWHFLQRHPRVTGARDEALLLHRPQAPTDPTSHATLHTATHESGCCGSMTAMSCHCRFGTG

SEQ ID NO: 210391 - protein, 162 aa, Triticum aestivum
  Clone ID: PAT_TA_104809.pep
HSLNETEVTTVICGRKELKKLIDIGWQLDTVKRVIYINEEGISAEVSIAQNSTSWSVKSFEEVGKLGAEAPVDANMPLPSDVAVIMYTSGSTGLPKGVMMTHRNVLATLSAVMTIVPELGKKDIYMAYLPLAHILELAAETLMAAVGASIGYGSALTLTDTS

SEQ ID NO: 210392 - protein, 90 aa, Triticum aestivum
  Clone ID: PAT_TA_104810.pep
TGRGARRGRERSEEEIMSDRREGASQSSEMCGCPCKLPRVRVSLSRLAWPACEATPATYCRRAELLGPRRPETGTGGGAARSGGRRGGGA

SEQ ID NO: 210393 - protein, 199 aa, Triticum aestivum
  unsure (1)..(199): unsure at all Xaa locations
  Clone ID: PAT_TA_104811.pep
TQHHAVPRRSTRPPPSTLTQPAPPPRALAPHTLTXPPRPRLPPPVLPQQQRERPARPRQQAPPLPSPPRPPPALPQPRPPWSLSRPRRAPRPPVRPQLLARAPSSPLPQLLPAPPPWSPQPRRGQVPRLRPPPARGLPPSSRPPRRRPASPPRAPPPSARPMGSGHQRWPLPSWMQENDRSGRGWLAEASATLIRECEA

SEQ ID NO: 210394 - protein, 149 aa, Triticum aestivum
  unsure (1)..(149): unsure at all Xaa locations
  Clone ID: PAT_TA_104812.pep
PIGHCPTAAVAPPTELEPSTAGSRRPFLKSPSFPSSSWLSLISLSLAALTRAAVGGGHHQDFPAAPHTLSSLPLPSXMSLSQVQSHRIDGETSPELAISLGTGEERRRDELGIEAPPLDLLMRLVDRIHAVAGTGSDPCRPSSTGSGRR

SEQ ID NO: 210395 - protein, 140 aa, Triticum aestivum
  Clone ID: PAT_TA_104813.pep
PLHGHDAVSARSAGFGPFRWSPRPPVGAWDATPAPAPCGGGGAPPMMSPFFRSPPQPLPALAGAGEFAPVRPTIGFPGMPSPTVLGVNPHASWLPTAAAGIQHTPDFRCALTSEIATVLLLTVSAQFFQESKVQSGAMSH

SEQ ID NO: 210396 - protein, 49 aa, Triticum aestivum
  Clone ID: PAT_TA_104814.pep
TLVDDIHYLADSERLISAGETDFAKDAAFGSTSSNLKQWVEEKTNGRIF

SEQ ID NO: 210397 - protein, 131 aa, Triticum aestivum
  Clone ID: PAT_TA_104815.pep
KPQIWFGLGSDSALRVVSTLEAPPGEGCAQVRAAKVGALGGSGSSVTAVSVGFRMAEGVAVSLMSGVLWRRHVWPLPAMRRLDPMVGDRVPLPAVPTPSGCETLVLLFYGSLQCSSATYWFYLMSLLPFLR

SEQ ID NO: 210398 - protein, 135 aa, Triticum aestivum
  Clone ID: PAT_TA_104816.pep
HLRRRRVRRIRLPRRDLLRHRREHRCPRRRGLHLHVPHVLMVGRWPCRRRQPSRIQLSIVVLHHLRGHHGLHITHGLSYKRRNKHGHNWTLEHHQCVSQCPNNQHRSFGNEWPIDGSKCFQILTVQLILSGTRTC

SEQ ID NO: 210399 - protein, 112 aa, Triticum aestivum
  Clone ID: PAT_TA_104817.pep
SRFQNDTLLATVLGRRPAMSAEAMVQSLARLCGVERRHVRVEVTHPVDFFITFASTVDCERVLTSSGQFRCAGASVAFRRWHRSSQASSGKLKFFCKIGIEGLPANAQPAHQ

SEQ ID NO: 210400 - protein, 155 aa, Triticum aestivum
  Clone ID: PAT_TA_104818.pep
IIQLHALLGNRWSAIATHLSRRTDNEIKNYWNTHLKKRLAKMGIDPVTHKAASGAPVGTADDVRSAKAAASLSHMAQWESARLEAEGRLARESTMRTAASTPTSITLHPINLPEPTTSPCLGMLQPWQGAKLDLESPTSTLTFIGNNNSVSLGIS

SEQ ID NO: 210401 - protein, 57 aa, Triticum aestivum
  Clone ID: PAT_TA_104819.pep
WCAPATPHEHQPLDTYCRHRIQPERSILGNLQNTPQMRTELVYFPCHLPPSRATVPK

SEQ ID NO: 210402 - protein, 88 aa, Triticum aestivum
  Clone ID: PAT_TA_104820.pep
PRVAICVLHPTDYRDSLRDLREYMCQGCFPWRNQANLQVGQQATPIYQDPSVAGLMNGPHVDYDNNPAPNSGRNILGAIQVDQMAMQH

SEQ ID NO: 210403 - protein, 157 aa, Triticum aestivum; identical to SEQ ID NO: 182729
  Clone ID: PAT_TA_104821.pep

SEQ ID NO: 210404 - protein, 82 aa, Triticum aestivum
  Clone ID: PAT_TA_104822.pep
PQLVEGLEESIGRGKGSTRLYATIDLGRARVGRTRVLAGDPVNPRWYEDFHIYCAHFSAHVVFTVKAAQPIGATLLGRAYLP

SEQ ID NO: 210405 - protein, 44 aa, Triticum aestivum
  Clone ID: PAT_TA_104823.pep
NSPQLRRESICIRKKIRKERLPHMYTFAAEPHHQFIKKDFLREN

SEQ ID NO: 210406 - protein, 134 aa, Triticum aestivum
  Clone ID: PAT_TA_104824.pep
PPSASASASISTPILSSPLPLLLLYGTFMRAPRPDPAHRRSSTSAADGAHAAHPCRPMPAATGGQPAGERVGKMQKTMQKRRAMDIGCFNKKQIASQTKLMQRPVHPVITFEDGFGKLAKSCGNSSSELTEQIE

SEQ ID NO: 210407 - protein, 84 aa, Triticum aestivum
  Clone ID: PAT_TA_104825.pep
TSTTRYATSVSIQPSKPHALLVFFIHPSMEIIDAELRLGPPGSGGGGDAQKKRSSSTVALAATSEASGTDDHDAAPASKVQVVG

SEQ ID NO: 210408 - protein, 103 aa, Triticum aestivum
  Clone ID: PAT_TA_104826.pep
VRTRLAHGDARLNRRGRWRGLVVHWLVHVAAFRGARQQASLYPAGLAGLPAGRNTREFLLLFTGEAVPQGFGAQGHGGCGARRRRSGEDRCDAVVAGHLATFK

SEQ ID NO: 210409 - protein, 79 aa, Triticum aestivum
  Clone ID: PAT_TA_104827.pep
PPPRRRRCRHRRSWPQSQSRRRRRRNRTPLPSREAASSRPSRRLPGYRWPWPRSPNDTETTYERACDSFIYFSFFIASW

SEQ ID NO: 210410 - protein, 66 aa, Triticum aestivum
  Clone ID: PAT_TA_104828.pep
PTSPTPSSERRGTPGAGRPRHCLRNPSPSSPELRLPPWSAMAAARRTKTRAVQLRVRHFQCKYALP

SEQ ID NO: 210411 - protein, 81 aa, Triticum aestivum
  Clone ID: PAT_TA_104829.pep
VERRNGGVSPSALIGGVDLATAQQGGLDSMVGVSSLGGDRAATAAGSGGHGGFVTSPSTRWPSDNRGGHRTVEPSAGNRQH

SEQ ID NO: 210412 - protein, 51 aa, Triticum aestivum
  Clone ID: PAT_TA_104830.pep
PLHLHIHSLANCNGDVFLVHLRRGALIGERGKTAEWRLLGWGVLFLSVRAP

SEQ ID NO: 210413 - protein, 72 aa, Triticum aestivum
  Clone ID: PAT_TA_104831.pep
AAEITEKVRLMAEERHVSFKMYKRRGVKDLEEKPKSKRRKGQKRSRGRQTVQGQSREHADLSDSADDEEFPS

SEQ ID NO: 210414 - protein, 122 aa, Triticum aestivum
  Clone ID: PAT_TA_104832.pep
RNYLFRRTRDNCQTLSQDDPSLLLTGPSRAIVYLAPITFEVQLKVKGKGESEDEMLAFGAFYYDDGSACERKLSIRYDHKRCMLEYEVALRPRSVEATISLKVVVGSWPENHRGIVVAITSG

SEQ ID NO: 210415 - protein, 83 aa, Triticum aestivum
  Clone ID: PAT_TA_104833.pep
GWRRDGVMLRCTEAVGPPHVAGVALLQLQGVRVAEAEARQATAGGEDAVAPAVLAVPAVVRSLAGPAPLGLGFSGGEVLPNEG

SEQ ID NO: 210416 - protein, 110 aa, Triticum aestivum
  Clone ID: PAT_TA_104834.pep
AAAPHPRPPALVPPPILPPSPISPLVRDAHCAVAHPFASGRHRPCHSSARPEMQTPSPPPRPRTPALVPPPSSPPWRELSARRGRTLHREDIGEGIAPAVPPRDRRCRCR

SEQ ID NO: 210417 - protein, 109 aa, Triticum aestivum
  Clone ID: PAT_TA_104835.pep
MDKKGKHEQQNSRSCCCECHAMVRLLRAVDNGWYIAEHWSSHNHSMSLTCREKVHWPSLKHIDVYTKDLVKHLRANNVNLSKVYSIVGSFFGSSHSVSFTKRSLRNLCG

SEQ ID NO: 210418 - protein, 28 aa, Triticum aestivum
  Clone ID: PAT_TA_104836.pep
GENGNAAHGDHLGPKPMGCYRARIILLG

SEQ ID NO: 210419 - protein, 170 aa, Triticum aestivum
  Clone ID: PAT_TA_104837.pep
CAHPEKQLFDWGMMRIRYPFTMYGIGDGFSMDTDDIHRKKRFTERISKLEEEEKNQAETRKRRFFTEILNAAREYQVQTSATYKRRKQRNDGVQAWHVRARQRINRLEKSRLQVLKAGDQEAYMRMVEESKNERLTMLLDKTNELLEGIGKAVQRQKDAEHVSRPEGSED

SEQ ID NO: 210420 - protein, 80 aa, Triticum aestivum
  Clone ID: PAT_TA_104838.pep
GEEEPLERRGRSPPPAGGTRSAGEEPLKRRRGRSVWIGGCFSLSLSPLLPVGANMIPVSRLKQLPCLPGKLRRPKWTKAT

SEQ ID NO: 210421 - protein, 125 aa, Triticum aestivum
  unsure (1)..(125): unsure at all Xaa locations
  Clone ID: PAT_TA_104839.pep
MAPSSASTVEITSESVFDSEVVPSSIVEIAPYLRVANEVEASNPRVAYLCRWXAFRMANNLDPTASGRDVHEFKTALLQKLEMETLKQSDTREMWSFYQHYYKTYIMALVNAGDTGDRAQLTKAY

SEQ ID NO: 210422 - protein, 62 aa, Triticum aestivum
  Clone ID: PAT_TA_104840.pep
MAKCSKIRDIVWLQQTLRRWRSRAAARVAAEGGVTAPAGHVAVCVGGASRQFLVRAAHLNHP

SEQ ID NO: 210423 - protein, 63 aa, Triticum aestivum
  Clone ID: PAT_TA_104841.pep
HASTNACVSLAMPSPTAPKSSSVRRTRASAAPEKHRTAAPTTATSPRSTDAAGVLAPGTIPAP

SEQ ID NO: 210424 - protein, 100 aa, Triticum aestivum
  Clone ID: PAT_TA_104842.pep
GIAADDSSVVLCFDSLCIVGIAKPGDERWTMVRYKISVHTAPLMFAGRFYCTTENGVLLLETSEDEPPRMEVAARLRKPISAMLNDSAHLVNNDGETDAG

SEQ ID NO: 210425 - protein, 187 aa, Triticum aestivum
  unsure (1)..(187): unsure at all Xaa locations
  Clone ID: PAT_TA_104843.pep
LELVALISEIKHPNTLELVGYCAEYGQRLLVYNHFSRKTLDDALHDREEIDIELSWNARLQVALSSGKALEYLHESFQPPIVHQNFEPANVLLDDKLSVCVAECGLXELMPSSSVTQLSGRLRTLLNYDAPEFQESGIISERGDVYSFGVVMLELLTGRKPYDSSRPRHEQHLVRWAGCQLHDIESL

SEQ ID NO: 210426 - protein, 90 aa, Triticum aestivum
  Clone ID: PAT_TA_104844.pep
LLHGIVHLNGYGHLVALHGFKGGSDFVSGHQIMDLWDRICSTLHVRTVSLVDTARKGHMVLRLLHGVAYGDTWFGRWGYRYGRPSYGVTL

SEQ ID NO: 210427 - protein, 46 aa, Triticum aestivum
  Clone ID: PAT_TA_104845.pep
MADELDELIDFLSNGSPQVRGAAADIVRGLTGDSDGLRSLTARANR

SEQ ID NO: 210428 - protein, 100 aa, Triticum aestivum
  unsure (1)..(100): unsure at all Xaa locations
  Clone ID: PAT_TA_104846.pep
GFKTMQDLLCSCEGTHKKFNSRSSRTNCPVMVRLLXTEDDGWYYGEVVLEHNHELAASAGERKLWKCHKYVHSSMKDIVRHLRTNNVALTEVYGVMADIH

SEQ ID NO: 210429 - protein, 63 aa, Triticum aestivum
  Clone ID: PAT_TA_104847.pep
VFLLHLHRHHIGRAAACSHGDGGTGGLRPHPRRHARRRGRGRLRRPTKRPPLGDPHRDTGVSG

SEQ ID NO: 210430 - protein, 39 aa, Triticum aestivum
  unsure (1)..(39): unsure at all Xaa locations
  Clone ID: PAT_TA_104848.pep
GTTRRRPAGSRRPTCRRTXHRRGRSTHRTPGSGPTPHRA

SEQ ID NO: 210431 - protein, 57 aa, Triticum aestivum
  Clone ID: PAT_TA_104849.pep
SNFVSVEGRGQLFRTLIKRLRAHFIIFVFLTLNNELTDDRSRKKYLAKYHLTRYCTL

SEQ ID NO: 210432 - protein, 193 aa, Triticum aestivum
  Clone ID: PAT_TA_104850.pep
SPLFSKYKVIHFNKTDARLANNGISTELQLVRCRVNFHALKFTPQIEALGNKLVQKLRDKGSCVALHLRYEMDMLAFSGCNHGLNPEEAEELKRMRYAYPWWRDKEIDSKTKRSEGLCPLTPEETSLVLKALGFEKDTLIYIAAGEIYGGEKRLKPLRAAFPKLVRKEMLLDSEPLRQFQNHSSQMAALNFIV

SEQ ID NO: 210433 - protein, 133 aa, Triticum aestivum
  Clone ID: PAT_TA_104851.pep
TSHGGQRQQALGAEAALGRTPMSSQAEDQSRQCRSRGGGAGGACGNGEGRHGRRRALASAPHEGSADKGGGETDAEKDFDEEVVIVEHLGYGDCCGRQWLRLASHFFIGFLVERDQGRRNCLFTRWILHTSSP

SEQ ID NO: 210434 - protein, 60 aa, Triticum aestivum
  Clone ID: PAT_TA_104852.pep
GLSSPSIRGERRREERGGHPGETEPYRPRGPSIDRQSPPAMAGAAPDRAALTVGPGMDMP

SEQ ID NO: 210435 - protein, 88 aa, Triticum aestivum
  Clone ID: PAT_TA_104853.pep
RVRPPVPASALQASGCVLVQELVTTRDEGRTRCHHRPFAAAAELRSRHGYAGGGRGRCSALHRRARNVGLHGVCPSGTNRQGDVRLDV

SEQ ID NO: 210436 - protein, 38 aa, Triticum aestivum
  Clone ID: PAT_TA_104854.pep
IIYYLLGASIDTHTETIKYKGSDHKVVQANMTPKMTYH

SEQ ID NO: 210437 - protein, 55 aa, Triticum aestivum
  Clone ID: PAT_TA_104855.pep
RRPLASPPRAPPPSARPMGSGRQRWPLPWLMQEDARRGRGWLAEASATVIDRDCG

SEQ ID NO: 210438 - protein, 97 aa, Triticum aestivum
  Clone ID: PAT_TA_104856.pep
DQRALVSASVDRRYGRAGGVSRRSGPATGETRVWCAEARRSASSVSLFTSRVRAPPCMLARRVHSPPVEGTGAGARRMADWQGETPPAPGRSVVRRR

SEQ ID NO: 210439 - protein, 48 aa, Triticum aestivum
  Clone ID: PAT_TA_104857.pep
MDQVLNKVGSYWFSKRASKEIDSIGDDLNSVSYNIGGGAKWMVNNIKG

SEQ ID NO: 210440 - protein, 62 aa, Triticum aestivum
  Clone ID: PAT_TA_104858.pep
GDQQPLLSLYDSRGRRSDAGWLAIGCVRERENLAQFGDDAAFLAPCACVEKERRGGIGWRLA

SEQ ID NO: 210441 - protein, 77 aa, Triticum aestivum
  Clone ID: PAT_TA_104859.pep
RRWRELQSNGKVRGSAGHLPGERMGTRTWGTALSRRWQQGEPARHASAYRQTFKKTWPWAGLASGDCSQHWPRVTRC

SEQ ID NO: 210442 - protein, 127 aa, Triticum aestivum
  Clone ID: PAT_TA_104860.pep
FRLLAHSLQSRLRQGFLILSYPPLPRSHFTSPSSSTSRLDLDRQGGLYSHRLSPSAMSDYGSTQFPPCCRLWGERETIRQQQCPWFYDRSPFSTATNYAFFVRTIRSMCAYDDIYEPTEPSCLIRCP

SEQ ID NO: 210443 - protein, 147 aa, Triticum aestivum
  Clone ID: PAT_TA_104861.pep
IDPSSRSRPGSHRRRRQAGTEFQQFLTDCPAPPQPLSHRHATASSSPFPGGSSPAELVTSQAGAAAAAPRYLMEPDLTLDEVAEQNRSAPDEEDEDAFVVEEIGDSSDDRQAEPTVALEPKKGMMFSSEDDAVRFYKAYARKKGFGV

SEQ ID NO: 210444 - protein, 83 aa, Triticum aestivum
  Clone ID: PAT_TA_104862.pep
LPLVIIDNMGDELPFEVLWAAGPARSPAGTHEEAGTTGAPQPEDVVCGVYHQTSRSWSRTAVVINVVTALGTPSMSLVEYKDY

SEQ ID NO: 210445 - protein, 192 aa, Triticum aestivum
  unsure (1)..(192): unsure at all Xaa locations
  Clone ID: PAT_TA_104863.pep
PLHTILVFDSRQXALPVAWVITRSVTKHDTSRWMKALTSRIHSVDSNWRIGGFIIDDPTSELDPIXNVFSCPIFFSLWHIRRTWLKNIIKKCSNTEVQREIFTQLGKFMYSIWSEKNPMDVLEQLFQDFVDQTTFIQYFKSFWVPKLEMWIDSIRNLPLASQESCGAIEGYHLKLKLKAYDDSQLDALQRVD

SEQ ID NO: 210446 - protein, 93 aa, Triticum aestivum
  Clone ID: PAT_TA_104864.pep
MSSWLRSAVSRAVEAGGRSGVARAVIGYADAVAHHAGQAVSDILLDRGGTQSFKSFKKTVMRLEEAAVSCRGGERIELLRRWLGALQDVEAAL

SEQ ID NO: 210447 - protein, 76 aa, Triticum aestivum
  Clone ID: PAT_TA_104865.pep
YMHAGLWKARGTTQSPRWLVSDAFALMVRHRLSRWRGFAWTYTYLYVAQIVRVKFLLTRTVYSYARSLIFESLFAP

SEQ ID NO: 210448 - protein, 128 aa, Triticum aestivum
  unsure (1)..(128): unsure at all Xaa locations
  Clone ID: PAT_TA_104866.pep
GNIRVFCRVRPLLSNESGAVSYPNNGENIXRGVELIHNTQSYSFAFDKVFDHSASQEYVFTEISQLGQSALDGYKVCIFAYGQTGSGKTHTMMGNPEFNDQKGLIPXSLEQIFQTSQCLMSQGWKYKM

SEQ ID NO: 210449 - protein, 140 aa, Triticum aestivum
  unsure (1)..(140): unsure at all Xaa locations
  Clone ID: PAT_TA_104867.pep
RDRGKNRKPMQRGRYLSTEAIQAVQSLKRATLSGAPAGSAVATDPKLRRLLKADMVAVFRELAAQGEGHLALKVFDEIRKEHWYKPRLFWYVDLITVLARKGLRSEVGKXCSYLKREQLEPDTDGFNLLLKTLLHAEFTQ

SEQ ID NO: 210450 - protein, 92 aa, Triticum aestivum
  unsure (1)..(92): unsure at all Xaa locations
  Clone ID: PAT_TA_104868.pep
WAAARTRGAEQLEPVIIVRWGRTTMELLNQLDGFYKLSKIFGRLKVESNSELEVALVQWWLRSGPIXEKSSSFLVCMAMICFFRIRSLPKLA

SEQ ID NO: 210451 - protein, 80 aa, Triticum aestivum
  unsure (1)..(80): unsure at all Xaa locations
  Clone ID: PAT_TA_104869.pep
SPSLSAQAFAAVSGTKRSSGSALGTAGVGRAGPWVRPTHEVEGNRPALPVRCALHVFGEMPXRAQLRLGGDEVMPSSSWG

SEQ ID NO: 210452 - protein, 87 aa, Triticum aestivum
  Clone ID: PAT_TA_104870.pep
NQRSSRPPAPVVARASAATPYLAGIRHIRRRRGQRAPDPSPGWREKQDRHRWRNTVFIPCPDAKGDCVKNMEAFRKRAGKFKEQVAE

SEQ ID NO: 210453 - protein, 108 aa, Triticum aestivum
  unsure (1)..(108): unsure at all Xaa locations
  Clone ID: PAT_TA_104871.pep
ISFRHPCKPLLIATYNPEEGSVREHLLDRIAINLSADLPLSFDDRVAAVNIATQFQESSKDVFKMVEEETEVXKTQIILAREYLKDVAISTEQLKYLVMEAIRGGCQG

SEQ ID NO: 210454 - protein, 88 aa, Triticum aestivum
  Clone ID: PAT_TA_104872.pep
ISLTLQSHDFTLLKPLRREFYTTPQTNLSNKLCTVKSKSSNQNPELIDLGPFLPKVIPCAIGMAPHLPCDTSTKLPPTHQYPYTYPHF

SEQ ID NO: 210455 - protein, 68 aa, Triticum aestivum
  Clone ID: PAT_TA_104873.pep
VRHRRWLWHSVEQHTSIQDWKTSHHLVLRCRPGNLVRTSDGSGAARRALGRFLPLSIRPALRLLVVVR

SEQ ID NO: 210456 - protein, 61 aa, Triticum aestivum
  Clone ID: PAT_TA_104874.pep
MPIYEGYALPHAILRLDLAGRDLTDSLMKILTERGYSFTTSAEREIVRDIKEKLAYVALDY

SEQ ID NO: 210457 - protein, 92 aa, Triticum aestivum
  Clone ID: PAT_TA_104875.pep
PAASHHHPPPHMESTAPPSRPRINLALYTNCWRQLSQRRSSSTSSCLTQLSCGFSLYLLLSRTQENTHTWTKKEHKCFAIGSSPWRTHRLHI

SEQ ID NO: 210458 - protein, 96 aa, Triticum aestivum
  Clone ID: PAT_TA_104876.pep
PQVLTSAAAMLRFDPANSCMKQEQTHHVQSHQNTHQLSDYGETENRVGSMLHPCSSESGGEQKHCPEMLACLITQYEIMIQKTSGPKMHPEVLNKN

SEQ ID NO: 210459 - protein, 90 aa, Triticum aestivum
  Clone ID: PAT_TA_104877.pep
VSVQTEQGRESKRPHQTDDMWRGSLLLLLLLAAAAAVEPASTLMGASHEDRGHAMVLPETGPPVQRWATGVSFNSYYLCICICILALHLG

SEQ ID NO: 210460 - protein, 82 aa, Triticum aestivum
  unsure (1)..(82): unsure at all Xaa locations
  Clone ID: PAT_TA_104878.pep
LPGLQIYKRTSLVNLIILRRMELKHTITIQHNHKKIXCGSLNTTTQPHDGRIMFPIVHKKYLSLCGSTSVASTKSRFIVDAA

SEQ ID NO: 210461 - protein, 143 aa, Triticum aestivum
  Clone ID: PAT_TA_104879.pep
MAAAHFTLNTGARVPSVGLGTYKAAPGVIADVLGAAVKAGYRHIDCAPLYHNEKEIGVALKKLFDDGVVRREDLFITSKIWCSDLAPKDVPLAIDSTLKDLQLDYVDLYLIHWPFQVKKGTEISPDIFVHPDIPKTWQAMEQL

SEQ ID NO: 210462 - protein, 106 aa, Triticum aestivum
  Clone ID: PAT_TA_104880.pep
SRRVDFFFFFFFFRGKPSENLDYKPHKGDTRMTWPQTPNSRPKHRGQGSSHFANELHKESCKPRTILVQRNIRRAPPAKNRPRGVIVAAVAPPPQLRLLCYSQKSA

SEQ ID NO: 210463 - protein, 90 aa, Triticum aestivum
  Clone ID: PAT_TA_104881.pep
MAAVQVASALSVPLLSALLGGAVALVFLAGYLRRKRADIAHLPPSAAAAAPDLPKQVRPAGQNKKGGGHARVHHHHASAADKEAAKKPGP

SEQ ID NO: 210464 - protein, 168 aa, Triticum aestivum
  Clone ID: PAT_TA_104882.pep
QLRSWKIEIIVEGLEFVLAPSVASEAPPVDTECSVSGGNTDTEVRSAETKRNEPDSNPCSTSASRDVDDGVKRIANAIKQFLTRFNIKLKNTYVVFDPQSILDKRALEFNRSLVFRTKEIQCGTNLSTDGPVKLNNLVTFQEAVIEFLKMDDVDANLQNDLDRGRRGR

SEQ ID NO: 210465 - protein, 123 aa, Triticum aestivum
  unsure (1)..(123): unsure at all Xaa locations
  Clone ID: PAT_TA_104883.pep
CSSLHTRHEQQPGPWALLVEQRSSHGVPSIEKITFLLVRYQTIHVLQIRDSSSLVEVRRIGAFCXEDDELCLHSHGQAAQWSSFLPGIKQRLLSFIFHRTWNEEPEQALLTYLAILHAVDAAA

SEQ ID NO: 210466 - protein, 201 aa, Triticum aestivum
  Clone ID: PAT_TA_104884.pep
ELRRQYDEFKKNPDVSGWLEDAALFAAIDNSINAVSWSEWPEPLKDRHPGALKDIYENQKDFIENFMAQQFLFEKQWKRVRSHAQKLGISIMGDMPIYVGYHSADVWANRKSFLLDNNGFPTFVSGVPPDAFSKTGQLWNSPLYDWKSMEADGFAWWVKRIKRALDLYDEFRIDHFRGLAGFWAVPSGSEVAMFGSCRRGR

SEQ ID NO: 210467 - protein, 88 aa, Triticum aestivum
  Clone ID: PAT_TA_104885.pep
PFPWSPLLSTGCAAGRPRVRARWPSFTLDAISSKQGLSAQIETALVMNCPRAQKRRWSWTQIETALVRNYPRQLDLGDRHRTMENQTI

SEQ ID NO: 210468 - protein, 162 aa, Triticum aestivum
  unsure (1)..(162): unsure at all Xaa locations
  Clone ID: PAT_TA_104886.pep
GRVDLGLPDLKWLDMALRSRWLWLKHPGASNPWKEFNLQVTQESRVLFEGRSVVGNGEATLFWLDRWLDGDRLQYESPNLXASVQPRLKTNHTVAETNVRGLWIEDVGSDLSPEALQEFISVWTRLLFFEPTAGIRDMPCWSWKKKGIFSTRRLVDAAANSD

SEQ ID NO: 210469 - protein, 59 aa, Triticum aestivum
  Clone ID: PAT_TA_104887.pep
WVFFGPHIHHQILLNNITLIKYFQPPDAMNEAYLQSEDSCSIYLDQVLSLAVCLEVIVR

SEQ ID NO: 210470 - protein, 115 aa, Triticum aestivum
  Clone ID: PAT_TA_104888.pep
AASTSSVAVLDTAAGVWCDTKSVVTTPRTGRYSADAAGGEASGELTRRCRHAAAAVGDMIFIYGGLRGGVLLDDLLAAEDLAAAETTSAANHAAAAAANMQAGGTPGRFACRRGR

SEQ ID NO: 210471 - protein, 172 aa, Triticum aestivum
  Clone ID: PAT_TA_104889.pep
MVRGSLGRLASRTLSVAGKWQHQQLRRLNIHEYQGAVVGSVQEVKEVLKNVFPSEKEIVVKSQILAGGRGLGTFKSGLKGGVHIVKAEEAESLAAKMLNQVLVTKQTGPQGKVVGKVYLCEKMSLVNEMYFAITLDRKTAGPLIIACAEGGTSIEDLAEKFPDKIVKVPVDV

SEQ ID NO: 210472 - protein, 85 aa, Triticum aestivum
  Clone ID: PAT_TA_104890.pep
CHLLSQNAFPRKTKSEASKVLVSRAPVRSASPTPSSLEPRRSYFFRFFLCCLASLLLASALAKNSAHSSVRTNTGSSSSSSAHPS

SEQ ID NO: 210473 - protein, 106 aa, Triticum aestivum
  Clone ID: PAT_TA_104891.pep
AAASTDDKEGSITSVQAIYVPADDLTDPAPATTFAHLDATTVLSRQISELGHGYTTSGKWRFGGLFAFQEPSQRYCHLEGPQELHPVGCLLLALLYWQRRTRLLLA

SEQ ID NO: 210474 - protein, 120 aa, Triticum aestivum
  Clone ID: PAT_TA_104892.pep
HLPLAANNERSTTSHPAILRTATHSNTTTTRKNLPKTETPRRVLIDAEHLQRKLEGSGQGHDKHWRSANRKLSLLARGSQQKNDVIDAAIVPLQRTKGFARRQLPTPSTRKMATHSTSPP

SEQ ID NO: 210475 - protein, 64 aa, Triticum aestivum
  Clone ID: PAT_TA_104893.pep
SEVKTIGEADTVEADGFTKSLRGCNRAYVPCEQLQRTPTLLPDDFMNLLYHIVFRSVAFRPNTL

SEQ ID NO: 210476 - protein, 74 aa, Triticum aestivum
  Clone ID: PAT_TA_104894.pep
YEAVWGLEEEAYIHEDVIGELADGGHGGEVELHELHEPEQHQPLVLIIVPNQHQPDRLISHKKPNHSKYCRAEA

SEQ ID NO: 210477 - protein, 215 aa, Triticum aestivum
  Clone ID: PAT_TA_104895.pep
LERWLGNLLARQFEGRHSKGVAKTVTKQRVESHFDLELRAAVMHDVLDAMPEGIKQNKARTILQHLSEAWRCWKANIPWKVPGLPVPIENMILRYVKSKADWWTNVAHYNRERIRRGATVDKTVCRKNLGRLTRLWLKAEQERQHNYLKDGPYVTPEEAVAIYTTTVHWLESRKFSPIPFPPLSYKHDTKLLILALERLKESYSVAVRLKSTRPR

SEQ ID NO: 210478 - protein, 93 aa, Triticum aestivum
  Clone ID: PAT_TA_104896.pep
VVGGSRGNPRRDGSWEGMRRSRRLRAAGRATRVPAAKMGLNRTVTTSLVFRRGLLYQSEPTQKLFKLEQHSLFLLGKDNCFIRSKLIKAIDFP

SEQ ID NO: 210479 - protein, 78 aa, Triticum aestivum
  Clone ID: PAT_TA_104897.pep
SHDPSSPPAAGVSRRREQQTIAILPLSRFNYCGGADYTAGAGLATSRRQLKKLWEGRLWRGVRAHMNRSTRPRSTRPR

SEQ ID NO: 210480 - protein, 189 aa, Triticum aestivum
  unsure (1)..(189): unsure at all Xaa locations
  Clone ID: PAT_TA_104898.pep
CNCVQGFSQKVQSDWDLQDYSGGCKRNTPLQCQTNSTSAQAPSDKFHVMEDVRLPDNAQDAVATSSQECEVVCLNSCFCTAYTYNYTGCFVWHGDLITLQDQYRGIGGGTLLLRLAASELPDQQRKKTTIIGSVVGGLAAVLIILAVVLFFISQKFRRXTLRISGNAGGALTDFKYSDLLNDIQVDAAA

SEQ ID NO: 210481 - protein, 93 aa, Triticum aestivum
  Clone ID: PAT_TA_104899.pep
SVPSVVHESASCWLVVAFPFINQERKLGARRRSDTVLVSTINDADQGSADVAYRTPPAPYEKSKSLGSGGSMVARLKLKGIDGRAPPGVEPAA

SEQ ID NO: 210482 - protein, 111 aa, Triticum aestivum
  Clone ID: PAT_TA_104900.pep
GTVIHVPVRPFVCFVSPPMSSSFVRSYRFNNLRLAHGQLDQKSWFPYSLLFPSVPIRSDGRWCGCIARPHKWGSKITVTGCVRPRMSSWSPYYYIPDPRLSSWSPAVDAAA

SEQ ID NO: 210483 - protein, 97 aa, Triticum aestivum
  Clone ID: PAT_TA_104901.pep
PTGSLKTMAEFMGCGFSKEEVARGVVDEIVDLCSLEKLKNMEANRDGRRNALGIRSDSFFRKGVAGDWSSHMSPEMGKMLDEAVEEALQGSGFSFSG

SEQ ID NO: 210484 - protein, 98 aa, Triticum aestivum
  Clone ID: PAT_TA_104902.pep
FFSLIGLVMLYFRKHPKFYHFASIQFDEATKHRIIQPKVVKSLPLYKRKTYVGIDPWLVGKDTLIVISIRPTATVKDLPNQPGGKKSSYSHTCSRRGA

SEQ ID NO: 210485 - protein, 74 aa, Triticum aestivum
  Clone ID: PAT_TA_104903.pep
NSSIRRYISSQNKWINRSCTNFPTEEMYMCMLLSLGIIFRRRLYKIFNIFLKSTTTWLVITTSKILPQSILAFK

SEQ ID NO: 210486 - protein, 39 aa, Triticum aestivum
  Clone ID: PAT_TA_104904.pep
SDHIISCHPTNQRIVILLAVKNNELLIPTTNLYRDTEII

SEQ ID NO: 210487 - protein, 88 aa, Triticum aestivum
  Clone ID: PAT_TA_104905.pep
STTQDYKSHHLCEHFSFRCCKVLVWFYRESCTTCLILYLPCSSVDLLQLYDVLKSDLCKHDKISVYICSAPLVRSYIHSSLMYYVLVG

SEQ ID NO: 210488 - protein, 81 aa, Triticum aestivum
  Clone ID: PAT_TA_104906.pep
IGDTSAYYLFRKMFVFNRMKTLSRKPGHPHDTCPLHKRVHRLPTSLIFSAHPLLHSFSLLVSFPLPISFFPFQSRGRVKPT

SEQ ID NO: 210489 - protein, 172 aa, Triticum aestivum
  Clone ID: PAT_TA_104907.pep
EIRDLSVLSRLCLLRGILTAIPRKALNVRQLHSNGSLWTVLYDGILPELCMHCENPIDRHFNFHALTVTQICLQQIKTSVLADFTDFTGDYKPFSRDVVNRVLKIIWSNLEDPLSQTVKQVHLIFDLLLDIESSLPSEDQSVKLVLCDIANDLLRLGPRCKGRYIPLSTRPR

SEQ ID NO: 210490 - protein, 59 aa, Triticum aestivum
  Clone ID: PAT_TA_104908.pep
RRVDLSATTSGGSERDLATPRSAGSGAMGPEVSHLGWGHWFTLRELEEATDGLAEENVI

SEQ ID NO: 210491 - protein, 112 aa, Triticum aestivum
  Clone ID: PAT_TA_104909.pep
GRVDERNSKTNRNESAAGVRRMPVVPAPPLPSPPRPSPTESKRNRTTPPRAHLTNFLSDSNRRGARAPARARPRRARRSKPNPSPPPPPPPPYQIRRSRAATDANRRPQWRA

SEQ ID NO: 210492 - protein, 171 aa, Triticum aestivum
  Clone ID: PAT_TA_104910.pep
RPRRQKDGSEGKITTIESVEVLQREDRELWISYSSLDSMSTLRLYESLKSKLEKKHWTFDGCPRGSLYDFYEEYWRPFAAILVKMETAGMLVDRAYLSEIEKVAVAQRKVAADKFQKWASKYCPDAKYMNVNSDTQIRQLFFGGIENRRNPGEFLPKSRALKVPNDVDAAA

SEQ ID NO: 210493 - protein, 62 aa, Triticum aestivum
  Clone ID: PAT_TA_104911.pep
YCWHKCFEQTTKRRVYYALQMENDSTASYMPMVYVTKHESIFFLFMVLLHAACLCIFIKVFS

SEQ ID NO: 210494 - protein, 160 aa, Triticum aestivum
  unsure (1)..(160): unsure at all Xaa locations
  Clone ID: PAT_TA_104912.pep
RGRVDLPLFLSSPSQRRQARSKTQLCRDAGAMHSRSLLRHPATPPLRYSSRMLRQRAALAAAASPHELLHGAGYELTTTSDVPVFQVPTAPRPRRAATSTAAASQLRCCGRCIVASTAASTPTAASLQLRQPQLQQRRLRRPVHRXSGGVSSDGVDCIAT

SEQ ID NO: 210495 - protein, 80 aa, Triticum aestivum
  unsure (1)..(80): unsure at all Xaa locations
  Clone ID: PAT_TA_104913.pep
APWRRPARGEPGAGGRKQRGATDAGGRVPDGAVIVHCRPXKPHXRRTRTSPLNPRPSSLLDAPPRMSSSCLFGSLSSTRP

SEQ ID NO: 210496 - protein, 80 aa, Triticum aestivum
  Clone ID: PAT_TA_104914.pep
LGWMCCPQLHSGIYYNYLFSFFCRFQENMTPERVQLGTHLQMPVAFLCWSRFIPNGIWAPLEALCSLVSSACTCDELCEP

SEQ ID NO: 210497 - protein, 97 aa, Triticum aestivum
  Clone ID: PAT_TA_104915.pep
AAASTARWTSFIPDLVAAAKSSETICENCMAILKLLSEEIFDFSRGEMTQQKIKELKSSLNSEFRLIHELCLYVLSATQSSELIRATLATLHACRRG

SEQ ID NO: 210498 - protein, 84 aa, Triticum aestivum
  Clone ID: PAT_TA_104916.pep
KQGEVKESCVKEFMRQGRGSKVRSEGFMHQGSGVEDASRAKEGQYQILMLVIGLLPYFLFINFIVCKNSVSSAPLAELLYGKLI

SEQ ID NO: 210499 - protein, 35 aa, Triticum aestivum
  Clone ID: PAT_TA_104917.pep
PQLYPKPALSRRTRTQVRRHRPAKGLAFYQGTKGG

SEQ ID NO: 210500 - protein, 162 aa, Triticum aestivum
  Clone ID: PAT_TA_104918.pep
SRPRRLYIENVSELAFDDVTTEDPDFPFIQGLAEAGLISSKLSRSDMNIAENIQDNHYFFSPDSPLSRQDLVSWKMALDKRQLPEVDKNSLYKTSGYIDIDKIDTAAWPALVADLGAEDQSITALAFGFTRLFQPDKPVTKGQAALALSTGDYAEVVMEELA

SEQ ID NO: 210501 - protein, 119 aa, Triticum aestivum
  Clone ID: PAT_TA_104919.pep
GQYSERAAATLCREVVSVVQSCHSMGVMHRDLKPENFLFLNKREDSPLKATDFGLSVFFKPGDQFRDLVGSAYYVAPEVLKRRYGAEADIWSAGVILYILLSGVPPPQPSHPKQPNRPR

SEQ ID NO: 210502 - protein, 90 aa, Triticum aestivum
  unsure (1)..(90): unsure at all Xaa locations
  Clone ID: PAT_TA_104920.pep
ESSVIYXILVRVVYQRNVDNLCPGMTCTIALLCYTLVLTYYYAAILVLNILLCMSHEGFSPFFSSSYYAFHTFLYKKAQSETTDLPRALT

SEQ ID NO: 210503 - protein, 149 aa, Triticum aestivum
  Clone ID: PAT_TA_104921.pep
MLRAVADASEKDVISLGFQSVRVIMNEGLATIPVQCLDECILVTGAYGAQKTDINISLTAAGLLWTATDFIVKGLSGRSVQKANHLNEEVQLGVSTEEGDIPTSEEGVKRNPLQQLVDYNKLFFSVFSVLQKLGADDRPEVRNSSTRPR

SEQ ID NO: 210504 - protein, 219 aa, Triticum aestivum
  Clone ID: PAT_TA_104922.pep
KIHLEDTDIQGKECMVFAGTTIVNGSAVCVVTGTGMATEIGKIHSQIQEASQEEDDTPLKKKLNEFGEALTAIIGVICILVWLINVKYFLTWEYVDGWPANFKFSFEKCTYYFEIAVALAVAAIPEGLPAVITTCLALGTRKMAQKNALVRKLPSVETLGCTTVICSDKTGTLTTNQMSAVRLVAIGRWPDTLRNFKVDGTTYDPSDGKIHDWPSTRPR

SEQ ID NO: 210505 - protein, 83 aa, Triticum aestivum
  Clone ID: PAT_TA_104923.pep
LQDISWMRVYHPLAMQTEEIKVAKQLNACVDFRISQGRVRIYDAQGCILCLLYKLRKPKQQSIVLQMSTSEYLMNQLYSLMLT

SEQ ID NO: 210506 - protein, 69 aa, Triticum aestivum
  Clone ID: PAT_TA_104924.pep
AAASTRGRRRRRGRGRPLRQTTAARCPPRVKSHRGGRSRRLGAAHLVGPRSRSPRRGCSRVCVVEGKEG

SEQ ID NO: 210507 - protein, 67 aa, Triticum aestivum
  Clone ID: PAT_TA_104925.pep
RGRVDFFLNILIDHFIHMHFYVQQNQLLKRMAFMKSVDAIFIIDLFCSPSVLLQLQLNMNARTPLLE

SEQ ID NO: 210508 - protein, 66 aa, Triticum aestivum
  Clone ID: PAT_TA_104926.pep
PSVLCPTANLGRGCQPPVGDTVAVAKLWCTILANPLEKISSLSYEQLKLVETACLSTYSTMLCGIQ

SEQ ID NO: 210509 - protein, 114 aa, Triticum aestivum
  unsure (1)..(114): unsure at all Xaa locations
  Clone ID: PAT_TA_104927.pep
CVSVQGEINLSTLARAYVHALVRPGGQEEXRKEGREEDGASTILSRPGEAIDRRHRWCGRHQAHRWGCCHCRRRRRPTLASWRRVGVCVLLWAAGPSSACQAACNANRLTNAYE

SEQ ID NO: 210510 - protein, 106 aa, Triticum aestivum
  Clone ID: PAT_TA_104928.pep
RCRAHETDRKSRGAFWRASRGEFLHIALPRLAARDACFRPLMLDRTAEIDAANDLWISLSSWVVEAVVFHCLGGRVAMERTSSLAPGFWTNGTRSLGDNNYGRCKY

SEQ ID NO: 210511 - protein, 204 aa, Triticum aestivum
  Clone ID: PAT_TA_104929.pep
AAASTLNGEPTYLVTADDVDNLLAIEVQPLDDRKRKGDIVKVYANDQAKITCDPQTKELIKKTLEVGHVSYQVQLPQVRFLDMWEPAVLAIKREGYSIKCNGQRGVVLTEKFQKATAINIPYGYERQTEFSIVSADGDEYNLQPADNNMSRDTIVLVLRLFRSMAVEKRRGREEGPLLQVDRSDPIRLNVYPSVFILLGVYSRH

SEQ ID NO: 210512 - protein, 192 aa, Triticum aestivum
  Clone ID: PAT_TA_104930.pep
RPRRPRPRRHHGSSSDGGHQAQCRRRGASVDVELRAAMALADMAGAGAGAAADHALPAQHLQHAAAPAAQAAMEHEDEELASTRLSLELGNVGIQSSPCSSSSSGAGQQPPQSSAAVTGYGLSRPRHMLTEAEKEAKRLRRVLANRESARQTILRRQAIRDELARKVADLASQNENMKKEKDMVLEQYLTLK

SEQ ID NO: 210513 - protein, 211 aa, Triticum aestivum
  Clone ID: PAT_TA_104931.pep
DKQLRDWVSDKLMSIQGFSTSVLVHYVIGLAKDSSSAGDLVGKLVEYGFSSSAETSSFAADIYAKVPRKGRGVSNYQKQEREAAKLVKKQSTYKLLADEDDDEVDNHTASSASASSKSRKHFRRKAQDQDDGKDDDETIAHVSERSVRRRTEEVDDEDGDDTLDEEQEILRDQQERAQLEKNMRERDAVHTRKLMERQLSKEEQEESTRPR

SEQ ID NO: 210514 - protein, 85 aa, Triticum aestivum
  Clone ID: PAT_TA_104932.pep
FLQFGLVWFDRWTYTCMVWPGFSLDYKLLPGLVAGLRTTSCRSCSRTPPFNLLSPWTEYVCFFLPSPSVNPFYLLICSQFLFPLV

SEQ ID NO: 210515 - protein, 198 aa, Triticum aestivum
  unsure (1)..(198): unsure at all Xaa locations
  Clone ID: PAT_TA_104933.pep
RGRVDDELELSDDDDDFIDSRRQSKRLKVGGTKTSQRKXLPMQAPRKRGVSFTDEEYSSGKDSDAPNSPDFSHRPKKPVRLHLKTVGHNDVFSNVNSHNESRTSGRRRTQRNISYAESDSDDSEEKSTKQQKLLKEDQDEEDGETIERVIWYQPKGVAEDALRNGQSTQPTVMSMPLDFDQQWDDVEFYIKWKGQSYL

SEQ ID NO: 210516 - protein, 109 aa, Triticum aestivum
  Clone ID: PAT_TA_104934.pep
IVGAKNLYHPIKCSRVIQDGCSHITSGVSQLVKVSQMALGDICPMLKPTWWWFTRTKYPRNGLRPTMTSIWGPQLRKDEPTWGQRQLFFFFFEPAKLFILLPVAALGTF

SEQ ID NO: 210517 - protein, 108 aa, Triticum aestivum
  Clone ID: PAT_TA_104935.pep
SRPRRPKIDEGAVHVVFSKSLDNYIKWCNYLPLRPVWNNIESLTKEKKLLYVCLYYLIWGEAANVRFLPEGLCYIFHHLARELEVIMQKQTAEPAGSCISNDGRSTRP

SEQ ID NO: 210518 - protein, 61 aa, Triticum aestivum
  Clone ID: PAT_TA_104936.pep
RNLLEFTYQEACGSRNKLALPIRVRKFIHTQLMPLYPSLSIALQMMCRFRPWTPFLSLSLH

SEQ ID NO: 210519 - protein, 187 aa, Triticum aestivum
  Clone ID: PAT_TA_104937.pep
RIRGRVDKGGQNWITKAKDKFTFPGGGTQFIHGANQYLDQISQMVPDIAFGSRTRVVLDVGCGVASFGAYLLSRDVLTLSIAPKDVHENQIQFALERGVPAMVAAFATHRLLYPSQAFEIIHCSRCRINWTRDDGILLLEVNRMLRAGGYFAWAAQPVYKHEEAQQEAWKEMEDLTTRLCWELGRRG

SEQ ID NO: 210520 - protein, 113 aa, Triticum aestivum
  unsure (1)..(113): unsure at all Xaa locations
  Clone ID: PAT_TA_104938.pep
MPPTQDGRSFQSVPEIGEEIGRXRFGGIRCCASRSTGDHCAVKSNDRSRLADLDYGLAGLEPKLASAGNPXVFQVHAXYEDEAWTHMVMVRLRHGAPIPELDAAVVVTLLAEA

SEQ ID NO: 210521 - protein, 64 aa, Triticum aestivum
  Clone ID: PAT_TA_104939.pep
RGRVDFFFFFFFFSRINPFILSLEATRGMHHATYTGDAPAGARHVLLHLLTKAASGYMVVKIHR

SEQ ID NO: 210522 - protein, 59 aa, Triticum aestivum
  Clone ID: PAT_TA_104940.pep
KSCIEVDAFLLDSSEIIQICIISAEDRAKLNYLCCCCLSLRKVVVKKKKKKKKKSRRGR

SEQ ID NO: 210523 - protein, 114 aa, Triticum aestivum
  unsure (1)..(114): unsure at all Xaa locations
  Clone ID: PAT_TA_104941.pep
IYAIGAGITAAAGTRLALQWILVKXLDCTHSNYQTLMRPVLLFIRRLPAAHEPASSPAPSPTAAPSESTMSSGNGIDGDEKSEETHSKDIRRIKCDFCTVVRSKMYLIRAHMVA

SEQ ID NO: 210524 - protein, 76 aa, Triticum aestivum
  Clone ID: PAT_TA_104942.pep
HFTSTIPVLWPSSSLVIFCALLTAAVTLHLILPQRATESLSSSIVGFFAFASTCFLFPTYIFLLSFLHTYVGAFII

SEQ ID NO: 210525 - protein, 87 aa, Triticum aestivum
  unsure (1)..(87): unsure at all Xaa locations
  Clone ID: PAT_TA_104943.pep
GIGGSTRHGSPRRDSRHRYTXVATATPQHPRHGTHRARRQGLALPAGSRAQRREVAALHGDAAQFLRRRAAHSGEPQREASQRSRVQ

SEQ ID NO: 210526 - protein, 155 aa, Triticum aestivum
  Clone ID: PAT_TA_104944.pep
LRPRDARHCATHRSDPWPPPRDPAPLPTSPPTRRPRLRPSTSCACSGCGSAARPRAAWTPSPRRRTPTPTTPKSPPARRGEGPQEAPRRFFERRRAKNTPLKAPGTCFGPDLTKVTAGTPTPNPAPGGSRGRRHFFFACMGPLAILSLISPLLSL

SEQ ID NO: 210527 - protein, 77 aa, Triticum aestivum
  Clone ID: PAT_TA_104945.pep
SLKCIVRSMLLSVLVFLLAKACHSDGTLYGTYILSKLLELQTQCTYYTSLTTTSYYLGRICVAEIPRVKTCFVDLHV

SEQ ID NO: 210528 - protein, 52 aa, Triticum aestivum
  Clone ID: PAT_TA_104946.pep
SRPRRLRFLQLNINGYNCHPSGGSLLKVFYLCAREITYAQAYSKLQNISLLH

SEQ ID NO: 210529 - protein, 209 aa, Triticum aestivum
  Clone ID: PAT_TA_104947.pep
VDGKLTLKSMDISQSEFFPFPRATISSQQDILNALWSLPNVDTDDMKLLRRIMGQGSQVKMASFKAAVRRYLTECLFECDDGNLPDLAVRAIGFLAQMSPKCQQAILTDERKEVEVDAVLDLSSCLRSLVRGATEENSSDDEVSLESDRCSEDNDFVLTTSNYFDIRSEQHMDEGCCSNFMINSIEDSEYTAGAGHYGDSGAAGSTMDP

SEQ ID NO: 210530 - protein, 64 aa, Triticum aestivum
  unsure (1)..(64): unsure at all Xaa locations
  Clone ID: PAT_TA_104948.pep
TGGSAPCRAVQRRTGFVAQXDILHPHLTVRETLALCAMMRLPTSAPTSAKLAAADAVIAESTRP

SEQ ID NO: 210531 - protein, 73 aa, Triticum aestivum
  Clone ID: PAT_TA_104949.pep
WCPNSTLFFFHFSFEILSDIRTPTSCLVGDLEFGPCLDTKEVSEKHSIITCRHEMPQQTSKGKKKKKKSRRGR

SEQ ID NO: 210532 - protein, 32 aa, Triticum aestivum
  Clone ID: PAT_TA_104950.pep
KAPAIAAAAYLRLAGRPAVLPSNNLCYSENFL

SEQ ID NO: 210533 - protein, 43 aa, Triticum aestivum
  Clone ID: PAT_TA_104951.pep
RTSFPVRPPATLYFPPVFASFQLVSRESGFYLLEARSHRFRTS

SEQ ID NO: 210534 - protein, 98 aa, Triticum aestivum
  Clone ID: PAT_TA_104952.pep
RFTWKVFNFSLFREMIRTQKIMSPAFFPAAAAAGGSDCGLRISVYQSNVSGAEHLSVCLEGKEPVVQATSASSASALAATSAGSGVPDVDRGCWCLFR

SEQ ID NO: 210535 - protein, 71 aa, Triticum aestivum
  Clone ID: PAT_TA_104953.pep
RGRVDLFLTQRTMSPSSSPEEEVPSSPKEQDHLSNRPISPASATPEVMYRLHIHWMESPVCPLSLVSDSAL

SEQ ID NO: 210536 - protein, 105 aa, Triticum aestivum
  Clone ID: PAT_TA_104954.pep
GRVDEQICMEVSISRLEMHCAETCLIAAKMQKACHMERGVSLFSNKDVVLTWCHLRREDVIGCGFMLDPPVFLGCWPSGIEFMPRHESNALCSFHAKASSRSLYG

SEQ ID NO: 210537 - protein, 56 aa, Triticum aestivum
  Clone ID: PAT_TA_104955.pep
GTMFAPRTMVAHRKPMLPNPTFVVKELGWPNYICNTSSYLGINKLLLICRVLVCSL

SEQ ID NO: 210538 - protein, 119 aa, Triticum aestivum
  Clone ID: PAT_TA_104956.pep
PVASPPPSAGAAPRAALATGTRALRGGGGIAGGAEAGALRQRRAGGGAARRGLRLQDAGGRGEGAAARSAAAMAVRVEGRGCRGGRGALRGLDRYGRWLRGGAGSSEERPRQLRRSTRP

SEQ ID NO: 210539 - protein, 122 aa, Triticum aestivum
  Clone ID: PAT_TA_104957.pep
MDPAAPDPDGGGLPARGSDAADVAGNTWDLAPFSPPPAALRGGELYIYRNAYNLVPRSIGECRGGLRALKFFGNDVEVLPPEAGDLDGLQSLQLKVSAPRVSGAVLRRMRALRELELSLVPP

SEQ ID NO: 210540 - protein, 211 aa, Triticum aestivum
  Clone ID: PAT_TA_104958.pep
AAASTEAATKITEVRLLSCGLLTSETAISLSSCTNLEVLDLSGCRSIADSGLSSISQLSKLTLLDLAGADITDAGLSALGNGSCPISSLCLRSCRRITNNGIASLLCGSGIINKTLVAFDIGNVPRISGRAVTLIAKNCERISSLCLRNCVLITDPCLETLGLDRHGSGKSTLRMLDLSYCTRLSRNFLRLFDPLVDPPLFRGLRWLGVGK

SEQ ID NO: 210541 - protein, 77 aa, Triticum aestivum
  Clone ID: PAT_TA_104959.pep
SRPRRLPSKLNLEYETNSYFESALPVKLNVESETNSYLKSASPVKLNLDLGHCQRNLLKHFKVYFGGEADSANQIGH

SEQ ID NO: 210542 - protein, 66 aa, Triticum aestivum
  Clone ID: PAT_TA_104960.pep
SSVRHILHDIIDRQSLEQSKTAQRMRALVTLIVNFRLSCANTNQINRLLMIKRRIDYREYKRGDSS

SEQ ID NO: 210543 - protein, 95 aa, Triticum aestivum
  Clone ID: PAT_TA_104961.pep
LSITMKPSRAAALVLVLVAALVLALAPVTEEASPCDPYPMGVYCEQGVDAGLYGEDMKPCCAFISPGYIDCLCAISERIPTGHVLCPDISCPSPP

SEQ ID NO: 210544 - protein, 82 aa, Triticum aestivum
  Clone ID: PAT_TA_104962.pep
FMSLRCYSTLSRPDRCYFTISKPDRCYFTTLSTWVELIRIACTVALLEQLGLLVQNSDKIDQELNGYVLTPQFTSSRTVTKT

SEQ ID NO: 210545 - protein, 133 aa, Triticum aestivum
  Clone ID: PAT_TA_104963.pep
SRPRRPFWNFSPSSYFRNSSFFGSSRGLGVNSNFLRLRRQRNSNSNGMASSISSVSSTSNGSEHAIAAKGGDLLADADSAACRQSDLPLNNDIAGSKVSKRSRSEITEVSSHAGKEVNMQGTNGQGGMFLGLG

SEQ ID NO: 210546 - protein, 230 aa, Triticum aestivum
  Clone ID: PAT_TA_104964.pep
CQVKELLLSVAVEDDDTVYDPIILDAPLISQHLKLLHLEQVNLKFSALNFSRCPVLEDLKMQRCGIDGRRISSKSLKRLCISDFCYFPEDFHVRIFAPGLISLQLDGFNGLTPSLEYMPFLEIAYVGLRDECYDFCRSNRQDCEFDDCGCHAYPVGEGVLLHGLSNAVNLELIADHGSERFIYTWDLKCCPIFDKLKTLLLSEWFTTVDLVCILQHSPILEMLTLVDAAA

SEQ ID NO: 210547 - protein, 194 aa, Triticum aestivum
  Clone ID: PAT_TA_104965.pep
RPRRPEVVAHAAITPPSASVAPPPSSHTPCPSRLHKGGDRAPRRGRRGGRPPGQPTHGDGWRRGTMVTPLGKEVAMGGAFVVVGRGRHGHGTATGQRSGGGTRRWKFAGRRRPRQVGARQHSHRWVAVPPITTQERSAAPVKPRLRVCSAVLGTSRRAPPQQAASPPSIPRALSDDVSPDVSPHGSAEGNQRVV

SEQ ID NO: 210548 - protein, 42 aa, Triticum aestivum
  Clone ID: PAT_TA_104966.pep
MATFIHNLVTKYRWKPVKGGNIVRTPGLGFPDGFDIQLFPKN

SEQ ID NO: 210549 - protein, 199 aa, Triticum aestivum
  Clone ID: PAT_TA_104967.pep
EFAAASTNGAKHGTGPSSAPDAQEGPMDNDSHGKETEDHNPVHNLDPDMAYEAPVPPERSHHPHLDETMKPEGHTSYSFVSANRVFAAYSADCKDDSPIFVSTPERMDEKIPEGTSLAKDGRTAHNEAAKQKKKMCFAPDDDSYVDQLTEDPVFTSRLGGLRQSGEYLNNNAPTNEASGTCSLPQKDLVEDPEKLGQSS

SEQ ID NO: 210550 - protein, 177 aa, Triticum aestivum
  Clone ID: PAT_TA_104968.pep
RIRGRVDGMEWLCAWFVNLHLALSRSFQNIPSTTSLEGDLLCALRKLPCIPLSDGSFSSVADGPIWLPHDILGSTPDCKGSMKDFPILYGNLRFVSPLLFSVSCKNKYLIEEMRANDLTDILLKIGVRKLSGHEIIKNHILTSLPNGTDAKKVDKMMMIEYVSFIMLHLQSPCTSCN

SEQ ID NO: 210551 - protein, 65 aa, Triticum aestivum
  Clone ID: PAT_TA_104969.pep
HRGWDFLTEYAEFTHLPMKKSVIPLTFSLVSNSLILIVGSRHKCIFRGYYDNVELYWRSTRPRIR

SEQ ID NO: 210552 - protein, 53 aa, Triticum aestivum
  Clone ID: PAT_TA_104970.pep
YSTINVPECHQHRTFRLCVPTVVVYSLVWMFYLNTKQLYISFWLYLTVRNKVV

SEQ ID NO: 210553 - protein, 137 aa, Triticum aestivum
  Clone ID: PAT_TA_104971.pep
MEANEEIRKHRSCLGTGCFCCAIFKKEDCRKEDEAYQQENYAEEALFCTLCNTEVRKNSKHCRSCDKCVDGFDHHCRWLNNCVGRRNYMTFLCLMAVSLAWLAVECGVGIAVFVRCFTDKAAIEEQSTRPRSTRPRI

SEQ ID NO: 210554 - protein, 75 aa, Triticum aestivum
  Clone ID: PAT_TA_104972.pep
QWHKFYSGKLLRFSFLNYARSQVSSNQSRKLTTMLPEAIRQQLLYSEEYQHFLLSQQHQYDKQFLCFQNLGSGLS

SEQ ID NO: 210555 - protein, 69 aa, Triticum aestivum
  Clone ID: PAT_TA_104973.pep
SIFRSRWILNSRTSSESVTFWPTSSVSYSLCLELLVEEMNVSRYILVVDTSIFVSGGSTCQQFTLALYI

SEQ ID NO: 210556 - protein, 101 aa, Triticum aestivum
  unsure (1)..(101): unsure at all Xaa locations
  Clone ID: PAT_TA_104974.pep
PPRPPQGFRPRWPFHRPRPPMPRRTLPPRXRRPRFPPHPPALPWAPPPXPPRAPPCIHPPPVSSQSPELSPPPSCFRCSDDSACCCLYIVSDILYCFLGPP

SEQ ID NO: 210557 - protein, 122 aa, Triticum aestivum
  Clone ID: PAT_TA_104975.pep
ALVGRNVKMLRSNGVEVRELQSLELPLTPTLLSDRIPGLDHGLSERIWKVFSEEGFVDERGYMRKDGRATPWKNAVVKRGFWEELSQWAKHIQEELNLAYGYHEMTSLQNDEMLNWIEEHLK

SEQ ID NO: 210558 - protein, 66 aa, Triticum aestivum
  Clone ID: PAT_TA_104976.pep
KRKWIKKLKMNHTLLRCHHIVCCLFCQNHNHRNSFSSCNKYTVQPTTTWRKHIMIERKYDRNTAYP

SEQ ID NO: 210559 - protein, 56 aa, Triticum aestivum
  Clone ID: PAT_TA_104977.pep
KLFLVLCNPVDEGSAHSVFSTPSTSIYMRSSFLMIKMTIILTNNMFVVCHKKSTRP

SEQ ID NO: 210560 - protein, 83 aa, Triticum aestivum
  Clone ID: PAT_TA_104978.pep
TPAGIGVGIAISSVDDESSPTALVVQGLLEAAAAGILVYMALVDILAEDFSKPRVQSRARLQLALNVSLLLGAGLMSLLAVWA

SEQ ID NO: 210561 - protein, 82 aa, Triticum aestivum
  Clone ID: PAT_TA_104979.pep
RAAPSPPSARPRPSRGAIGTPIAIDRVRLRTRALLPRTDGRTDGPKISSRRRGEEGCSAFGSGGLGVGALADAEAGRSTRPR

SEQ ID NO: 210562 - protein, 132 aa, Triticum aestivum
  Clone ID: PAT_TA_104980.pep
RGRVDLGAAAAPGKGSPRHSRRHVRVEFELVLGLILPVATLFFLGGVKIVVFVFIISPKDRQVPRRLLPPLRLLHGSEERQDQRILTSSPVAVDLVRLQQQPLVAGTGCAMIMTRERCLLALSSSSAPSIGG

SEQ ID NO: 210563 - protein, 184 aa, Triticum aestivum
  Clone ID: PAT_TA_104981.pep
RIRGRVDCKLGCLSHRARIMPWRTLRFNESVCNPYNADFDGDEMNLHVPQTEEARTEALMLMGVQNNLCTPKNGEILVASTQDFLTSSFLITRKDSFYDRSSFTLLCSYLGDAMENIDLPTPALIKPIELWTGKQLFSVLVRPNAFTKVYLNLGVREKICTKKCALTVEDKTSEAVHDAMCPND

SEQ ID NO: 210564 - protein, 139 aa, Triticum aestivum
  unsure (1)..(139): unsure at all Xaa locations
  Clone ID: PAT_TA_104982.pep
GVDQSMCSGCRLPFNLRRKRHNCYNCALVFCHSCSSKKSXKXSLAPNPNKPYRVCDSCYGKLNKGPETDRYSSAKRGAILQGFNDSINDDLETRSNVQLSRLSSMESFKNMDSRYSKKNKKFECEGKMKRTLKRESKSA

SEQ ID NO: 210565 - protein, 78 aa, Triticum aestivum
  Clone ID: PAT_TA_104983.pep
SNRSLCWLRMGDGQRAFDDATKCKRLRPKWAKAHYRQGSALMFMKKYAAAYSALSRALELDPESEETEKLFWEAMELK

SEQ ID NO: 210566 - protein, 102 aa, Triticum aestivum
  Clone ID: PAT_TA_104984.pep
RLVVEHFYMSIITGTRIVTSNVHLCDHLRSLPVLMGILCLSAGCYKHCLNPTSCVPFMCDTITARSSTTNGEQELRRSTRTWIMHETSREQALPKVKAKGAQ

SEQ ID NO: 210567 - protein, 221 aa, Triticum aestivum
  Clone ID: PAT_TA_104985.pep
QAFQLLAFKQVPKLRDLALCNIGSIHKCADLTKKLLVLSDMELQDLVCNKLKIISEKDPWTGRRDFLIEVLVAFFEKRQSQKDAVNALPLYPNEQIMWDESLVPSINYSGEGCLALPKLNLQFLTLHDYLLRNFNLFRLESTYEIREDIQEAVPHLHAYINNEGDTSFRGWSRMAVPIKEFRITQVKQPNIGEVKPSAVTADVTFSISSYRSQIKSESTRP

SEQ ID NO: 210568 - protein, 78 aa, Triticum aestivum
  unsure (1)..(78): unsure at all Xaa locations
  Clone ID: PAT_TA_104986.pep
FGQSNGACMDGLXHPSIHCFLERDKLDAKVNAPLFTDFVCEVHGKRAVYGCDCDIPTRLLVPCFLVCDKQLSNRSSCS

SEQ ID NO: 210569 - protein, 52 aa, Triticum aestivum
  Clone ID: PAT_TA_104987.pep
AILLNIEHCLLQYISRSRTYCKEHVDSTISNCIQFAAYHSDVDTYEICVARN

SEQ ID NO: 210570 - protein, 85 aa, Triticum aestivum
  Clone ID: PAT_TA_104988.pep
SGPIAKSVDPPDPNFILFMKNIYFKILCKILEMTHSPENIYQDMVKEMTTCRIVLRPTRNHRAWLLRIRDRLLIIISQPCLYFLI

SEQ ID NO: 210571 - protein, 117 aa, Triticum aestivum
  Clone ID: PAT_TA_104989.pep
CSVAFFFCFPDHTVWTASLPPCSPLARPCSTARVCMQHTARGLPVAVVKLIVFPFSEKLHDAIWSLILYLVMQCTHKKWCSTRKIVVSFIMQCTRKKWCSTRQIILFLLTDDNGAAL

SEQ ID NO: 210572 - protein, 84 aa, Triticum aestivum
  Clone ID: PAT_TA_104990.pep
LIQEQSILHQIHTILCLLQKKKSKQQIIYQIQINLTYFASSPNNLVSSHAFSDSYMEDGEQKLKQFIVQTYMGATMQLQSDKTM

SEQ ID NO: 210573 - protein, 54 aa, Triticum aestivum
  Clone ID: PAT_TA_104991.pep
CFIFISTKVIVEAPLSFCSCLWPCHRQRPGLQIVHRYMVRYASSGQNLWSTRPR

SEQ ID NO: 210574 - protein, 90 aa, Triticum aestivum
  Clone ID: PAT_TA_104992.pep
AAASTSSTLNRNALRLCSSLVQLGTLENQQSHLKSPAASLWRLLGGDKLSMHPPVYMCRSSRLPSFLKSSSPGDHPPEVHLSTTRFVQYF

SEQ ID NO: 210575 - protein, 120 aa, Triticum aestivum
  Clone ID: PAT_TA_104993.pep
LVLLPSFIIFFHDGSRRPSSAGDIAILFLAFVLNLAFALSLLCFICMHTSLAASNTTSIEVYERKKTCSWEYDLGWRKNLEQVFGTNKLLWFLPMYCPEDLQNIATIQGLEFPTRSDAVL

SEQ ID NO: 210576 - protein, 113 aa, Triticum aestivum
  Clone ID: PAT_TA_104994.pep
RPRRPGDLHVHLDGCIVGSIASAKIEEVVNYLRRLKLLAHPATPEDLEVGYVPLSLGGAYPGLYLFTGAARFVRPVKNLVSLPDGETRIELIGPFEQAFMEIRCPDGGDGGRK

SEQ ID NO: 210577 - protein, 171 aa, Triticum aestivum
  Clone ID: PAT_TA_104995.pep
RGRVDRGRVDEKAVIEVCMDLLHPTMIVVDLGCSSGENTLIFVSNVIEAICCNHDKLHGNLMELQVFLNDLPGNDFNRVFQSLEQFKESITITHKLEALPPFYIAGLPGSFYTKLFPRHSVHLFHSSYCLHWRSELPDGFAAKREMYLNKENIYIARTTPPSVVKLYQEHF

SEQ ID NO: 210578 - protein, 98 aa, Triticum aestivum
  Clone ID: PAT_TA_104996.pep
MGFSLDTGGGGDAGGYGAGLQGAQESATGRMLFPFEDLKPGANPSGGGASGGDQFEHSKDPGGGGGGHETLGFWNNSMIGNGSSNDAGGGGGGGGGSW

SEQ ID NO: 210579 - protein, 32 aa, Triticum aestivum
  Clone ID: PAT_TA_104997.pep
YYLFYTKDKPRLFSMYCELTDVHIFSRITVKI

SEQ ID NO: 210580 - protein, 40 aa, Triticum aestivum
  unsure (1)..(40): unsure at all Xaa locations
  Clone ID: PAT_TA_104998.pep
VHKNAVPSRVSSSKVTTFXGAARLRGPMAVLKLYFLKKKL

SEQ ID NO: 210581 - protein, 41 aa, Triticum aestivum
  Clone ID: PAT_TA_104999.pep
SSPSWIQPPPILLHPTATSSLALATTSSTQRPDRRIQPVWC

SEQ ID NO: 210582 - protein, 181 aa, Triticum aestivum
  unsure (1)..(181): unsure at all Xaa locations
  Clone ID: PAT_TA_105000.pep
DGLSGIVQQKGVYQYHPSPAAASPTARDPRDXLARELPGFTXGATESTPLQRPLNSSGNRTANGRASSVSGMSNCSVGDPKYDKICIWESDGDITCDIVDGAALLDDARRSVRTEDGGESVALLPPPSPXAPRIAKSSGCPRRWRSNRETIVKGHKHYELMLNLQLGIRWVASVIFLRQRV

SEQ ID NO: 210583 - protein, 42 aa, Triticum aestivum
  Clone ID: PAT_TA_105001.pep
VITMMERFMSKGIVEELLKRKVILAINRSMVRVQIMGVDAAG

SEQ ID NO: 210584 - protein, 43 aa, Triticum aestivum
  Clone ID: PAT_TA_105002.pep
RPSAATTRTGKSSSRSKILGCQGHELQQHNLYITKLAINNSIC

SEQ ID NO: 210585 - protein, 86 aa, Triticum aestivum
  Clone ID: PAT_TA_105003.pep
RGRVDVLCLVLRLMRNKNIHIQWVIFVVQRIPLMILPAFVCVVAILQEPIPREYQAIPPALVYSLVYNNNLDALSFSIYFPVRCKL

SEQ ID NO: 210586 - protein, 87 aa, Triticum aestivum
  Clone ID: PAT_TA_105004.pep
RDLIFDACSWKYYIANMIFSGLLSTPVSVSAARTTAVVCSLLQCQSHLIYLIIGSVSCISIGIMLSNFNYYSRFCFICISVGTMLSN

SEQ ID NO: 210587 - protein, 43 aa, Triticum aestivum
  Clone ID: PAT_TA_105005.pep
RGRVDRPGQEIPVSLVYDQVKTAAKFSQHDYKLDSLIDGIDKE

SEQ ID NO: 210588 - protein, 138 aa, Triticum aestivum
  Clone ID: PAT_TA_105006.pep
AAASTRYRKKRREAMGLEDPPKKRQPAAAAAPAACSEAGGESADPEQQQPQQAKKTTTTTKRGREVELRVVGFGKEVVLKQRRRMRRRQRLGEEEKAAILLMAQQSSKHAGRDVAASLPAPPCSFLLVFPADYLLNNE

SEQ ID NO: 210589 - protein, 109 aa, Triticum aestivum
  Clone ID: PAT_TA_105007.pep
AAAVRAADLACGGSAATRGGRWWAGIRRWLGFGARVSLEAPLPLGRGGEGLEERMRQRLRDRTHAHTGCLPARPPRSLSPSLSVKLLSPACEEEFGGSPLHFGLVDVAA

SEQ ID NO: 210590 - protein, 200 aa, Triticum aestivum
  unsure (1)..(200): unsure at all Xaa locations
  Clone ID: PAT_TA_105008.pep
LSQDQLFSIIDVSPSWAYNGSQNKVLITGTFLTNKEHVENCKWSCMFGDVEVPVEVLADGSLRCYTPVHQSGRVPFYVTCSNRVACSEVREFEFRDSETQYMEAADPHXTGINEMHLHIRLEKLLSLGPDDYEKYVMSDGNEKSELISTIGSLMLDDKFTNLSAPSDEKELSAAQDKNLERSVKDKLYYWLIHVDAAANS

SEQ ID NO: 210591 - protein, 63 aa, Triticum aestivum
  Clone ID: PAT_TA_105009.pep
FFFFFFFFFFFFSPSRSTHARRLVLFIIAQVPILFYCLLNTLQAAAATKAQAGRRRSGDQSLV

SEQ ID NO: 210592 - protein, 45 aa, Triticum aestivum
  Clone ID: PAT_TA_105010.pep
ELLCLHLDDSFTETFIIDHLYPLITLNPCSRARDSNIVPRTSHHH

SEQ ID NO: 210593 - protein, 206 aa, Triticum aestivum
  Clone ID: PAT_TA_105011.pep
DNDMIAQYDGQLLDSEELNLMHSEPVWQGFVSQNSELGMLGNGKFLNDSARPHPDDPFVEDDQHGSVRSIGVGISSDAADIGSEVRESLIGGSSEGDIEYFNESNLSVSGKRHSQQETEKKKVNANGAKQDQINYDIQKGNMPPGAAYGDGGFSFPPPLHSGKNTESDVKSSWSKKDDYSINDPDDCQNGTVSDDTLATWKVDAAA

SEQ ID NO: 210594 - protein, 108 aa, Triticum aestivum
  Clone ID: PAT_TA_105012.pep
VGPSYNCGCSCILHVLCFNHIRIKIKSKRLWCLKLHLRIKVFLKNNLFKRETQSSLCYVYETIQHHFYCGLARIVSCVVFRWLLISPHLVPFHIYFGLDCGRRRGREF

SEQ ID NO: 210595 - protein, 62 aa, Triticum aestivum
  Clone ID: PAT_TA_105013.pep
SRPRRHLDGSDLESWRSVLEKDSNGNWVELPLVKKSLEVLQALLLDDSGLGGGLGIGGGSGP

SEQ ID NO: 210596 - protein, 120 aa, Triticum aestivum
  unsure (1)..(120): unsure at all Xaa locations
  Clone ID: PAT_TA_105014.pep
MEFLRRIEELAASAGVRTAGCGWPPSLERSASGVGLPLSLRMLKRKKQQRRQQQVPQPSRWDGRLRLGSAGESVGRAFSSMVLIVRELQSFXLQQMLCDDLQAVLARAHGEMQDSFVWLF

SEQ ID NO: 210597 - protein, 79 aa, Triticum aestivum
  Clone ID: PAT_TA_105015.pep
AASTRGADAAVIDGVGRDAPRGAARGADDRGAARLRLLHGDLPLAKPAMQRALLPLPLLDSLSVSWRERSITGHRARPV

SEQ ID NO: 210598 - protein, 95 aa, Triticum aestivum
  Clone ID: PAT_TA_105016.pep
AAASTLLFLSHLSGLLGLIVWWRRGVIGLLSIRHHFINSQQWPSVRPFCSCESVDPAHAHDLAEAGAARSNSTRGQSIAARGKWRDAGDASRRFI

SEQ ID NO: 210599 - protein, 98 aa, Triticum aestivum
  Clone ID: PAT_TA_105017.pep
MWLVWQSAADLQGSYPYYVTQVEQQFQNMHLIRPPMQPLAFQQDQINLQRDIQLQIEHYFSTNNLCHDTYLRERMDNQGWVPIDLIASFPMVCFLILI

SEQ ID NO: 210600 - protein, 61 aa, Triticum aestivum
  Clone ID: PAT_TA_105018.pep
MAIMTITKKKPAYWWDSPGDDCPELQRFAIRVLSLTSSSSGCERNWSAFEQVHSKRRNRLH

SEQ ID NO: 210601 - protein, 48 aa, Triticum aestivum
  Clone ID: PAT_TA_105019.pep
IPKLNKEEVGPVMLKDFEAALQEVSPFVSPRELGIYEEWNMQFGSLSI

SEQ ID NO: 210602 - protein, 91 aa, Triticum aestivum
  Clone ID: PAT_TA_105020.pep
MSAYCGKYKDELIKNAAYIGTPGKGILAADESTGTIGKRFASINVENVEDNRRALRELLFCTPGALQYLSGVILFEETLYQSTLKAWAGKA

SEQ ID NO: 210603 - protein, 45 aa, Triticum aestivum
  Clone ID: PAT_TA_105021.pep
APAAAWGARGAAGGMVAPFVAKTYSMVDDPATDAVVGWGPANNSF

SEQ ID NO: 210604 - protein, 166 aa, Triticum aestivum
  Clone ID: PAT_TA_105022.pep
ISHLKASRLEELAAQIKSDRAKHDAKGKQVESSRGEETEKTDGGQTRNDDGENSRGAVAPINQEKLDELLAASLAAEDEAGLTGKGEHNPASVPSQEGTGIDEDENDDDEEMIFPITTGDIDPAVLASLPPSMQLDLLVQMRERVMAENRQKSQKKKKKKKSRRGR

SEQ ID NO: 210605 - protein, 104 aa, Triticum aestivum
  Clone ID: PAT_TA_105023.pep
TLSSEGRTPPRVGFVGHITRIANKLIQLANSNSTIQSHLQQNSGWTEWHASILTKRNAVENVYQWACGRRPPMQDRGRDRDVPDFPDRVYDVGALASDLRQAFD

SEQ ID NO: 210606 - protein, 185 aa, Triticum aestivum
  unsure (1)..(185): unsure at all Xaa locations
  Clone ID: PAT_TA_105024.pep
AASTDTHAKGRLSRLINILDKLKLLQLANELVDESGVPSDAAPTHSMELRPYIEEPIRRILPSSHVNLNHRPXRHDFVLSKQEFVDAYWETLEYCYLTAGLTEPLSAFPGCAVPEVSHPRSWSSRRVMTIEQRRELQKRIRKISEEGRIPFKDCLVIAKELNLSLEQVLCVSYSQVDAAAVDAAA

SEQ ID NO: 210607 - protein, 101 aa, Triticum aestivum
  Clone ID: PAT_TA_105025.pep
HLSLPLHVIQSSAKHMPATSLQPYPAWPSHECSCKGIGRYTEEPMAAKEAVNREGALALWVPRLQGFIHSRQLFGQTRSDRCMLMHNISNTRKSISPAPIT

SEQ ID NO: 210608 - protein, 100 aa, Triticum aestivum
  Clone ID: PAT_TA_105026.pep
NSRPRRPKDNLPRGGGSDDHQKAVPLCEGCIWVTPTSMTALTRESKPVPSTMQDDSKEVHQLSQQCRHPHSTKPKPHPSRAPLCRFSGMVPRHPLPRPHW

SEQ ID NO: 210609 - protein, 137 aa, Triticum aestivum
  Clone ID: PAT_TA_105027.pep
AAASTSDVHVVPLTLSGTDGSRPVTVLPNVAHDLDKLQNNTYSLCIEGNCYVLLSPRDDGTGSQSSKEKLLVFHVQSELVTSIDTPEDGTLFSGIMEMGKSVCDTTLSRDRPEITLSVLNSGLLWERMCCLSVSPSP

SEQ ID NO: 210610 - protein, 162 aa, Triticum aestivum
  unsure (1)..(162): unsure at all Xaa locations
  Clone ID: PAT_TA_105028.pep
HSMSLISHRDLVGVAYTEEETKAMAAEIEVVDGPNDEGEMFTRPGKLSDRFPQPYPNEQAARFANGGAYPPDLSLITKARHDGQNYVFALLTGYHDPPXGVQIREGLHYNPYIPTPATEAQMGKDVVSFLSWAAEPEMEERKLMGVKWIFLLSLALLSTRPR

SEQ ID NO: 210611 - protein, 67 aa, Triticum aestivum
  Clone ID: PAT_TA_105029.pep
FWIVSVTKLQNLTQYQAVERVNPTVVPTKLEVADMVTFPIFCQCPTAAQNATALVTYVMQQGDTYAS

SEQ ID NO: 210612 - protein, 96 aa, Triticum aestivum
  Clone ID: PAT_TA_105030.pep
HIKAVHEQSRPFTCGFSGCGQKFSYKHVRDNHEKSSVHVLFEGDFVEADEQLRPHPGGRKRKPISVDTFMRKRVAAPDAPPAYSDGTEYLRWLLSG

SEQ ID NO: 210613 - protein, 185 aa, Triticum aestivum
  unsure (1)..(185): unsure at all Xaa locations
  Clone ID: PAT_TA_105031.pep
SRPRRPRPRRQHTLPSGGVSSSTEFVPKILKGTEDWEADAMDDKYSLFLNGVLIXIAKQGMSKNGGSVGKDNSISILEEFFGNALSKGSGNLPTYVESQQLNTGADMMASSVPESSKFARWFRDEDSKPSEDLPSKSLLSMIVNNDKTGPQNIAPGPTLSDGAIHQNLSSKLTTDKFDASSRLLP

SEQ ID NO: 210614 - protein, 122 aa, Triticum aestivum
  Clone ID: PAT_TA_105032.pep
HPVWKCISTPIFMHRQAAAGPPPPRRGTRPLADASHCPTPQDPHLAAPASARGDSATARSARALPAGGTSDCEAAEGRAPRAPRWLGSPPVSPLEPERRGTKHSAHYSVVAEMLGISSTRPR

SEQ ID NO: 210615 - protein, 36 aa, Triticum aestivum
  Clone ID: PAT_TA_105033.pep
EACTCVLILIILILLLSLHIRFVGSEIERTHFGSTR

SEQ ID NO: 210616 - protein, 61 aa, Triticum aestivum
  Clone ID: PAT_TA_105034.pep
RFQSTPFGSPHVVNCYEGFCSLIFFLKVFAISMAYKSSIRYAPIMHWMWVFGVPCQSHGLD

SEQ ID NO: 210617 - protein, 114 aa, Triticum aestivum
  Clone ID: PAT_TA_105035.pep
MRERRELHGSRGFQRRRLGGRKTSLSHNPRERGVAKFLTGLPARGNFSSSSISSNLGGLRVYVCEHDTNPPDVLPEVWVCRSHQKSPTWAVLPDCLPLMKQYLAFHSTHCSPSP

SEQ ID NO: 210618 - protein, 119 aa, Triticum aestivum
  Clone ID: PAT_TA_105036.pep
SPVPVPNTGRVSPQLLSLSPIVPPPGSNGSVVAYYAKESSKQLAAGIVTLGDVGYKKLSRYYSGMIPNGNGNIKQGNAGFKANGVTNGHTIDSEYAGTVIVRDIVSKAMIVQFRSTRPR

SEQ ID NO: 210619 - protein, 195 aa, Triticum aestivum
  Clone ID: PAT_TA_105037.pep
EELKKIKHAMQLAVFAAYHLSLETSFLADEGATIPRVISVTAMCAQEAWTNTDHISAKSAGRDTTDSLRAAEEKWPHTAAITQMFDGISASPPSLRLDGESLGSAPECTESEFPVNHANSLNAVNACQKAVLAKIPVDLSHLENSGSGLPPDDFQAGGLDNWNRLSCSYLPGTDNHQSILVSLSSTCIPKSTRPR

SEQ ID NO: 210620 - protein, 48 aa, Triticum aestivum; identical to SEQ ID NO: 197356
  Clone ID: PAT_TA_105038.pep

SEQ ID NO: 210621 - protein, 148 aa, Triticum aestivum
  Clone ID: PAT_TA_105039.pep
NLEMVTSTVVPSGQGRWGRPPGIRPAVIARSTEWPRARAAAVWNPVLQGWTHLGGRLCGEDRQRWPECGALWTVVQAAASRYFCHAEPTCSCWRFLRGLWRPSSTGSSPSSVSSVRPPKPPLSSRGLLYRANGPSLLLRPPAIGKQGE

SEQ ID NO: 210622 - protein, 173 aa, Triticum aestivum
  Clone ID: PAT_TA_105040.pep
AAASTTLLQRSRPPAAAAATNIDIAVVPRGIMSGNPGYAAAPKRQRRRRPRDAEDGSAFPRVVTSRPRGADQVREVAVVPAEAMDIDAGTSANAPTGGVDGSYLSDTRFDQCAVSPLSLQGIKDAGYERLTRVQEATLPVILQGKDVLAKAKTGTGKTVAFLVFFRLQHNKSI

SEQ ID NO: 210623 - protein, 77 aa, Triticum aestivum
  Clone ID: PAT_TA_105041.pep
GREVPGAEAVEAEGVQALHHGLRARQRGRRRGRSVPVVMVLMLVVAVLLPVVVVAEAVGAEGERDGADDDVEQEEER

SEQ ID NO: 210624 - protein, 57 aa, Triticum aestivum
  Clone ID: PAT_TA_105042.pep
DIHKKKYSICQDLYDYIVMRISSLFLINEGMVLVTLSGPYIYLCNVDSGNEKSTRPR

SEQ ID NO: 210625 - protein, 69 aa, Triticum aestivum
  Clone ID: PAT_TA_105043.pep
GRVDPPPSTHTHTAAKRSSPEREESTMSGRGKGGKGLRKGGPNRLRKVLRHILGITNPAIRRLALRGGV

SEQ ID NO: 210626 - protein, 60 aa, Triticum aestivum
  Clone ID: PAT_TA_105044.pep
LCPAQQPPPSPPPLSPAQQPPPSPPRQLRPSPEQQPPPSRSPSNEAERPLSFSWIKTEHF

SEQ ID NO: 210627 - protein, 96 aa, Triticum aestivum
  Clone ID: PAT_TA_105045.pep
FIHTGSLANKSGSVVICLLVLIMQSLVFHRSVLLSLSINLYVRMCSASGTLVLFLDFENCVKNQVVCCFNIYQKELISLSKKKKKKKKKSRRGREF

SEQ ID NO: 210628 - protein, 79 aa, Triticum aestivum
  Clone ID: PAT_TA_105046.pep
TILILQDRTTTTPKMSDRASLEANIGASNKRNLKQPTSRETVYRTLSSTAYAEMDVSGIDAIMRMLSGSHSSSSSSLLS

SEQ ID NO: 210629 - protein, 165 aa, Triticum aestivum
  Clone ID: PAT_TA_105047.pep
RPRRQGFRPKSFTAEPKKQRAETRTGCEAHMTVKITTSGKYVVTECVADHNHDLEAPVVDIQILRSQNLQIHQKLLAKLQQPPDPPKVVLIPNDYKNYVRTRHTTDMQLGDARAISEYLQRMKGENPSFFCSIQVDEDDQFRNVFWADVKSVMDFNYFGDVVCVD

SEQ ID NO: 210630 - protein, 105 aa, Triticum aestivum
  unsure (1)..(105): unsure at all Xaa locations
  Clone ID: PAT_TA_105048.pep
APCFDAAEEDGRAVECPICFLXYPSLNRSKCCGKGICTECFLQLMPSKASKAVHCPFCKTAAYAVEYRGARTLSEKKLQREEEQSVYEGATRIHSKNAGGHILLP

SEQ ID NO: 210631 - protein, 88 aa, Triticum aestivum
  unsure (1)..(88): unsure at all Xaa locations
  Clone ID: PAT_TA_105049.pep
EATKEKGFEAKDEXLDATGRAMDKGRGAAEATKEKGYEAKDNAADTAQQTGSYIAQTAEAAKQKAAGAAQYTIDTARAGTEQTSTRPR

SEQ ID NO: 210632 - protein, 82 aa, Triticum aestivum
  Clone ID: PAT_TA_105050.pep
FRVIQCRNIRQTILHGSKKNHSSIEIEHIERVSVYYQSASCKSIRKIKRYHLITHRSLHLINWNKKTAMFCTVQKINDNMRR

SEQ ID NO: 210633 - protein, 177 aa, Triticum aestivum
  Clone ID: PAT_TA_105051.pep
MPSIAAIPEPMAVDDSASKKAKRKQLKAEAAASGKKDKKEKKDKKRKTKEPASSDEEGRSSTSSESDRAPAAKKAKKEKKDKKAKAEPAEEPANDDGELTASGEEEEEPADPNALANFRISEKLKDKLKSKGINALFPIQATTFALVLDGNDLVGRARTGQGKTLAFVLPILESLST

SEQ ID NO: 210634 - protein, 50 aa, Triticum aestivum
  Clone ID: PAT_TA_105052.pep
SSNHVSLIYINYRKNSATKVTCLVRNWITKGILTTKSIGTHRIPGNFSLK

SEQ ID NO: 210635 - protein, 169 aa, Triticum aestivum
  Clone ID: PAT_TA_105053.pep
AAGRPTKGSTNPKSSAAAGGACNPVPLKARSNSARVAGGSAAATATFFGLPARIRPAFTRRQPSQGRILPDKRSGGTGEEPRSPKVSCIGKVLSDRERCGRRRQRRWWRGVAAVFRCGGGGCASRGVGGGAAGKKMALEGSEYDEEEKEASVAAMRKFKSGRRAATWGE

SEQ ID NO: 210636 - protein, 72 aa, Triticum aestivum
  Clone ID: PAT_TA_105054.pep
PPPLLSFSAPPTRSHQLLPPRGPRCRLSPPNPASATSPAPLVTPPLAPPPLTAPSSNPRAPRVSPQARRRGR

SEQ ID NO: 210637 - protein, 225 aa, Triticum aestivum
  unsure (1)..(225): unsure at all Xaa locations
  Clone ID: PAT_TA_105055.pep
QNLELSEFNKQVLGVLPKLPGSLYFDVTFASSCGFEQTSETAIFGFLGVPLHHGWLVDPQDXELGSSIRKSSYYQLSYILAVYESIRSSTNSGPQKHGGCKDDDKFDSTLVFSLTRSEELGSISCAMISTFLHGPQLTSYGFSSLHDDLKARQPTVLIWNETLITISKVGDQIYVLLNDLSLLSTETGAVWERLTEDSDGLFVDCNFVPTDSEIQSILPSTRPRI

SEQ ID NO: 210638 - protein, 59 aa, Triticum aestivum
  Clone ID: PAT_TA_105056.pep
LFLQGETIHASIWKNLIDTFRSKINEKSIYGFSNFKVVESTKYRPVSNEIKNFLHTIQR

SEQ ID NO: 210639 - protein, 70 aa, Triticum aestivum
  Clone ID: PAT_TA_105057.pep
TSLINMFKNMQTCHGKVIDVYGKLVWQILLLFAMARILLFTWQILVYIAMAKFTLSCQKKKKKKKVDAAA

SEQ ID NO: 210640 - protein, 69 aa, Triticum aestivum
  Clone ID: PAT_TA_105058.pep
IWEVEHLKRKNAAIHTTRMDDLHTMLPIKTSIYTRCTVSSRSISDRAWFGRAVSFILVAESLRMVRHGL

SEQ ID NO: 210641 - protein, 99 aa, Triticum aestivum
  Clone ID: PAT_TA_105059.pep
GGERKSRFLKRKGLRAIGRQGQSCGGIGEEDGKMPRELDLSIRRPGKKQDKKARRTGRGAASTGAEDQSEELPGMASLLGIRPNGERRRGTHRVRIPAG

SEQ ID NO: 210642 - protein, 200 aa, Triticum aestivum
  Clone ID: PAT_TA_105060.pep
RRHTRVRILNGVQAAYWGMLEEGRITQSTANILMRSVDEAMDLVSSQSLCDWKGLRSNVHFPNYYRFLQMSRLPRRLVTYFTVDRLELGCYICAAFLRAHRIARRQLHDFLGDSEIARIVIDESTAAGEEAKKFLEDVRVTFPQVLRALKTRQVTYAVLTHLSEYIQDLGKTGLLEEKEIVHLDDALQTDLKKLQVDAAA

SEQ ID NO: 210643 - protein, 64 aa, Triticum aestivum
  Clone ID: PAT_TA_105061.pep
LCMFCTYREGTSLRKNWTLKSFLCWFFTPHYKNHRASTCPLRMWLEKKKKKKKKEKKKKKKKKN

SEQ ID NO: 210644 - protein, 153 aa, Triticum aestivum
  unsure (1)..(153): unsure at all Xaa locations
  Clone ID: PAT_TA_105062.pep
SRPRRLSVPAQVTVSDAAALAADDPSHGLRFPLIAKPLAVDGSASSHDLCLVYRAEGLRGLHTPVVLQEFVNHGGVLFKVYVVGGRAVCVRRSSLPDVPAERLADPDADASVPFANISSRPALDKGEDSMPPAAFVDXVARGLRQALGLHLLN

SEQ ID NO: 210645 - protein, 62 aa, Triticum aestivum
  Clone ID: PAT_TA_105063.pep
RGRVDRNPGHSTPRGAGLEEFTGTRHVAAFRRVLLLVLIREGGRENKIKRIIPPRGRRKRIN

SEQ ID NO: 210646 - protein, 48 aa, Triticum aestivum
  Clone ID: PAT_TA_105064.pep
MPEDELITILEQRCIVARSYATKMVQVMKDLQMHRQNSRVFAGRHGGV

SEQ ID NO: 210647 - protein, 65 aa, Triticum aestivum
  unsure (1)..(65): unsure at all Xaa locations
  Clone ID: PAT_TA_105065.pep
RPRRLPSAAAPSATPPPRXPRRPTALQRCRQAPPCQGGGTSPNLPASSRPSPSSPSRAPPSRLPT

SEQ ID NO: 210648 - protein, 155 aa, Triticum aestivum
  Clone ID: PAT_TA_105066.pep
AAASTDHHRRAPVGAGAARRKGGRGKNAKQITWVLLLKAHRAAGCLASLASAAVTLGAAARRRVADGRTDADSGAPGPARESPVLRSRFYAFIRAFLLLSLLLLAVELAARFHRWDLAASALALPIIGVESLYASWLRLRAAYLAPLLQFLTDAC

SEQ ID NO: 210649 - protein, 119 aa, Triticum aestivum
  unsure (1)..(119): unsure at all Xaa locations
  Clone ID: PAT_TA_105067.pep
MEVLEEGLLLRTPWREERTLADTLVIAKIKRSYEGAYIVMKRGRVXKGSVPFLDLLNITMGAEEWIWESGKHKCYESVVALISYHPKCEIQLNEXKFLILKESRREVTQYYVRHFVMLT

SEQ ID NO: 210650 - protein, 172 aa, Triticum aestivum
  unsure (1)..(172): unsure at all Xaa locations
  Clone ID: PAT_TA_105068.pep
VPTVELGKLLLAQGLQVTVLLGGGDTSFLXGVAAANLEMSFHCLPPAALAPDVAAACSSSFEARVFELARASNPDLRDFLRSARPAALLIDFFCSAALDVGAELAVPTYFFLTTCIASVAFCLYQPVIHEGTTLSFRDMGGDPVHSPGLPPIPADHLAAAVMDRESLRSTRP

SEQ ID NO: 210651 - protein, 70 aa, Triticum aestivum
  Clone ID: PAT_TA_105069.pep
MDGVFHYLCKMLFLTNAVPIQSNIISEYWWTYMRADPDGLHEIQRLSGAGKLQIPVEKTFPISQVREAHE

SEQ ID NO: 210652 - protein, 68 aa, Triticum aestivum
  Clone ID: PAT_TA_105070.pep
MYSSVIGSLIQQRRPYLLRDAYDDMLLDGVQPVRDTFHNLIVGTMKGSRLQDAFYFRDQMRGRRGREF

SEQ ID NO: 210653 - protein, 183 aa, Triticum aestivum
  Clone ID: PAT_TA_105071.pep
ELLQKREMVGAFQRIPMVMPATDILMSAQRKSRNVPPMKGIQNIAKRERNKGAKQLDALMKELSVPLRTYTENFPRRRDLHPYERSLIELTFGEGYYEKVLGRVDALRKKITSVGKQHASVCAKSLTKREAEERLTEGRKELEEVFQRGQNAIEDLINVAKALRSMPVVDPHIPTLCLVVDAA

SEQ ID NO: 210654 - protein, 137 aa, Triticum aestivum
  Clone ID: PAT_TA_105072.pep
TCCRAWRACRRFTTSCPGTAALSRQAFLARLLVAVSWGAGATLQHALSRQACLRGCSPESHGMLPCSMPYRSKLAGAAACQSLMGCCLAACSVVAWLPARSPESHVMLRCSMLCCGKLAGMAAASGCYGSAGWCPCR

SEQ ID NO: 210655 - protein, 96 aa, Triticum aestivum
  Clone ID: PAT_TA_105073.pep
EAKSKGGAGGKTKTKWGTKIKGKGSLEPWSHAYTWEEDFTASDDDEDELEVEERRPEKPKKKAESKNALENYSYNMRNTIKDEKIASKLPAGRRGR

SEQ ID NO: 210656 - protein, 216 aa, Triticum aestivum
  Clone ID: PAT_TA_105074.pep
QDCGVDLYDEALDDCYGKQNLIKDDATSNCLEGRSWKRYKCKVPHYGDVGATLEYLQKMQHDNPSFFYAVKSDEDGNLTNFLWADSKSIMDFTHFGDVVCLDSGYEVQGYGRPIALFTGLNHHRQTVIFGTALLYDESFEAFRWLFDTFKMAMNSTHPKTLLTDRSAVISEAVAVSWPETAHRFCVWQIYQNALQQLSQAFHGSRTLEYNFKVDAA

SEQ ID NO: 210657 - protein, 159 aa, Triticum aestivum
  Clone ID: PAT_TA_105075.pep
HKPATQTHRRRGLGRHVSALRATSVSATHGSPTPSTSHAPSAADLSCSSSSSSSSPPRTLPYRLPRPPPRHANEAESAVTTLAAAIFATMRLGGLGGCRWAVRARRRGPDMDERRGGGDRKIGEMRDPIFSSSHTYPTRPLCPPSLHLPDLPTLRVRPI

SEQ ID NO: 210658 - protein, 177 aa, Triticum aestivum
  Clone ID: PAT_TA_105076.pep
PRRRKNLKKNVGIQKECVANLEKALHDMRAETAEIKVSYETKSAEALEMMDTAQKKFDEAEEKLLAAKSLEAECSRARNAALRSLQDMEEREDQFRRYRLSSDHEYEAKEKDISLQRKSLNDMKKMLHEKEQVLLKEQSLLNQRDENIVERLARVTQSEKKLEEDKVILEAERMALM

SEQ ID NO: 210659 - protein, 77 aa, Triticum aestivum
  Clone ID: PAT_TA_105077.pep
RPRRLPGSPSAAVLAPGPAAVPEPPPAATPWSMAPQLMPPPPLRVSTPPPLLGFRLGGDSRQGREGWFGRDCFFGLI

SEQ ID NO: 210660 - protein, 85 aa, Triticum aestivum
  Clone ID: PAT_TA_105078.pep
DTKTTTQFTAQSFDKFQPRVRSDRPIILSYVCWHRLALYSLHSKVSIKLGHLFWNGGSSYQGLDFGFLIVHPDGCLSVRILLLGA

SEQ ID NO: 210661 - protein, 67 aa, Triticum aestivum
  Clone ID: PAT_TA_105079.pep
RCELALLYIDQSWFRPSTSTYEMMLPWYCGMFILTMTLLWNVHAKSSQFMLSRIYGRAENITGGFDI

SEQ ID NO: 210662 - protein, 121 aa, Triticum aestivum
  Clone ID: PAT_TA_105080.pep
RGRVDWGWWHTKPLKHVSGFSSHIWSLWERCRQIHYIERPAGGTCRHRIDFNWGLSVGKDSGHASLRGARMGIIQKVMSVLETSRNLNRKLSNLSIQKVISVLETSRNLNRKLSNLSTECR

SEQ ID NO: 210663 - protein, 111 aa, Triticum aestivum
  Clone ID: PAT_TA_105081.pep
NSRPRRPRSDDADSILPSLCLRWPPAPLAKSFSPRASSQELLPPPTTSPALSCQDPLPGDGDGPEVSFYFRRDRLPLAAHISSDEQQWASGHLPRPPSQLIRLGPLPPLSN

SEQ ID NO: 210664 - protein, 153 aa, Triticum aestivum
  unsure (1)..(153): unsure at all Xaa locations
  Clone ID: PAT_TA_105082.pep
AFSPGRTAAGAGGASGAGSGGAADAAPAALXRPSLSRRLRNSGSLKGGQSPMFPPGTASGGRRGRGGMEPAEPSSPKVTCIGQVRVKGGKRKPKHASSSAAAALRSRSRRGGGLSGSEASFRRGADDRDAALHPGAKNQGWVYQIPVNSVDAA

SEQ ID NO: 210665 - protein, 141 aa, Triticum aestivum
  Clone ID: PAT_TA_105083.pep
EVNPTCHRHKKCGKIPLGKPKCGKQFKQLKLGKCGKNNVAIYGKHSHNPNSPDISQVTKQQAIALQRERTRRTRVLRKICLQFFNVLPLGHHLGNITKRNQPPNYVTMKFSHVVRPTILSCVLKMYYSCRQKLSIKISTKT

SEQ ID NO: 210666 - protein, 72 aa, Triticum aestivum
  Clone ID: PAT_TA_105084.pep
LAREKGRTKKEIACKPLFRCVCSSVLSTFGFLYTVQPVSTCMCILNLEYMNVCLQKKKKKKKKKKKKKKKKK

SEQ ID NO: 210667 - protein, 155 aa, Triticum aestivum
  unsure (1)..(155): unsure at all Xaa locations
  Clone ID: PAT_TA_105085.pep
RPRRLLRQQLEEGQXKMQSRLEEEEDAKAALMCRIQRLTKLILVSTKTNIPALTDSSRLQRQNSVSEEDKLSSSQDSTTVVQNDSTSKDTLSSALPDPLDEINGLRSASGDPSSVTGSGQDSMQVGITESDHLDLLIEQVKMLAGEIAFGTSSLK

SEQ ID NO: 210668 - protein, 124 aa, Triticum aestivum
  Clone ID: PAT_TA_105086.pep
RPRRRHPEETNNGSGNWNKAGSSDQVGGSDWGKPKFFGGAGSSSWNKGEAAEGDNQNSTWSRPSGNFEGGRGFGRGRGRGRGRESWDSGDRNDQESRKGSWHNDSSAKPSWGSDTQVGNEVDAA

SEQ ID NO: 210669 - protein, 51 aa, Triticum aestivum
  Clone ID: PAT_TA_105087.pep
LWYVYIMMPFVSPGNTMNVHLFNYFTVFARHNLSYVRRNDLIVLLIIFILC

SEQ ID NO: 210670 - protein, 100 aa, Triticum aestivum
  Clone ID: PAT_TA_105088.pep
MTESLELDLSGRCMPDYILPTTLAKVPNCMPLLRKISLMGNYRLSDNGLDKLISAAPSLSSLNLSECSLLTSTGIENLANRLQSVLSRVDAAASRRGREF

SEQ ID NO: 210671 - protein, 172 aa, Triticum aestivum
  Clone ID: PAT_TA_105089.pep
AAASTPSMPQPQPPPTLPPPQIAADVAPPSYHPQPTPFPASKQHRPSTSPGASIRLHPSRYITAMARSARSAAPRLHRPSLALAPPPSQIPRWSPPTFFSADAPRSAANHPLRHGAAPSQTGSESSQLSLSASSWALPRRSLAGSMHPAAEGPRRIWTLLVQRRQQILRPAP

SEQ ID NO: 210672 - protein, 87 aa, Triticum aestivum
  Clone ID: PAT_TA_105090.pep
RRVDLPACVVGPLPLDQAVAEIEVIKGRAEELSACYSRYSCIGEPVSNLVMLQQQQASGRAADAAAADMLVEARDSAKRQQFLGRRG

SEQ ID NO: 210673 - protein, 92 aa, Triticum aestivum
  Clone ID: PAT_TA_105091.pep
MKLGCSRFLLSCHVLLCLSAIWVLAMADVPAGQRPGCLAKCGDVDIPFPFGIGDKCALHSGFNLSCTNMILDGVKKPQARDIEVTKISLSDA

SEQ ID NO: 210674 - protein, 194 aa, Triticum aestivum
  Clone ID: PAT_TA_105092.pep
TRIAAAAEVPQDDEAIPDGELGEVSVSTYVNSLKNEFATLRSAEIKDMVENNKIKLSTIMQSNRGSSTIWQMSALDGTGLATNLLTPRQDDVSCSTLGLELCLAEKDGGSSQEDSPYGTLTATLGGILTAKNANKPIELPTVSGLPPYTTWVFLDRNQRMTEDQSAFHRQNIYYNADCGKALMFSDSEDGRRGR

SEQ ID NO: 210675 - protein, 115 aa, Triticum aestivum
  Clone ID: PAT_TA_105093.pep
NIVFLHKLIALPKNLHYTWSRSALHRDDRAAPRGIEVHCIAMTVLLQRGVSMHVSAGDCTHVFAALHLYAPHTSEAPKWATNNLQKKGVICGGASCTEPTDALLASGVWTARGDD

SEQ ID NO: 210676 - protein, 105 aa, Triticum aestivum
  Clone ID: PAT_TA_105094.pep
CQIKLGIIHIGWERARTVLSTASAVCLDKTGPLAMAPIQHLQVSAKNEASKFNLTVPASGEIQRIKLPAAMPICLKIQSKHCFHSLHMTKHWVHIAVPDPPICSA

SEQ ID NO: 210677 - protein, 175 aa, Triticum aestivum
  Clone ID: PAT_TA_105095.pep
DFRWKPTAKSPAKIDHCCMPALHDAPILTRREALSWCFSAPTPAPIDTIILFSSFLELKFTHNRGRKVQRDFAYKIQKNAIQIVMHFFHYICTYMFMLARTLFCYHFVKVLDLKTMCMLKRSNNLCEKFKYNDNTCSCITKRVRGGRAFAPHPTRPPVRRLREPEHARPRLPCML

SEQ ID NO: 210678 - protein, 210 aa, Triticum aestivum
  Clone ID: PAT_TA_105096.pep
GRVDRMAQLLDERDLGVLTSVMSLFVSLVSNNAEAYWNCLPKCVRILERMARNQDIPQEYTYYGIPSPWLQVKAMRALQYFPTIEDPSARRALFEVLQRILMGTDVVKNVNKNNASHAVLFEALALVMHLDAEKEMMSQCVALLGKFIAVREPNIRYLGLENMSRMLLVTDVQDIIKRHQAQIITSLKDPDISIRRRALDLLYGMCDVTN

SEQ ID NO: 210679 - protein, 168 aa, Triticum aestivum
  Clone ID: PAT_TA_105097.pep
NSRPRRPSLLKTCLLCLGIFPEDTVIEKKCLIRRWIAEGLFHKEGRYTVHELGEMCFNELVNRNLIQLVIDEHHKLNTCRVHDTILDFIISKSIEDNFVTLVGVPFVPVNVKRKVRRLSIQLDTQGNCIVQKRRLVLSHARSLNIFGNSGEMSRLDEFRHLRIVDFGC

SEQ ID NO: 210680 - protein, 170 aa, Triticum aestivum
  Clone ID: PAT_TA_105098.pep
AAASTPSPPAAADALAQILHALLPPLLLAAASANALHSRWRALHATLLALQSSLVSAPAPAAGHPLFADLVASLLPPLRSLHALSARCQDPALPGGRLRLQSDLDIAASSLTLLLHDLSLLLRSGLLSVDSSASSPNAIVLQVPAAAASRSDKSLFIRDAFARLQIGGLD

SEQ ID NO: 210681 - protein, 151 aa, Triticum aestivum
  Clone ID: PAT_TA_105099.pep
ITLPTKNELVVMTSHAPPWMSAGEGSRGEGYSIVFTARRTAARVCWGRGVMHLHGHVCQTTSRAPTHYKPEMPVLQRGGRTATGGGVPSGGDPVGSVGSWALRSPESPRGRRGQLQAMAALASASPRMSMAIVVVVLHCTGGDCVDAAANS

SEQ ID NO: 210682 - protein, 132 aa, Triticum aestivum
  Clone ID: PAT_TA_105100.pep
GRVDFKHGAEEAKKAYMAAREESGDTTEVASEEKVSSALIDKVDAMLQELEKEIDDVDAQIGNRWQLLDRDHDGKVTPEEVAAAAAYLKDTIGKEGVQELISKLSKDKEGKIRVEDIVKLGSQAEENNTSTD

SEQ ID NO: 210683 - protein, 60 aa, Triticum aestivum
  Clone ID: PAT_TA_105101.pep
RPRRHQFTSLVFKIYMLGMTNSTSSLKAVKKIQPNREVRRTLSSKLQVSIHLTIYRSPAN

SEQ ID NO: 210684 - protein, 85 aa, Triticum aestivum
  Clone ID: PAT_TA_105102.pep
LKEFQEQQRPADESTAPSSTAEESALSIIPSDLSGLDNEHWIGGMEAGSYYASLAQGMLMEPPADGAWQEDREHDDGFDTSLWSY

SEQ ID NO: 210685 - protein, 155 aa, Triticum aestivum
  Clone ID: PAT_TA_105103.pep
ASPGGPSPAGASSAGRRLLRTQTVGNMGESIFDSEVVPSSLVEIAPILRVANEVEAGNPRVAYLCRFYAFEKAHRLDPTSSGRGVRQFKTALLQRLERENDPTLKGRVHQSDAREMQRFYREYYKKYIQALQNAADKADRALLTKAYQTAAVLFE

SEQ ID NO: 210686 - protein, 156 aa, Triticum aestivum
  Clone ID: PAT_TA_105104.pep
MASAAAAALAAAGKRQLSEDDLYLILHKYSPATILTALQEVTQHAQRRSIDWRALVAKTATGITSAREYQMLWRYIAYGYDFVENVEDGSPQPLGDESDLECEIEPSPKPSNEAAAEASRFAKILMYGPSREQGSSHRANSDVPLLNTPNEKSTRP

SEQ ID NO: 210687 - protein, 100 aa, Triticum aestivum
  Clone ID: PAT_TA_105105.pep
AASTRVQADVGRVDAADVVVPTIPSIRTDASGSVPENHEITLQAEADELPETIGTLHCHENNDGYTFMCTTEVGGTSRPRSRGRSWRKLKAKSRACKRKS

SEQ ID NO: 210688 - protein, 64 aa, Triticum aestivum
  unsure (1)..(64): unsure at all Xaa locations
  Clone ID: PAT_TA_105106.pep
VTWMTRNMAISVCISNLPCTWYXILLLCVKFQDKKICFFHDPLQRSTLTTTQAKRQQSVQELVT

SEQ ID NO: 210689 - protein, 146 aa, Triticum aestivum
  Clone ID: PAT_TA_105107.pep
MSFGVDASQDLQLPARVQGDGHDTGVVIRQSVEAVPVRQGWQTGLFDCEDDGCDAFCCSVWFPCAAFACVADIVDQGSDGRCVHFTCYLGAAYFGLWWVYTGWYRRKLREQYGLPETPLPDCLTHLLCHWCALAQEYRELARRGFN

SEQ ID NO: 210690 - protein, 135 aa, Triticum aestivum
  Clone ID: PAT_TA_105108.pep
MATGASGGRTQQNKPSILSTLPKHLPLDFLKSITDQFSEKRVIGKGAFGTVYEGTVPDGETIAVKKLAENSPLPRDRAFNNEVQNIMALQHENVVKLVGYCHESQKKVVQNNGRYIVADIVESVLCYEYLPGGEP

SEQ ID NO: 210691 - protein, 74 aa, Triticum aestivum
  Clone ID: PAT_TA_105109.pep
DDEQIDIGTNLDYKSTSSHIDLNNLNVDNDEPAYAATATEKFGASNLDLPSEFPESEFLVSTRLDPSLVDGEYP

SEQ ID NO: 210692 - protein, 100 aa, Triticum aestivum
  Clone ID: PAT_TA_105110.pep
METGAKAPKKAGRRAGGGGPKKKSVSRSVKAGLQFPVGRIGRYLKHGRYAKRVGSGAPVYLAAVLEYLAAELLELAGNAARDNKKNRIIPRHVLLAIRND

SEQ ID NO: 210693 - protein, 178 aa, Triticum aestivum
  Clone ID: PAT_TA_105111.pep
APSIPPFIVPKQSKLNGDDSVFLKELDDRRYSEVAVAGGGVSVAVTRFPPEQKRPIGPLVLVGVRDGVLWLVDRYMCAHALSLSHPGIRCRCLAAYGDPVSAVKWATRLGREHHDDLAQFMLGMGYATEALHLPGISKRLEFDLAMQSKDLKRALACLLTMSNSRDVGQETTATDVTQ

SEQ ID NO: 210694 - protein, 158 aa, Triticum aestivum
  Clone ID: PAT_TA_105112.pep
YEPPRQLRDLCIQHGFSRVPAWFNCSLLPNLSSLDMEVGDFGEQDVLNFGGLPELTCLWNAIPGGMEFPDGAFPKLRICRVHAPFRFLQGSMQSLESIYIIVHVRALKDASTDLDFIGSLGDLPSVRRVDAQIGCNGASASDIEKVNAAVRQAIDTHP

SEQ ID NO: 210695 - protein, 129 aa, Triticum aestivum
  Clone ID: PAT_TA_105113.pep
MDVSGTGAGAKGNKGAAGRKAGGPMKKSVTRSVKAGLQFPVGRIGRYLNNGRYAHRVGTGAPVYLAAVLDYLAAELLELAGNAAKDNKKSRIIPRHLLLAVRNDEELGKLLAGVTIAHGGVIPKINPVL

SEQ ID NO: 210696 - protein, 208 aa, Triticum aestivum
  Clone ID: PAT_TA_105114.pep
SSINVSDKQHSRNEGHQARTRNENAAESQNAAKAGNGPYSTDVACNGASNLSEKGLRETGEKRKRSTGHHDVQRDDSSDSSVESLPDLEISPDDVVGAIGPKHFWKARRAIVNQQRVFAVQVFELHRLIKVQKLIAASPHLLIEGDPCLGSALVTSKKKTAAANVEKQLLSAKSKDDDDAQLTLQQAEYSKDNTEGNQASPSQDNDVV

SEQ ID NO: 210697 - protein, 80 aa, Triticum aestivum
  Clone ID: PAT_TA_105115.pep
MAGRRAPHVMSLHDSGPPLLGRAPQHPHPGDDRYEPPHGALLRTLEFCSDESTESFSEEQEKALQLLTSLHNLSVSGCCD

SEQ ID NO: 210698 - protein, 107 aa, Triticum aestivum
  Clone ID: PAT_TA_105116.pep
RKGLCQLDLAASLPRTCVPGSDTARRRPLAAACTGHVSARSIGIGAGGHRAHYALAMPPVGRCSQGRRLVGGNVRVRASRVAVIVDGERAEDAACACRPGVELHRRR

SEQ ID NO: 210699 - protein, 165 aa, Triticum aestivum
  Clone ID: PAT_TA_105117.pep
MSTASEWQQDHDVGKKIKSESAAEADRMMAAARRSSSLPAAGAGPGSTPSFNTMTPCAACKLLRRRCAQECPFSPFFSPLEPHKFASVHKVFGASNVSKMLLEVHESQRGDAANSLVYEANLRLRDPVYGCMGAILTLQQQVHALEAELAAVRAEILKHRYRPAA

SEQ ID NO: 210700 - protein, 38 aa, Triticum aestivum
  Clone ID: PAT_TA_105118.pep
KTSSSWKVNFHQATDYIQSFHYRKTRKLQITFRVVHFE

SEQ ID NO: 210701 - protein, 151 aa, Triticum aestivum
  Clone ID: PAT_TA_105119.pep
FLRLPPDEPEHLVRTSLACKLWLGLLSGARFRGLYGEFHGAPPMLGFLYNWFFCSGPKEDDPVANFVSTTKFGALVPDGDGWDRQYTPWDCRHGRVLLGDYTGLIVWDPMTGRRMKLEPPVGYVGAAVLCAARGCDHRACHEGPFRVVVIG

SEQ ID NO: 210702 - protein, 59 aa, Triticum aestivum
  Clone ID: PAT_TA_105120.pep
RVHIVQLCILRNAFFTPLRSNMFFTNIYCDRKEMFHELTNKFWHLLFSPLDALHLIIMP

SEQ ID NO: 210703 - protein, 161 aa, Triticum aestivum
  Clone ID: PAT_TA_105121.pep
PLYILPVPALRHSSIPYRSNSPTLTLALCRSTHIFAMSSHPRYYFSLPTEAPARSRSASRRPPLTPSTVSSPCLTTLVPVTSRRDSGTSTSGSPTKASILLAKVASSPTTPRGETPPGSPMLTPRSRLQSEPAYTSERPSMSRTESDRYVRQYRQQDGYIS

SEQ ID NO: 210704 - protein, 143 aa, Triticum aestivum
  Clone ID: PAT_TA_105122.pep
KGRLVGQRLLLGWAGHSPGWLQRGSAPCQLPPRHSLSSTHPHRLLVAKPRRWQPLTSLYAQKQPVATDRGKLISNNILATTGETKITCFRPGHRRQNEDDGGENVSKQGGKGIYIVANEFVEHHALAIERAKRAPEMLKMKDD

SEQ ID NO: 210705 - protein, 165 aa, Triticum aestivum
  Clone ID: PAT_TA_105123.pep
LNYYKESFSMVPLYHRDKIVLVAFGGNKKDPSDKVEVLVVLQNDHSYSWRSAPDVDPLLYEYSPSTKELAGHLNKCAPLYSNSSVARHSLTSTVERASREEHGALGTSLHRKYGQVEDCSSLAQKLEKLIDDDKYDDVDDCSSCPASTPKDHRSKRTGADTRTDM

SEQ ID NO: 210706 - protein, 124 aa, Triticum aestivum
  Clone ID: PAT_TA_105124.pep
MASTPPPRDLTRLDPAAPPTRDLAGLALAAERSRRPRPRHGSHAATPSGRSPDRRSSSSSACEDFLRKFVDSELLTASLEDWFSGDSEDCGFRKPAFDVPFDLAELQNFDYALEGVTFQQLVRM

SEQ ID NO: 210707 - protein, 100 aa, Triticum aestivum
  Clone ID: PAT_TA_105125.pep
PALLHNRSSASATSLAPDIDPESESICQNLDLVWSVASRSGGDASQLGASPNGGDGGKICRHRGRHGLRRLRVPHADVIFVSNLKLLRWHLHLGEVTRGI

SEQ ID NO: 210708 - protein, 133 aa, Triticum aestivum
  unsure (1)..(133): unsure at all Xaa locations
  Clone ID: PAT_TA_105126.pep
YWEASLSRRNEHPDRVLFLRYEEMLPDPVRSLRTMAELGCAFSREEEERGVDRAIVELCSMGKLKSVDANMKGRRVQASRPXAFFRKGVAGDWSNHMTPEMGKMVDEAVEDGLRGSGFSFADTSFAQMKTTRS

SEQ ID NO: 210709 - protein, 92 aa, Triticum aestivum
  Clone ID: PAT_TA_105127.pep
LGSQYQRRGDDGERDRDRAQPPYRSARRPARCAPLPPSQLLSSLRSHREKLLARRVAAHPAAASSVFLVVVSGGSVRFGAGSVVVYAGSPKG

SEQ ID NO: 210710 - protein, 114 aa, Triticum aestivum
  Clone ID: PAT_TA_105128.pep
DNDLNSAETNVVIVNACLVAAEEALALSIWTMATVCRALSLMLALFTGVLLEKQIVVICPNLGVLSAVVLSIIPMIRPFQWQSLLLPVLPGKLIDFIDAPVPFIAGIQHKPPDI

SEQ ID NO: 210711 - protein, 156 aa, Triticum aestivum
  Clone ID: PAT_TA_105129.pep
IVFFHLRPLEVPFVAPENRYSVSRLAVSNCYRLVVRHGYMDEVITPDLASLIYEKVRNHIVARALEREGEISAKATGAQPEKAMVTETVAGSGISTPARSSTTSARLEALERAYNREVLYIIGKEQMKVKVGTNIVRRFFLKAFLFIRDNSRAKIA

SEQ ID NO: 210712 - protein, 69 aa, Triticum aestivum
  Clone ID: PAT_TA_105130.pep
LATEQSVLQVLHHQCVPLDSASLVSNLPKVSFLCTYSPLCSHFSLIFALIRGCYLCNHDGFFMPSDPIL

SEQ ID NO: 210713 - protein, 58 aa, Triticum aestivum
  unsure (1)..(58): unsure at all Xaa locations
  Clone ID: PAT_TA_105131.pep
YRLGTFHGXPSGCLMYELAHTLRRNTNELLWLACVSLTDQFVHERITNERYQAAVMEL

SEQ ID NO: 210714 - protein, 49 aa, Triticum aestivum
  Clone ID: PAT_TA_105132.pep
QLAAHLEADPFVPSGDDGDPRVWQVGEDGPFHEGAPRVHELQQQVRWQL

SEQ ID NO: 210715 - protein, 101 aa, Triticum aestivum
  Clone ID: PAT_TA_105133.pep
VVAVKRLYKNSYKGVEQFANEVDILSRLRHPNLVALYGCTSSSRDLLLVYEFVPNGTLADHLHHGKDGGGDTLMLAWPTRLGIAVETAAALAYLHAHQVLH

SEQ ID NO: 210716 - protein, 47 aa, Triticum aestivum
  Clone ID: PAT_TA_105134.pep
VAAASGLLDVGCSTSFRSSSPSRSRTANMLARLAILSQIFPRLKINP

SEQ ID NO: 210717 - protein, 118 aa, Triticum aestivum
  Clone ID: PAT_TA_105135.pep
HPLSNPSWSVMLGTCLHFLSSTPQCCLVGAAADGDGGQRVVLREDDLLRNPIHRHHAIIVRTGTSVIVEIVDKIHLQLLSLCLLRNPIHMIPLVFLNLMGNKQSSNIPREENYLKAAL

SEQ ID NO: 210718 - protein, 168 aa, Triticum aestivum
  Clone ID: PAT_TA_105136.pep
ENSDFQLFENHIAVYERENGLPKITVYDLPASGEALGKLQGGREIDFVDPAYAVEPEESQFHSSIIRFHYSSLKIPPSVFDYDMDSGVSVLKKINTVLRGFDSSNYVSERKWAAASDGTQIPISIIYRKDLVQLDGSDPMLLSGFGSYEVLPYWVAIFINQKKIFLPS

SEQ ID NO: 210719 - protein, 73 aa, Triticum aestivum
  Clone ID: PAT_TA_105137.pep
PTVPDQNQWSSWRGQHQLLRTTDPYFNPAPMYVLKIIVELVLYYFAYVLQKVIAQSPAYIAVYGCPGIYKPLS

SEQ ID NO: 210720 - protein, 129 aa, Triticum aestivum
  Clone ID: PAT_TA_105138.pep
THSYDEGLLLCALALAFAVVTTDAQRCGKQGDGMECPNNLCCNKDGYCGLGVTYCNAGAGCQSGACYDNKICGAQAGGALCPSNHCCSSSGRCGYGREYCSNDCQSGPCWDLKCGHLANGRPCPNNLCC

SEQ ID NO: 210721 - protein, 44 aa, Triticum aestivum
  Clone ID: PAT_TA_105139.pep
VLQCQRKERHVVFAFEGGETAGDAHRGVTAAVGVGFHVEHGEGR

SEQ ID NO: 210722 - protein, 87 aa, Triticum aestivum
  Clone ID: PAT_TA_105140.pep
EYSAELAGVPVGAPMRAPEGVAETADGVIAEGASVGASVVGAGGDAIGDGDAAVGGVATGAGAVPGDLAGGAGSGAIWAPAWGPARR

SEQ ID NO: 210723 - protein, 182 aa, Triticum aestivum
  Clone ID: PAT_TA_105141.pep
SKERIELGVDAVIDAGEVDDPAAYPLPKGRIKLDHLRDFLHLRPRNDTIAAVARMRSELTFATHSFFREMGFLCVHTPIITTDDCEGAGEMFQVTTLFSQAQKADGDLRLKLSAGAPRQDEDDGRTVGFESDFFKRQAFLTVSGQLQAEAYACALSGAYTFGPTFRAENSHTSRHLAEFWMI

SEQ ID NO: 210724 - protein, 191 aa, Triticum aestivum
  Clone ID: PAT_TA_105142.pep
ARAHSQALDELDNLSFQGRLLRVKAAKPLNNKTFESSHFAVDEKMNLKERRLEQKKTSEIGGDTRAWNSFYMRQDTVVENIARKNGISKSELLHREADDLAVRIALGETHVIAETKKYLSRSGVNVDALEEHTSKRNEKLKRSNHVILVKNLPYSSSEEDLAAMFQKHGSLDKIILPPTRVFALVVFVEAT

SEQ ID NO: 210725 - protein, 138 aa, Triticum aestivum
  unsure (1)..(138): unsure at all Xaa locations
  Clone ID: PAT_TA_105143.pep
MGIDLVAGGRNKRTKRVAPKSDDVYLKLLVKLYRFLVRRTKSKFNAVILKRLFMSKTNRPPLSMRRLSNFMKGKEEKNIAVVVGTITDDMRIQEVPAMKVTALRFTETARARIVNAGGECLTXDQLALRAPTGENTIL

SEQ ID NO: 210726 - protein, 141 aa, Triticum aestivum
  Clone ID: PAT_TA_105144.pep
EFSCVRRDVLLQVLAAELPTGTIRYSSKIVSIDEHGDGAKTLHLADGSTLRAKVLVGCDGINSMVGRWLGLAKPSHSGRSATRGLARYPDGHGFPPKFLQLFGNGFRFGFVPCNDTDVYWFYTWSPSEDDDDGAEESGTKM

SEQ ID NO: 210727 - protein, 103 aa, Triticum aestivum
  unsure (1)..(103): unsure at all Xaa locations
  Clone ID: PAT_TA_105145.pep
NGVSLHVAESGPRXGPAVLLLHGFPELWLSWRHQMAALAARSFRALAPDLRGYCDCDAPADPTAYTMLHVARDVVALLXHLRLPKVVVVGHHWGAQAAWHSCL

SEQ ID NO: 210728 - protein, 150 aa, Triticum aestivum
  Clone ID: PAT_TA_105146.pep
LQGCRVMITTRKEDVAALAPVRHRLLLQPLGSVESFKLFCSRAFHNSLGRKCPSELEEVAAAIVDRCRGLPLAIVSSGSLLSTKQPTEHAWNQVYNHLRSELRGNNHVQAILNLSYHDLPGDLRNCFLYCSLFREDYEMSRENLVRLWVA

SEQ ID NO: 210729 - protein, 78 aa, Triticum aestivum
  Clone ID: PAT_TA_105147.pep
CAAAAAELGRVIRAQRKGAGSVFKSHTHHRKGPARFKALDFGERNGYLKGVVTDVIHDPGRGAPMANVTFRHPFKYKH

SEQ ID NO: 210730 - protein, 33 aa, Triticum aestivum
  Clone ID: PAT_TA_105148.pep
MESKGGKKSIITSSLMYEAPLGYSIEDVRPAGG

SEQ ID NO: 210731 - protein, 91 aa, Triticum aestivum
  Clone ID: PAT_TA_105149.pep
MGCFQSKPAGKPLPPDADAALPPDDSADPEAANGADGAGADGDDKDGAKRAVPVFREFGLAELRAATKGFSADLIVSESGEKAPNVVYRGR

SEQ ID NO: 210732 - protein, 82 aa, Triticum aestivum
  Clone ID: PAT_TA_105150.pep
RGAGHWTTKHVAVWFHNRRARYKSKLIEVEFSKLRAAHDAVVVHNCRLEADLLMLNDMLAETEEEKNKAMAASAAATGGGGG

SEQ ID NO: 210733 - protein, 140 aa, Triticum aestivum
  Clone ID: PAT_TA_105151.pep
DGKHIPPSHALDLIRGKNILLLMDSSLEGQYANDDASKLVDLASKCLQFEARDRPNIKYLLSSVGPLQKQKEVASHVLMGITKTASVLPTILSPLGKACAGMDLTAVHDILLKTGYKDDEGAENELSFQEWTQQVQEMLN

SEQ ID NO: 210734 - protein, 148 aa, Triticum aestivum
  Clone ID: PAT_TA_105152.pep
AAAGASSATAATSGSAAGAASSFTSSATAGSASATASLVSVSTTAGSFGASASGSAAAAGSGSLVSFVSAAAGASSLVASTSTGAGASTSASTGAGTSSVLATSSAATGVSTAGASSVSAAVGFWTSAVAIAVVDARKCPEWQTLQAS

SEQ ID NO: 210735 - protein, 158 aa, Triticum aestivum
  Clone ID: PAT_TA_105153.pep
TGAERYHKRHRVCLRCAHSSAVMIDGVQKRYCQQCGKFHILLDFDEDKRSCRRKLERHNKRRRRKPDSKGTLEKEIDEQLDLSADGSGSGEIREENIDGASCDMLETVLSNKVLDRETPMGSEDALSSPTCTQLSLQNDRSKSIVTFAASAEACLGAK

SEQ ID NO: 210736 - protein, 92 aa, Triticum aestivum
  Clone ID: PAT_TA_105154.pep
NTNQGLHPIPSNLEESCCGGSCGCGSACKCGNGCGGCNMYPEVEAAGATLLVAATATHKASSGGMEMAAENGGCGCTQCKCGTSCGCSCCSC

SEQ ID NO: 210737 - protein, 85 aa, Triticum aestivum
  Clone ID: PAT_TA_105155.pep
MQCFRFASWDKERDKEELQVPARSQSARSNSSISTDHDARRSGSECCSLTVSSEISVESFGRYRQLSLPQRPNNDLRIFTFQELK

SEQ ID NO: 210738 - protein, 138 aa, Triticum aestivum
  unsure (1)..(138): unsure at all Xaa locations
  Clone ID: PAT_TA_105156.pep
MAGTVPKLAALAFAPSARRFRVSLAGRARSPVIAMASAKEGNGAVTKRTTLHDLYEQQGQSPWYDNLCRPVTDLLPYIANGVRGVTSNPTIFQKAISSSNAYDGQFKELISXGKDAESAYWELVIKDIQDACKLFEPI

SEQ ID NO: 210739 - protein, 226 aa, Triticum aestivum
  Clone ID: PAT_TA_105157.pep
AGGFPLVLDFAIRDGSCERDGCLSGNSSCAKAANDAGGYVCKCREHYNGNPYITDGCQDIDECRLREQSPEFRDLYPCDGICTNIPGGYDCRCKRGMKGDAKKGNCAEIFPLSAKIIVGLAGLIVVFVIIVMAKQHLKLKKFYAQNGGPILNGVKNIRIYTRKQLKQVTNNYECVIGQGHFGKVYKGTLKDTQQVAVKKSIRVDKDVKKELPDEGIIQSEMRNKNI

SEQ ID NO: 210740 - protein, 93 aa, Triticum aestivum
  Clone ID: PAT_TA_105158.pep
MGFTKPPVQALKSANKLKRKELYVQYKKHQNKEKHEERHNRRREEAKDPELKAARLAKRKPATIDSKRVWDDVDDDSLGVQVDLERLKKRCIE

SEQ ID NO: 210741 - protein, 181 aa, Triticum aestivum
  Clone ID: PAT_TA_105159.pep
MDSSNGKRKHRGYLTWTDKMDWALLDVLVEHHNNGNHTANGWKPHAYSAAVKNVREKCNVEITRDHVLSRCKTFDKHCSTISKLLDRSEFGWDRNKSMIVIHNEDAWKVYIQKNKAAACYRNKVIKNWDAISLIFSRDYATSEDESAGAENAQEMALKGAEDVRELIQIHLQHLNLAVKTR

SEQ ID NO: 210742 - protein, 112 aa, Triticum aestivum
  Clone ID: PAT_TA_105160.pep
CSPHHSPMASFQITPFAGLLENTEFNFHSLYLHNISSGPNPTRGAIINDNAINGWGQPFVVDWTIYDGTGHGAKLVSRAQGQHIYARKWRHFVSLECTNGMFKVSTLQLMEL

SEQ ID NO: 210743 - protein, 127 aa, Triticum aestivum
  unsure (1)..(127): unsure at all Xaa locations
  Clone ID: PAT_TA_105161.pep
GGTGCCFNRQALYGSDPVLTEADXEPNIVXKSCCARRKXKKSKSYMDNKNRMMNRTESSATIFNMEDIKEGIEGYEDERTMLISQTRXNKLYGQSTIFTTSTFMTTGSIPPXTNPASVLKESIHGIH

SEQ ID NO: 210744 - protein, 233 aa, Triticum aestivum
  Clone ID: PAT_TA_105162.pep
GNNGCLCCTVRGDLVKMLLKLVKQKGDKFDHIVIETTGLAKPGPVIETFCSDELVSKYVKLDGVVTLVDCKHAMQHLNEVKARWVVNEAVEQVAYADRIILNKTDLVDDAELEVLTNKIKLINGMAQMKKAKFGDVDMDFVLGIGGYDLDRIEAAVQLNENKETGGHCHLGHEHGHHHDHVHDAAVTSVSIVSEGLLDLDEVNDWLERLVDEKGEDLYRLKGVISVNESTGRF

SEQ ID NO: 210745 - protein, 215 aa, Triticum aestivum
  Clone ID: PAT_TA_105163.pep
MASPQIGWIGLGSMGLPMATNLQKHLSSTAAPNLIYFNRTICRGDSLKDIGAQPASSATDLVDNSDIIFMSLSDDSALDSTLNAILDSEDSGKLAGKLIVDTSTVHPDSSAKAETRIQEKGGQFIASPVFGASPVAAQGKLLWIIAGPNAAVDKVTPYVEGVMGRAVIRVGEDIRASGKMKTAGNFITAGFMEIIAEAHVLAEKSGLGSGNLEAL

SEQ ID NO: 210746 - protein, 190 aa, Triticum aestivum
  unsure (1)..(190): unsure at all Xaa locations
  Clone ID: PAT_TA_105164.pep
MGSIWNAFTGGNKSGHQQQQQQQSQSYSQPTTQEPAHYSSYDPTEGQGVESFLQSSTFADPSQLHPLAGLNRDTLEYISLEDSALSELPGGQSVLPSRGFTDDLCYGAGVTYLGGLGVGGAWGLQEGLRRSAGQPPKLRLNAVLNSVTRRGPFLGNFLCVVAIIYNCTNLXIGSLRGKHDAGNTILGGAL

SEQ ID NO: 210747 - protein, 100 aa, Triticum aestivum
  Clone ID: PAT_TA_105165.pep
HTHHHSLLIELSTAIFHSLSLYLLHRTTLTYKTRTQTKSPPLHTHTKKSMHNIKTKPAPGAAPRRRPRIFTLPAYSLRVQFVPRGVAALCGSFRHRIEFV

SEQ ID NO: 210748 - protein, 238 aa, Triticum aestivum
  unsure (1)..(238): unsure at all Xaa locations
  Clone ID: PAT_TA_105166.pep
GKLVNTMAVDHLAEKLGNQELMTLTKQLYYSTTHVIGVGIRGERPERIGDKCWLHFPEDNCPFYRATIFSNYSPYNQPQKDAKLPTLYLANGEKAASSEAKEGPYWSIMLEVSQSTMKPVDVENLLKDSIQGLINTEMIKPEDEIVSTYHRAFDHGYPTPTLEREGVLKQVLPKLESMDILSRGRFGSWRYEVGNQDHSFMLGVEAVDAIHSGAVELTLKLPDFVNXRQNTERRLTQN

SEQ ID NO: 210749 - protein, 206 aa, Triticum aestivum
  Clone ID: PAT_TA_105167.pep
MPASSPKSQKSAPRSPTSSRSVPNATQTIEVDTVVGEDEEDEVDPGLGADAESSTASITSSILHYRTINGRTYHSERGNAAYWGSNDERQSEAMDIAHHMFTLAQDGELHLAPLDKDIQKVLDIGCGTGIWAIDFADKFPGCEVIGTDISPIQPSWVPPNLKFEIEDCNQDWTFPPDSFDYVHIRYLVGCIPDWNQLLEQATGPQP

SEQ ID NO: 210750 - protein, 182 aa, Triticum aestivum
  Clone ID: PAT_TA_105168.pep
MASFNVEQAIGAMVVSKNEARSSPEGTAVLFGSQVIPGTSKVFATDASFGAAILNVDAKTCEATTVATGAVEGQAATCWVAISPVTKTAFVTDVGRNRVVEMSLEDASVVSELDLTCNGDPGLIDLAAAGNFIYALSPGNGTTEAAVTVLDVSGGSGSAKMVQHFELKGMAGKTAMGMKVMM

SEQ ID NO: 210751 - protein, 174 aa, Triticum aestivum
  unsure (1)..(174): unsure at all Xaa locations
  Clone ID: PAT_TA_105169.pep
RDKKEIEDLGNTLVDRLRNGSNHYIALHLRYEKDMLSFTGCSHNLTRQEAGELREMRLKVRHWKEKDINSKERRLQGGCPMTPREAALFLKAMSYPSATNIYIVAGEICGGHSMDEXKADINGHHLATTXDRALXXXXXKLYQNRLAAVDYNVALQSDVFVYTYDGNMAKAVQX

SEQ ID NO: 210752 - protein, 224 aa, Triticum aestivum
  Clone ID: PAT_TA_105170.pep
AGLEERIETETALSVQHKEKSDAACNAKELLETQLYSANAEVQKLHGIIKSLENQVEEEKALRDELMIQSLLKIEAAVEAVKEPLEAQLCSANTEVEKLRGIIEALESEIEKERTVHEELTSQLDMKIEAERTHSEAVKESLEGQLCSANSEVAKLRDIIKALENEVVEKEKASHEKLAEKAEKSISAESVKESLEAELQLVNSEVVKLRDMVTALEHEVVKEK

SEQ ID NO: 210753 - protein, 113 aa, Triticum aestivum
  unsure (1)..(113): unsure at all Xaa locations
  Clone ID: PAT_TA_105171.pep
MEVVTGAMSTLLPKLGNMLKDEYNLHRKVRGEILFLTAELERMEAALIEVSEAPIDHPPSKLVKLWAKDVKDLXSYEIEDXVNKFMVHIFCRAXDKAHSFMGFIHRIIYLCTR

SEQ ID NO: 210754 - protein, 106 aa, Triticum aestivum
  Clone ID: PAT_TA_105172.pep
SCQRDPGGIQFSGSGSAKSDLDLNARAALDRVDALRELRTVFLSSPTLVSLVERIQRSRRPPLSHHDAAAARTARKHMVLYCGNAGMLMSLMRMSTTTSTFSCSTC

SEQ ID NO: 210755 - protein, 103 aa, Triticum aestivum
  Clone ID: PAT_TA_105173.pep
WHALDRGMRWRPYYPMARRTTATATWTAVSAGHAPHGDADAQARLRSSGAEQQRPWCFPTDGGVREVRKRGEHGLGMGGGGGGDARERGRERSETNPSHRTPP

SEQ ID NO: 210756 - protein, 192 aa, Triticum aestivum
  Clone ID: PAT_TA_105174.pep
MAPSLLLLPSPPHPSSPSTLSAAYSAPLTSVLQKLKSASSPQTLVVGLALPILTGPSANSKQIAWPIAQSLLASLYTLTSVVCAKEDIPVDVGAGKGSVDVRVVLIDHEKGRRYEPNFEGQFEANCTAVLDLAAFATKVRTWDMVYHPSCEEGYELLSTFLQLAEKKQTFMQNQLVAIEGGISLTTEEKLNT

SEQ ID NO: 210757 - protein, 200 aa, Triticum aestivum
  unsure (1)..(200): unsure at all Xaa locations
  Clone ID: PAT_TA_105175.pep
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCLHKMDATNSQYSKARYEKIVKEVSFYLKKVGYXPDKGPFVPIXGFEGDT

SEQ ID NO: 210758 - protein, 90 aa, Triticum aestivum
  Clone ID: PAT_TA_105176.pep
ALVTWYIFKRHSVVTMYLCPLFHRYIKHCPKIHYLFSKSSYCGMKLLSHGKVVHQGGFSFKSAPDDTFQIKQTLYQQQLSWRSYIKMLFL

SEQ ID NO: 210759 - protein, 147 aa, Triticum aestivum
  unsure (1)..(147): unsure at all Xaa locations
  Clone ID: PAT_TA_105177.pep
WFQHMEPDLQMYAQNPEVNVTXKHIYTRWANVFKKVGEKTNRTLDFSNQKLEKLAKAANFTNVTYQSHKIPVGRWPKDKKKKELGTFVGLAFSQALDGFIKLPLCGILQWSPEEMQMFAVEMRQSIMDLKTQTLGYVFSVYGQKPEA

SEQ ID NO: 210760 - protein, 64 aa, Triticum aestivum
  Clone ID: PAT_TA_105178.pep
DMLDNYLTGSDYSFCKCKKNIIVFTTSTTEYLYVFLDLDWILKRQSNLSSRLCPRRFQDLYLYS

SEQ ID NO: 210761 - protein, 217 aa, Triticum aestivum
  unsure (1)..(217): unsure at all Xaa locations
  Clone ID: PAT_TA_105179.pep
MELNGATLSLLSLISLVILVSMLSRKLAPRSKKQQPPGPCCLPLIGNVHHILTSKLPVVLRDLAKKHGPVMYLRLGQVDAVVVSSRSAAEEVLREKDICMASRPILMVSEILLYGNLDITFSPYGAFWRTLRKICTVELLSERKVRQFSPVRDNETMSLVKNVRVAGRGGNLFNLGRLLVSCSNSITGKTAFGEMCSSEXQEEFLXAMDXGLKLDAG

SEQ ID NO: 210762 - protein, 238 aa, Triticum aestivum
  Clone ID: PAT_TA_105180.pep
GGTRAMDLPPGSSSWLHTTPTNQSPVPAADFHPDPHWFPHWRRPPSTSPSTPATRATTPTAALHGLPRCQIGSGLAFDYRIRRTTASLAARSGRARPLTAGSKGHGLPHLPPSTFRRRCYRPPSNPLAMLAPPTNSAAWSCSPRHVASWSVGVGVQCGASVRAVCDDGCGKPNAKQHLPATAVDGQSQRKPSPGRHSPLLHVATSGSPDILNPLNRKRRVRVHGSGEQRKKDGARDEV

SEQ ID NO: 210763 - protein, 119 aa, Triticum aestivum
  Clone ID: PAT_TA_105181.pep
VGKVLPELMPKLTGMAFRVHPAHVSVVDLTVRLVKPATYDQIKAAIKEESEGNLKGILGYVDEDLVSTDFQGDNRSSIFDAKAGIALNDNFVKLVSWYDNEWGYSTRVVDLIRHMHSSK

SEQ ID NO: 210764 - protein, 71 aa, Triticum aestivum
  unsure (1)..(71): unsure at all Xaa locations
  Clone ID: PAT_TA_105182.pep
GGXYVXQTISLSFGALAVNDVIAAVVCVLLTEYVTKFYYSRPKVTFAVALLNNFKMGFTYGLFIDAFKLAS

SEQ ID NO: 210765 - protein, 161 aa, Triticum aestivum
  Clone ID: PAT_TA_105183.pep
GDVRDTSIVKLPLCVIKLQKLQYIRAGTIISSDEGDESVASVPTTNTSTLPETRREVQTSASPEGSDDMVTALTETRLLWSCRPCSLVSSWLSKLRRHRLDNDGVEVPEGIGSMTALHTIGVDNVNIPNGKAILKELMKVTQLRKLSVSGINGHTYKICFM

SEQ ID NO: 210766 - protein, 194 aa, Triticum aestivum
  unsure (1)..(194): unsure at all Xaa locations
  Clone ID: PAT_TA_105184.pep
MDQTQRLPEDVLADVLRCLPPRSLAAARCVCRSWHAIVDAHRLLDRDLLPLSLAGFLINFCELDFTEFFFHPSAIRRYADLHFMPTDDISVEDVCNGLVLLDHYVVNPATRRWASLPPRPSPPLGFELFYYERNYIVFDPTVSPHYQVLRFLHVPXRGRGLDAETKQQQWPPSPYMMHVFSSETTRWEERSFIX

SEQ ID NO: 210767 - protein, 90 aa, Triticum aestivum
  Clone ID: PAT_TA_105185.pep
VEVVVVCCQDLLSLNTWLCFCVLLSCCLCWMDSIPVQVLARFYLFMQILLGVATLGLFINITKQRCLHFNTCISVLKLLKYLLVLTQSRT

SEQ ID NO: 210768 - protein, 237 aa, Triticum aestivum
  unsure (1)..(237): unsure at all Xaa locations
  Clone ID: PAT_TA_105186.pep
GVFTPIMDRPDRIPPSRFDLHLLDIDSHTMWMVELLDCRHGRVLLMDTLWDEVIMCXPITGEQRRLTVPPEFVRNRFTGAVLCAAIDHDHVHGSCHLSPFNVVLISALGGNNQPIACVYSSETGEWGDIIPSSVSFELFYDHTPGLLVGNALYWLLDSIGHDILKFDLDKQSLTVIRGPTLTNDFRHGSHCIIQAGDCAIGFAILTYPHLQMWHRNINFDAVATWVLWKTIDMRMII

SEQ ID NO: 210769 - protein, 196 aa, Triticum aestivum
  Clone ID: PAT_TA_105187.pep
RIKSSDLNWGKPTLETCNRAADDTSKPVDRIELCIFFIKNVALVGSSEQVSILGLSKENLPSSGWQQLQPLNRPNNVKSLVFNPWPSCPLMHAFLFCSYQNISVDVYHLVRCKRTSNFILDCFFSSLEAEIKNTFPHETYSQLKQKFMIDTLALLSRLAPGLNLDEEFNLRLEHQDIRLISPMYIHHMEAHSIFPR

SEQ ID NO: 210770 - protein, 197 aa, Triticum aestivum
  Clone ID: PAT_TA_105188.pep
GDWYPRHSRRRWRWGDWRIRHRDSVVRRRRRDCQRRFGWFLDRVPRKKMSAAGVNGSDNKRSRSSRDDPLALPEKKKKVIVWRDPDAWVISDADLAKMKRDEESAPPPVKIPTLDYFKPPTRFHTAELFPVSESGSKAVLSAAKFLLGVSSSLDGEPLRRCSGFWVDWDEDKKTGLVLTTAWLIRTKDAPFNVWSGG

SEQ ID NO: 210771 - protein, 204 aa, Triticum aestivum
  Clone ID: PAT_TA_105189.pep
MAAAFSSTVGAPASTPTNFLGKKLKKQVTSAVNYHGKSSKANRFTVMAAENLDEKRNTDKWKGLAYDISDDQQDITRGKGIVDSLFQAPTGDGTHEAVLSSYEYVSQGLKKYDFDNTMGGFYIAPAFMDKLVVHLSKNFMTLPNIKIPLILGIWGGKGQGKSFQCELVFAKMGINPIMMSAGELESGNAGEPAKLIRQRYREAA

SEQ ID NO: 210772 - protein, 225 aa, Triticum aestivum
  unsure (1)..(225): unsure at all Xaa locations
  Clone ID: PAT_TA_105190.pep
GNLQTLQALEVQEESLRHLGELRQMRSLRLCNVKGIYCGRISESLVQMPYLSFLDVIASDENEVLKLNVRVPSLQKLTXRGRLAEGALDETPPFQAGRGQNLYELHLFWSQLREDPLPPLSRLSNLTRLDLTTAYSGVTGWFPKLKVLCLRDLPDLSRLEIHQGAIEILEELILINLSSMTDVPPGIEFLTSLKNLGFYKISRDFLTSLRQCAAIRGKWRYSLRD

SEQ ID NO: 210773 - protein, 61 aa, Triticum aestivum
  Clone ID: PAT_TA_105191.pep
QPTNNSLQFYDHFPPAVLNIMRTYIALCKRKKYVYFRKQNVEETYKKDVAWLMFRSLLYRL

SEQ ID NO: 210774 - protein, 129 aa, Triticum aestivum
  Clone ID: PAT_TA_105192.pep
EELLKFFSTYDKTLDIFAFLRLLVAIQICSHSEEYVPHIPVVASGDCSLEVWCFRRVTPAGVESEYLMMRALASALEVILIVETFQERYTQDIYTDPGVPRTAVTLLYNGDHYYIMYPCATSCESTSHE

SEQ ID NO: 210775 - protein, 84 aa, Triticum aestivum
  Clone ID: PAT_TA_105193.pep
QCFAWRLCGGFPHHRMWHMPSCLASLLYFSCASDIGPVCSKWLLCSSNYVSLRYVCVICELITNFGHDYSHTFWANNKFARSHV

SEQ ID NO: 210776 - protein, 187 aa, Triticum aestivum
  unsure (1)..(187): unsure at all Xaa locations
  Clone ID: PAT_TA_105194.pep
RTVSDNITQTDGILQINITELNNILILKPIEGWRKPTLGILLINVHATYDRNSGYGRTGVVIRDCHGNYIASSHRYLMHVVHAAMAEAYAFRGIXLAQHIGINVFAVQTDYMQVVETMQDGGFLATESSAVYGDCNNIFDXGFDRVLVEYRNREAIVVAHKLARNAFVTHNSCIWDDDPLVLSLNRL

SEQ ID NO: 210777 - protein, 234 aa, Triticum aestivum
  Clone ID: PAT_TA_105195.pep
GDATRRRGFIIQHNPFGLVFAGTFPSWIVREDGDFVLTLNDAHTYMRLNGSGFVEFAKQEARSSVLWSAPESFCDFESYCGPYGICKRSGLCICPAGFDPLSTTSRSSLGCSREVPMNCEGDNSTHRKGVFNPIDGVYKLPKNSWPSNARNLKECEASCLKDCTCTAFAYNVTCLLWFWELRNTVVLDSGSNGNRLYIRVATKQQDGHLGFRAAPLFLTAMATLTIIVIVIGLT

SEQ ID NO: 210778 - protein, 187 aa, Triticum aestivum
  unsure (1)..(187): unsure at all Xaa locations
  Clone ID: PAT_TA_105196.pep
MSAPASSSKRSHGPAAHSADRLSSLPDPLLHLVMSFLPMREVVRTSLLSPRWRDLWASVPFIHLDFKEFVDATADSFVIGVDDHDWLKLDENRLQKFGDHLLLLRDGAVPLDEARIFIGGADLSDXYDLWIHHAIKHKARLLHVYAHRLRVEFNDRSMISAQHLEIIRLQEVTLTDTCLRSLKFYYP

SEQ ID NO: 210779 - protein, 98 aa, Triticum aestivum
  Clone ID: PAT_TA_105197.pep
MHRWYFRNHLQRYGATPKSALKAYFLASANIFEPGRAAERLAWARMAVLAEAVTTHFRHIGYVCSLIVSPLWNLVLVMIDAKCLCNSLQGSMLFNRES

SEQ ID NO: 210780 - protein, 164 aa, Triticum aestivum
  Clone ID: PAT_TA_105198.pep
AGVYLKLQPYAQMSVARRANHKLSFKFYGPYEVLARVGKSAYKLKLPTNSRIHPVVHVSQLKPSLPANQVPSDASLHLLTDVPVSIQPGQILDSRLVRAGNGARAQVLVHWAGLSSNLNSWEDKNALQHRFPSTAAWGHAVSQGGGHATHLPCGPAKTKASPRS

SEQ ID NO: 210781 - protein, 228 aa, Triticum aestivum
  unsure (1)..(228): unsure at all Xaa locations
  Clone ID: PAT_TA_105199.pep
AGGTKNDIALSLGWGKKNPATDQQAVKSLLEQVKGAREMCIDSWHVMVRLRLREEGPCDPIRPLELPDSLHVFHRANCSHFQKSHLNVTGYHTFHGGFWSSFSMGLDAQVSYNFHSARKLHPEKFIDKGTYDKLGLKQGGFAASPSQPSSRNIGHIAKVKVMKRPGGRWEELMIPYSTRSVVCLHLPSFSGGVDPWGVPGTRKKQDRALTAPYIDDGLIEVVGFSXTW

SEQ ID NO: 210782 - protein, 231 aa, Triticum aestivum
  unsure (1)..(231): unsure at all Xaa locations
  Clone ID: PAT_TA_105200.pep
RGLHKLLLPEARCAMLPGSALLLSRTKGIDMDIMWCIVDAFAQQNKHAQFSVGPDILPTTLNSLLRVKRRRSVRRKPLQKLLSMKSSGTEGVNCSITDSSLQKGDVSGRTRCPEIDTSFCSPPCELDLHRVCPTDGFNLLLVLHHIDPISVANGQSILALLTLLSMVGDCSKAAVNTQHYRIRKSRHNKGCRVLSRQCSAQKTRDHKRXDTRDAAFQKNRRLTXRSEPMSA

SEQ ID NO: 210783 - protein, 196 aa, Triticum aestivum
  unsure (1)..(196): unsure at all Xaa locations
  Clone ID: PAT_TA_105201.pep
MPAGGFSASSALPSGMEFEPKITPTVVTSCVTAATGGLVFGYDIGISGGVTSMEDFQREFFPTVLRKSRENKGSNYCRYDNQGLQLFTSSLYLAGLVSTLFASYTTRRLGRRATMRIAGAFFIAGVIFNGAARSLGMLIVGRILLGCGVGFANQAIPLFLSEIAPITIRGGLXLFQINITVGILFANLVNYGTNRI

SEQ ID NO: 210784 - protein, 102 aa, Triticum aestivum
  Clone ID: PAT_TA_105202.pep
MAAAFSSTVGAPASTPTNFLGKKLKKQVTSAVNYHGKSSKANRFTVMAAENLDEKRNTDKWKGLAYDISDDQQDITRGKGIGDWLFQAPTGDGSHDAELSYY

SEQ ID NO: 210785 - protein, 126 aa, Triticum aestivum
  Clone ID: PAT_TA_105203.pep
GADDQQTPDQHSCQALVDDLVKLPLAVPASYLVFLRRFRFKSTMFSQLPAAAAAPADVCQSSPEFDSPVGRRTVEEVGAQPRTGEGGGCDRKKSALDEAAAADGGVGERPHRTGEAADVRSGDDPR

SEQ ID NO: 210786 - protein, 189 aa, Triticum aestivum
  unsure (1)..(189): unsure at all Xaa locations
  Clone ID: PAT_TA_105204.pep
MAYAYRWRRNLCTLMRFLPQVERPDQPVSLHDKYFYTAASVFIFMAASQLPLYGFKPGMGIDPFYWVGMAFASNWGTLTTFGILPVFVPEFLVPVCISRILKVSSRTPEGRMLLDGAHKVVGICTNIVMVIIFMLVYAILVKVDTCTAVVMMLQLFFSGVVDLYLDEVLKXGYGLLPSISLFTATNICV

SEQ ID NO: 210787 - protein, 82 aa, Triticum aestivum
  Clone ID: PAT_TA_105205.pep
GGIVQIWFLLKSLLKAQPACWRRRFHHESRRPPPSPQQLKPTATNPLLPVLGTYPPCPLQLMAAFRKEVHIARYKWSKGIIV

SEQ ID NO: 210788 - protein, 182 aa, Triticum aestivum
  unsure (1)..(182): unsure at all Xaa locations
  Clone ID: PAT_TA_105206.pep
MSASVLDYTKALEVLKEYKQRDGLDIHELMDTTKHGGLTYNDFLLLPGYIGFAASEVTLDSPITKRITLRTPFVSSPMDTVTEHEMAIHMALQGGLGVIHHNCSPEAQADMVRKVKRYENGFINDPIVIDQNTTVGEAKALKEKWGFGGFPVTEDGKLGSKLVGIVTNRDLQFEEDLDQAVX

SEQ ID NO: 210789 - protein, 56 aa, Triticum aestivum
  Clone ID: PAT_TA_105207.pep
MLNTLFVHNIRHYYIQYANIRRYYIQYASILNVITSCFMELREYNKISCLGLRTTN

SEQ ID NO: 210790 - protein, 238 aa, Triticum aestivum
  Clone ID: PAT_TA_105208.pep
AGSMFAAKAGAKHVIGVDMSTIIFKAREIVKINGLSDKITLLQGKMEEVELPFPKVDIIISEWMGYFLLYESMLDTVLYARDTYLQKDGLIFPDKATIFFAGIEDGDYKEDKIEFWNDVYGFDYTPLKATALSEPLVDTVEVKAAVTDPAPVLTLDLYTCTVADLAFQVPFKLSAKRDDFIHALVSWFDIDFTACHKPIRFSTGPHTKYTHWKQTVFYFEDVLTVQQGEEITLNLDVR

SEQ ID NO: 210791 - protein, 174 aa, Triticum aestivum
  unsure (1)..(174): unsure at all Xaa locations
  Clone ID: PAT_TA_105209.pep
GRRDNNNPSKGRYRELYRVLXPDFEVIKILTELLXYRLDTGMYEIELNHRRLLDGMLEICGMPSEKFRTVCSSIGKLDKLTIEDVKKKTTVXMEEKVVPDETXEKIGSLVKTRGLALEVLLELXNEGSKFMENAGSVVVWPGILCSVYPRILLQFLPPDETQDLRLQLINSAPS

SEQ ID NO: 210792 - protein, 111 aa, Triticum aestivum
  Clone ID: PAT_TA_105210.pep
HSVFYMWRITDNNVWRTIAWRMWDNIVKQFETQEAFATITDVNRKGSDKRDNMETFWMSETIKYFYLTFEDPNVINLDDWVLNTEAHPLKRPKGEELETPQKKTSWWKFGH

SEQ ID NO: 210793 - protein, 48 aa, Triticum aestivum
  Clone ID: PAT_TA_105211.pep
GYTATLLLNNHNALHLINTHCPAHLECKRYTNYPCGINITRSLIMYSS

SEQ ID NO: 210794 - protein, 207 aa, Triticum aestivum
  unsure (1)..(207): unsure at all Xaa locations
  Clone ID: PAT_TA_105212.pep
AGCSESLLQLKLKDLDGLQQLTVVAPTLKELSVILCFAPNQPIASVSAPELVSLQWNDAYDPCSVQLGEMAHLQCLHAGIFLVYGPVDFTPNRDCLRILQDFKVMHSLTLLLLYNPDIGNNRYLMEDMTRLPDVTCLSLTVMSNGHCFGASSFHILGLCTGVRKMALNYFEAQTPCPSRCICDQATHWXTEKLVLDRLREVEMSELW

SEQ ID NO: 210795 - protein, 189 aa, Triticum aestivum
  Clone ID: PAT_TA_105213.pep
MAAAFSSTVGAPASTPTNFLGKKLKKQVTSAVNYHGKSSKANRFTVMAAENIDEKRNTDKWKGLAYDISDDQQDITRGKGIVDSLFQAPTGDGTHEAVLSSYEYVSQGLKKYDFDNTMGGFYIAPAFMDKLVVHLCKNLMTLPNIKIPLILGIWGGKGQGKFLQCELVLPKMGINPIMMSARELKSGYS

SEQ ID NO: 210796 - protein, 227 aa, Triticum aestivum
  unsure (1)..(227): unsure at all Xaa locations
  Clone ID: PAT_TA_105214.pep
GENAFNTSFAEEVGVDIDKLLIAQPDSAENSLSIVNTLVGGSIDVVVVDSVAALIPKCELEGEIYMKFKDAQSRLMTRALRKIQYTLSRSETLIIFVNQVRTKRSSDPSSGLYKEVTCGGNALGFYSAIRMRTSRRKLHYCKEEATGISIAVQIIKNKLVPAALKEAGLNIGFGKGICHESEILEMASTHGVIVKEGSGYWINGDFLPVKEEAEXFLLENEAVAYDI

SEQ ID NO: 210797 - protein, 230 aa, Triticum aestivum
  unsure (1)..(230): unsure at all Xaa locations
  Clone ID: PAT_TA_105215.pep
RDRLTSAVGGPFMDSSKPEYFDLEKFVKWLMDEINISKPFPAKTRCSFGEVSILIFMFFTLMFRNWHQPGSDGSHSKSGGSSDLTEKGHVQVPVSTTGPSSSSDDKDKNEFASQLIRACSALRQQSFLNYLMDILQQLVHIFKSSSTNGEGGSGSGCGSLLTVRRELPAGNFSPFFSDSYAKSHPTDLFMDYNKLLLENTFRLVYSMVRPEKEKSAXKDRSYKVPNAKDL

SEQ ID NO: 210798 - protein, 80 aa, Triticum aestivum
  Clone ID: PAT_TA_105216.pep
GGCKEIRPETTIHSARFSRHRSINVSLSLPQVLSPALAGEEFGFSLSLHIQIQGRCRRHEHCLLDATLRGRTAVKRVAQI

SEQ ID NO: 210799 - protein, 60 aa, Triticum aestivum
  Clone ID: PAT_TA_105217.pep
VLTFEHFKFDQFGFELIPSFDHIRRTVYPIQLILFASENLYQILVDHVMYTPKANMFDLV

SEQ ID NO: 210800 - protein, 134 aa, Triticum aestivum
  Clone ID: PAT_TA_105218.pep
YIARGTAGLRLRSYAQSCSLQVLDSDAAQRLIPGLRVPLNLAIYMPLALNINPKKYLQALFLACQNMAKETSVSPSELKEFSLYNKHIDNLQQLSGDYDAVIICLGGKASSLPELTNKLPLRTCRGVIAEFKLP

SEQ ID NO: 210801 - protein, 110 aa, Triticum aestivum
  Clone ID: PAT_TA_105219.pep
MLMAVALVLMLAAVPRAAVAIDCGHVDSLVRPCLSYVQGGPGPSGQCCDGVKNLHNQARSQSDRQSACNCLKGIARGIHNLNEDNARSIPPKCGVNLPYTISLNIDCSRV

SEQ ID NO: 210802 - protein, 180 aa, Triticum aestivum
  Clone ID: PAT_TA_105220.pep
MKKFLVLALIVVAATTTAAEPFTAFRSAWEPQHPSSPEHQPTPQPQEHPVPHQKLNPCRDALLQQCSPVADMSFLRSQVVQHSSCLVMWEQCCQQLKAIPKQSRCEAIHNVVHAIILQQQQQLVQATSTQPQQQQQQGQQQQQGLGSSQPQQQTQLDQGWIAVIGTWVIQTIPAMCDVHV

SEQ ID NO: 210803 - protein, 36 aa, Triticum aestivum
  Clone ID: PAT_TA_105221.pep
FFSLAFTNQIKRYCPHYYRSEIVLNSIQNSLTLTHK

SEQ ID NO: 210804 - protein, 116 aa, Triticum aestivum
  Clone ID: PAT_TA_105222.pep
GPFRVVFLATDDREEVVKATVYSSATGAWSPPVSLDDSCECYARHKRDATAEMMFFSSYVPYVQSRRVAAIGDAVYFTISRSAAIAKYDWAENHLSVIDPPPPDTELYGGFVSLMV

SEQ ID NO: 210805 - protein, 96 aa, Triticum aestivum
  Clone ID: PAT_TA_105223.pep
MKTLLILTILAMAITIGTANMQVDPSSQVQWPQQQPVPQPHQPFSQQPQQTFPQPQQTFPHQPQQQFPQPQQPQQQFLQPQQPFPQQPQQPYPQQP

SEQ ID NO: 210806 - protein, 67 aa, Triticum aestivum
  unsure (1)..(67): unsure at all Xaa locations
  Clone ID: PAT_TA_105224.pep
FLDIGASAETVXGNPKVVFGLRDAFVKLEXGLELSGVKISEPEFHGTQVPMVAMVENGMDLDDAKVE

SEQ ID NO: 210807 - protein, 84 aa, Triticum aestivum
  Clone ID: PAT_TA_105225.pep
SLEVFGFLTRPMISAMLPQHRHREPTGGRSTGSNSPKDEFILPFLGDEDASGSGSGFVQAKRSISMMLERPIHTVHIYWRKFDD

SEQ ID NO: 210808 - protein, 61 aa, Triticum aestivum
  Clone ID: PAT_TA_105226.pep
SLWQVENRISKAKKGLIVGLIGPDHPFTNNYCVWEDEFKVAHFCGCEMQHHVWIADQKGSP

SEQ ID NO: 210809 - protein, 199 aa, Triticum aestivum; identical to SEQ ID NO: 178440
  Clone ID: PAT_TA_105227.pep

SEQ ID NO: 210810 - protein, 189 aa, Triticum aestivum
  Clone ID: PAT_TA_105228.pep
MKTLFILTILAMATTIATANMQVDPSGQVQWPQQQPFRQPQQPFYQQPQHTFPQPQQTFPQQPQQPFPQPQQPQQPFPQSQQPQQPFPQPQQPQQSFPQQQQPLIQPYLQQQMNPCKNYLLQQCNPVSLVSSLVSMILPRSDCQVMQQQCCQQLAQIPRQLQCAAIHSVVHSIVMQQEQQQGIQILRPL

SEQ ID NO: 210811 - protein, 136 aa, Triticum aestivum
  Clone ID: PAT_TA_105229.pep
MKTLLILTIIAVALTTTTANIQVDPSGQVQWPQQQQPFPQPQQPFSQQPQQIFPQPQQTFPHQPQQAFPQPQQTFPHQPQQQFPQPQQPQQPFPQQPQQQFPQPQQPQQPFPQQPQQQFPQPQQPQQPFPRPQQPQ

SEQ ID NO: 210812 - protein, 110 aa, Triticum aestivum
  Clone ID: PAT_TA_105230.pep
VSVSTTAGSFGASASGSAAAAGSGSLVSFVSAAAGASSLVASTSTGAGASTSASTGAGTSSVLATSSAATGVSTAGASSVSAAVGFWTSAVAIAVVDARKCPEWQTLQAS

SEQ ID NO: 210813 - protein, 55 aa, Triticum aestivum
  Clone ID: PAT_TA_105231.pep
SCIVTSENCSSTYLTSISNPIQRLSNKHSQATITRTVEAQLGIRNTKFKFFVQLA

SEQ ID NO: 210814 - protein, 125 aa, Triticum aestivum
  unsure (1)..(125): unsure at all Xaa locations
  Clone ID: PAT_TA_105232.pep
GRSQVLQQXSTYQLLQELCGEHLWQIPEQSQCQAIHNVVNAIILHQQQKPQQRPSSQVSFQQPLQQYPLRQGCFRPSQQNPQARGSVQPQQLPQFEEIRNLALQTLPAMCNVYIPPYCTIAPFGI

SEQ ID NO: 210815 - protein, 184 aa, Triticum aestivum
  Clone ID: PAT_TA_105233.pep
MAKLQGTRLGALRAYVFGFFICTSGFLFGYDTGIVGGVLTLQSYQDDFRYTDKTTVSAVMVSVQNVGAFLAALSIFFISARFGRRRTIMAACAVFCIGVVLQVIPSHSLVCFYIGRFVAGIGLGAATAVTPSYNVEMAPKEIRARLGSGQQLLFALGVMISYWIDYGVAISESLKRKSAQWQIP

SEQ ID NO: 210816 - protein, 170 aa, Triticum aestivum
  Clone ID: PAT_TA_105234.pep
MASDKSKGKQPAVPRPSASVLLVSPQNQILLLQRVKQSSSFASAHVFPGGNVSEFHDGKMPGPESDDRHIESEIYRLAAIRETFEESGILLARNAGFGRLIEVPEVEREEGRRKVHSNETSFLQWLAQKGGKADTDGLIPFTRWVTPTNVPKRFTTQMYIYFLPTLSGTP

SEQ ID NO: 210817 - protein, 169 aa, Triticum aestivum
  Clone ID: PAT_TA_105235.pep
KRKVNKPEPEVVTAEEKELQRVLRSEQIMKNLFNALWTVSKQKISESEVATKSMRELLKDKDTEILELKKELDDLKFRCSHVKQNDAASIAISSVVQTDLASDAALNNFHIMGQVGNKESDGSESCSEQTSAPDGGVTHAPSHLDDPSETSFTELHIVPCNLSAQFTDI

SEQ ID NO: 210818 - protein, 154 aa, Triticum aestivum
  Clone ID: PAT_TA_105236.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQPF

SEQ ID NO: 210819 - protein, 109 aa, Triticum aestivum
  Clone ID: PAT_TA_105237.pep
MKTLLILTIIAVALTTTTANIQVDPSGQVQWPQQQQPFPQPQQPFSQQPQQIFPQPQQTFPHQPQQAFPQPQQTFPHQPQQQFPQPQQPQQPFPQQPQQQFPQPQQPQQ

SEQ ID NO: 210820 - protein, 41 aa, Triticum aestivum
  Clone ID: PAT_TA_105238.pep
MNRKSNDTYLLPPLGSNHHHHHHHHHHHHHHHHHHQNRMRA

SEQ ID NO: 210821 - protein, 185 aa, Triticum aestivum
  Clone ID: PAT_TA_105239.pep
SPPPPATDPEPGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEIT

SEQ ID NO: 210822 - protein, 105 aa, Triticum aestivum
  Clone ID: PAT_TA_105240.pep
IYLNHIVNLDGKCNRMESKYFGRLFWTMKNDYNRNIVTLDQPGKQTGNCAKKASKKTERSEKALSTQQKDKCQKGNEKIKRSEKRSFLYKKCTCANARRNPTHHI

SEQ ID NO: 210823 - protein, 75 aa, Triticum aestivum
  unsure (1)..(75): unsure at all Xaa locations
  Clone ID: PAT_TA_105241.pep
PVAMPHHIARYEMSQRTSCHVMQQQCXHQLPQMPQQSRYEAIRAIIYSIILQEQQQVHGSIQSQKQQPQQLGQCV

SEQ ID NO: 210824 - protein, 196 aa, Triticum aestivum; identical to SEQ ID NO: 209139
  Clone ID: PAT_TA_105242.pep

SEQ ID NO: 210825 - protein, 84 aa, Triticum aestivum
  Clone ID: PAT_TA_105243.pep
RFGGPQLSSQTDNRACRNQSDPILLQQRGSLMSSMASASREEAHRRGTAGGQSDRSRTGSSGAGSAASRRRRGEEVAADADHRR

SEQ ID NO: 210826 - protein, 196 aa, Triticum aestivum; identical to SEQ ID NO: 209139
  Clone ID: PAT_TA_105244.pep

SEQ ID NO: 210827 - protein, 167 aa, Triticum aestivum
  Clone ID: PAT_TA_105245.pep
MKTLFILTILAMATTIATANMQVDPSGQVQWPQQQPFRQPQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQPYLQQQMNPCKNYLLQQCNPVSL

SEQ ID NO: 210828 - protein, 144 aa, Triticum aestivum
  Clone ID: PAT_TA_105246.pep
MKTLFILTILAMATTIATANMQVDPSGQVQWPQQQPFRQPQQPFYQQPQHTFPQPQQTFPHQPQQQFPQPQQPQQQFPQPQQPQQPFPQPQQAQLPFPQQPQQPFPQPQQPQQPFPQSQQPQQPFPQPQQPQQSFPQQQQPLIQ

SEQ ID NO: 210829 - protein, 137 aa, Triticum aestivum
  Clone ID: PAT_TA_105247.pep
PPCSQQQQPPLSQQQQPPFSQQQPPFSQQQQPILPQQPPFSQQQQQPILLQQPPFSQHQQPVLPQQQIPSVQPSILQQLNPCKVFLQQQCSPVAMPQSLARSQMLWQSSCHVMQQQCCRQLPQIPEQSRYDAIRAII

SEQ ID NO: 210830 - protein, 180 aa, Triticum aestivum
  Clone ID: PAT_TA_105248.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQSSYQQLQQLCCQQLFQIPEQ

SEQ ID NO: 210831 - protein, 125 aa, Triticum aestivum
  unsure (1)..(125): unsure at all Xaa locations
  Clone ID: PAT_TA_105249.pep
PVEKTPAGKKPKRRRXPASKEGGDKKGKKKAKKSVETYKIYIFKVLKQVHPDIGISSKAMSIMNSFINDIFEKLAGESAKLARYNKKPTITSREIQTSVRLVLPGELAKHAVSEGTKAVTKFTSS

SEQ ID NO: 210832 - protein, 199 aa, Triticum aestivum
  Clone ID: PAT_TA_105250.pep
LQQQPPFLQQQQPSLPQQPPFSQQQQQLVLPQQQIPFVHPSILQQLNPCKVFLQQQCSPVAMPQSLARSQMLQQSSCHVMQQQCCQQLPQIPQQSRYEAIRAIIYSIILQEQQQVQGSIQTPQQQPQQLGQCVSQPQQQSQQQLGQQPQQQQLAQGTFLQPHQIAQLEVMTSIALRTLPTMCRVNVPLYRTTTSVPFGV

SEQ ID NO: 210833 - protein, 175 aa, Triticum aestivum
  Clone ID: PAT_TA_105251.pep
FLVFALLAVVATSAIAQMETSCIPGLERPWQQQPLQQKETFPQQPPSSQQQQPFPQQPPFLQQQPSFSQQPLFSQKQQPVLPQQPAFSQQQQTVLPQQPAFSQQQHQQLLQQQIPIVHPSILQQLNPCKVFLQQQCSPVAMPQHLARSQMWQQSSCNVMQQQCCQQLPRIPEQSR

SEQ ID NO: 210834 - protein, 71 aa, Triticum aestivum
  Clone ID: PAT_TA_105252.pep
MKFTPALIALVSGLGATAAPMEETAQPVALEKRAGGLDYVQDYNGDAAGFQSDKGAGTFSLKWGGDTDVVA

SEQ ID NO: 210835 - protein, 51 aa, Triticum aestivum
  Clone ID: PAT_TA_105253.pep
SIITDQNIHGVPNDQMACIISKFVGEVQRYIENEQAQSYAIKWCLATSSVD

SEQ ID NO: 210836 - protein, 189 aa, Triticum aestivum
  Clone ID: PAT_TA_105254.pep
QQQPLLPPQQSPFPQQQQQHQQLVQQQIPVVQPSILQQLNPCKVFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVP

SEQ ID NO: 210837 - protein, 102 aa, Triticum aestivum
  unsure (1)..(102): unsure at all Xaa locations
  Clone ID: PAT_TA_105255.pep
RAPGPRKDEVVTREYTVNLHKRLHGCTFKKKAPNAIKEIRKFAQKAMGTNDVRIDVKLNKHIWSSGIRSVPXRVRVRIARKRNDEEDAKEELYSLVTVAEVP

SEQ ID NO: 210838 - protein, 66 aa, Triticum aestivum
  Clone ID: PAT_TA_105256.pep
ALLRSTTCRLHWFIIYLYFDCHDFCEFVEVLSLLENVMMTVIMMESIVDEGNLILETKKTAIAKYR

SEQ ID NO: 210839 - protein, 148 aa, Triticum aestivum
  Clone ID: PAT_TA_105257.pep
TQTINHHLINKSWYLVDLPGYGFAAASKTARTDWSSFTKGYFLNRDTLVGVLLLVDASVPTQQIDLDCANWLGRNNVGLTFVFTKCDKVKKGKGGRPDENIKVFLENIGSLYPKPPPWIMTSSTTGLGRDGLLLHMSQLRNYWDNEAT

SEQ ID NO: 210840 - protein, 194 aa, Triticum aestivum
  Clone ID: PAT_TA_105258.pep
PNASGTFHSMFMKCMKDCESEAEFEETWAMMRQEHNLQDDQWLTDLFEQRHKWCTALHKVAFDCGIRSLDRNFSSHNVLGSIADESTSPTNFALEFDKLVGSWRTNESVDDIQCKQISPECSVKQNSILQHAAEVYTHKVYKSLETEFLDGCTGTSYQEMQCSETLYRFEFIMQSSPKVWIVFLDTSTMELSCS

SEQ ID NO: 210841 - protein, 128 aa, Triticum aestivum
  unsure (1)..(128): unsure at all Xaa locations
  Clone ID: PAT_TA_105259.pep
TTVGDGGCSDDERAGGGAAAESSAFWAEQLSHLHEVLGKMSSAESRIRADTEEAVRHARSGTATAAAGVCSSCATRATAGGGCRGCTLRSVAARLRDAGYDSAVCRSXWARSAEFPAGEHSYVDVVVP

SEQ ID NO: 210842 - protein, 54 aa, Triticum aestivum
  Clone ID: PAT_TA_105260.pep
ICKHYEQVSKSYRRRITFPMLVVHHLGMQPKKHIYEHCRSSSCLMDKPQNLANT

SEQ ID NO: 210843 - protein, 210 aa, Triticum aestivum
  unsure (1)..(210): unsure at all Xaa locations
  Clone ID: PAT_TA_105261.pep
NYAFELFCRRSFIAKRXQCPDYLLETAKSIVHRCRGLPLAILSIGGLLSSRPQTQYDWEQLYNQLPTELSNNDHVKAVLNLSYHDLSGDLRNCFLYCSLFSEDYPMSRETLARLWVAEGFVLRKGNSTPEEVAEENLRKLIHRNMLEVMDRDELGRVSTCTMHDIVRELALCIAREXRFVSTSDYGTMQQMDMDARRLSSCGWKENTARK

SEQ ID NO: 210844 - protein, 115 aa, Triticum aestivum
  unsure (1)..(115): unsure at all Xaa locations
  Clone ID: PAT_TA_105262.pep
MSDLDVQIPTAFDPFAEANAGDAGAAAGSKDYVHVRIQQRNGRKSLTTVQGLKKEFSYSKILKDLKKEFCCNGTVVQDTELGQVIQLQGDQRKNVSXFLVQAGIVKKEHIKIHGF

SEQ ID NO: 210845 - protein, 163 aa, Triticum aestivum
  Clone ID: PAT_TA_105263.pep
EQQANTIRVVGTCGYMSPEYAMEGSSSVKSDTYSFGVLLLEIVSGSKISSSHFMTDFTNLIAYAWSLWKDGNARELVDSSIVENCPLHEVLRCIHIGLLCVQDNPSARPLMSSTVFMLENETAPLPTPKEPLYFRQRYDEVEDQRDTMGITLNKMTITVQEGR

SEQ ID NO: 210846 - protein, 186 aa, Triticum aestivum
  unsure (1)..(186): unsure at all Xaa locations
  Clone ID: PAT_TA_105264.pep
KNSCYAHYFGNWRTHADCSPFQRLSVYADDVILFIKPTVADLSFTTMALQMFGEASGLHVNFPKSSAIMIHADETDTERVSHALPWRMDSSPCKYLGLMLSIKQLTRSDWQPVVDDVLNFLPXWQRGMVTRPGRLTLVNTVIRARPTHHLLVADAPKWDLERVDKSCRAFFWAGTEHIHGGKCLVA

SEQ ID NO: 210847 - protein, 176 aa, Triticum aestivum
  unsure (1)..(176): unsure at all Xaa locations
  Clone ID: PAT_TA_105265.pep
WFSWCFIGVSTILALWFLKFLGGKSNPKKKQLPPGPWTLPIIGSLHHVVSVLPHRRMSKMSRRHGPLMHLRLGEVPAVIVSSAEAAAQVMKTNDLAFASRPQGPLQDIVGCGGRGIVFGSYGDRWRQMRKICVVELLSSKQVRRMEGIKANEVXNLLRSITAAGATVNVSTKMAAL

SEQ ID NO: 210848 - protein, 139 aa, Triticum aestivum
  Clone ID: PAT_TA_105266.pep
ATFSPPTPWRPTVMASSATSVAPFQGLKSTAGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLN

SEQ ID NO: 210849 - protein, 168 aa, Triticum aestivum
  Clone ID: PAT_TA_105267.pep
YRWVCALLLALLFQEREVNRSNSASHSIPVLSNLLRSDEPAYRYFAAQALASLVSNGSRGTLLAVANSGAATGLISLLGCANVDIADLLELSEEFMLVPNPDETTLERLFRVDDIRVGSTSRKSIPLLVDLLKPIPERPGAPFLALGLLTQLAVDCVPNMLLMAEVGI

SEQ ID NO: 210850 - protein, 138 aa, Triticum aestivum
  Clone ID: PAT_TA_105268.pep
LRLLPACRHAFHSGCVDPWLRANPSCPLCRASIALPYPPLPELLRVELGSVSSRRSTSSSSSAAVAAAPPEGVRAYPLPNSNTNTEYLVEEDLQVVLKPPSAANPAPPPPPTARITGEPSQQLAAAAERGLYVIVTPT

SEQ ID NO: 210851 - protein, 164 aa, Triticum aestivum
  Clone ID: PAT_TA_105269.pep
PRPPPTASAAAASGATSTASGAPPMPPRPPGAPPPPPPPGRPGGPPPPPPPPGSLSKSLAGGDKVHRAPEVVEFYQSLMKREAKKDTTSLGSKTSNVSDNRSNMIGEIENRSTFLLAVKADVETQGEFVESLASEVRAARFANIDDVVAFVHWLDEELSFLVDE

SEQ ID NO: 210852 - protein, 143 aa, Triticum aestivum
  Clone ID: PAT_TA_105270.pep
MARLNSKAVAAAVVLAAVVLMMAGREASAALSCGQVDSKLAPCVAYVTGRASSISKECCSGVQGLNGLARSSPDRKIACRCLKSLATSIKSINMGKVSGVPGKCGVSVPFPISMSTNCNKYVLIFRSTHPNACIFIFSRSRVV

SEQ ID NO: 210853 - protein, 156 aa, Triticum aestivum
  unsure (1)..(156): unsure at all Xaa locations
  Clone ID: PAT_TA_105271.pep
MALARRFIFLFPAAVLAGLASASASPFLSDRVSQASTGLTGRRSLLRTKNDCPMDFEFQNYTIITSRCKGLQHPTMECCAAFKEFSCPFAAYNNMQSTNCAATMLTYINLHGTYPAGLFDECLXGMEGVSCEAIPAIETGMSNGGQRVQGHKSRNS

SEQ ID NO: 210854 - protein, 107 aa, Triticum aestivum
  Clone ID: PAT_TA_105272.pep
MFFSIATFAALAASTSALAIPAKRETISITPHDAYSSSVGVLGCKINTDRVAYWPSAVSCDKMCVRVSANGRSVNLLKIDTSGGAYDIAYDAYNYLVTGKSATEDPI

SEQ ID NO: 210855 - protein, 69 aa, Triticum aestivum
  unsure (1)..(69): unsure at all Xaa locations
  Clone ID: PAT_TA_105273.pep
CTAIYKCSCNMTEIAIFPLKVVEVRQLAKSKARQCFHLWCRPTLFVLXRSPHQDREDSHQDSLIQAFPQ

SEQ ID NO: 210856 - protein, 162 aa, Triticum aestivum
  Clone ID: PAT_TA_105274.pep
ISFVACLEYLWLFSCGSLPSVLNLPPSLETIYIGCCSSIQVLSCRLDGLQKPQVTTSINSPELSTVAAAGEHSLPPHLKYLNIWSCDSMLGGILRLPTSLEMLYIMDNSRLTSLESLSAEHPPSLETFSLSHCITLASLPNEPQTYGSLKELSIHGCPAIKN

SEQ ID NO: 210857 - protein, 144 aa, Triticum aestivum
  Clone ID: PAT_TA_105275.pep
DMACVNPLNCMGDNSFLIILKEENTDAYLFLQDCRVISGLKLRSRRQGVATEKHKFVSRNRKRKTNRGAAHQPGILDRERYRNEQGCGGSPTLAAASSPIACEAEGRVGAASPGAWSRSRGIGDAPPSLTSGRQLRSAVGWESR

SEQ ID NO: 210858 - protein, 149 aa, Triticum aestivum
  Clone ID: PAT_TA_105276.pep
VYGSVLNLVSSAFFSVDVADVGGESASGLREVVEDIIAAFAKPNISDIFPFLRPLDLQGWCRWACARYQKVWGILDGIIDRRLADAQTSTGEHAHGNFLDSLLELVSAGKIGRDKVTVILFDVFAAGTDMMAITVEWAMAELLRHPRAM

SEQ ID NO: 210859 - protein, 83 aa, Triticum aestivum
  Clone ID: PAT_TA_105277.pep
KSMLDEIRELEVPCLDEDPVLEVKAIIGGIVYLSAYEASSPSACWLLSFCTETEKLNKVCPITNSDFFYPYLMAWPPLLYATR

SEQ ID NO: 210860 - protein, 40 aa, Triticum aestivum
  Clone ID: PAT_TA_105278.pep
GISQCLGSCRHSLIGSALCLYKWDKLSMMPGCSTSCLYIP

SEQ ID NO: 210861 - protein, 52 aa, Triticum aestivum
  Clone ID: PAT_TA_105279.pep
LSLSVTYAHYIAFCSPIALVCRNNQDDAASFMGAITYVKLDFYNFCGYSISC

SEQ ID NO: 210862 - protein, 120 aa, Triticum aestivum
  Clone ID: PAT_TA_105280.pep
IVYWLDLPNEKNMHDQDISSKPLPNGGGTLGQHRHRKKIKKSLTACPPCHVVASTSSGPDTAPLGSDSDILHDDDKPPKRSSKKKVNKWKQCRRATGEKLNLLPELPCEEHIDAASPVEV

SEQ ID NO: 210863 - protein, 88 aa, Triticum aestivum
  Clone ID: PAT_TA_105281.pep
GRWSPAVAPPVTGRRQDRWCLEFWTPERATLLLLILLSPRLWCCSFYSSDAHACSQTIIVEGLKGMISGPQMMHFIGRHNQGPIIFLL

SEQ ID NO: 210864 - protein, 104 aa, Triticum aestivum
  Clone ID: PAT_TA_105282.pep
DDVGFSRDNYLRRGPQIESGHVSNFEPFRMRGLGPERRMSEDIYEQHRSSPTVRVETPWHSIPFERPRRPFPLEDSWDADDHSYPLSKKLRTGELHDAELPRIS

SEQ ID NO: 210865 - protein, 105 aa, Triticum aestivum
  Clone ID: PAT_TA_105283.pep
TARSVFSISGMMLITSPWSFCAASKPRRERILGRIKVMTGDTNQPNTTMDQPTEATSQAVAMECYGFSRKNLLAISSSARCLSICFSTSCAYPAMLRAAGSEELA

SEQ ID NO: 210866 - protein, 85 aa, Triticum aestivum
  Clone ID: PAT_TA_105284.pep
YSRVHSNKCQACKNKKNGLRLLRRAKNSCYRNRRQPRASECVPIAKGVELLTTLFCGEQRRSLCPLLSRHRVINREFKGSSAMEK

SEQ ID NO: 210867 - protein, 123 aa, Triticum aestivum
  Clone ID: PAT_TA_105285.pep
CYQFQTGRVRTRLVHAIDILTLLQQSVELFLLQSYCAKLVRIITNSYGVFLYFRLYFQSDLKVIVLHTFRFRRVPPWNGGKKNQSPSSSPSLTTSDHLSTFSSPLSASNNLYKSRSDFFIYST

SEQ ID NO: 210868 - protein, 161 aa, Triticum aestivum
  Clone ID: PAT_TA_105286.pep
GIFIGNLRKPIEEVRPKLEKKIAEAAGTEVTLWFMEERNDDITKQVCMVQPKAEIELQLEVTKLSTPWGYLSAVALAVTTFGTIALMSGFFLKPGASFDDYVSDVLPLFGGFLSILGVSEIATRLTAARYGVKLSPSFLVPSNWTGCLGVMNNYESLLPSK

SEQ ID NO: 210869 - protein, 134 aa, Triticum aestivum
  unsure (1)..(134): unsure at all Xaa locations
  Clone ID: PAT_TA_105287.pep
VSIRYSFRLLVSIRHSTLCHSILKMNXRRRRRPSCPGQPATARRAGRQCRRLILGPLVALLYGLEQDLEGALGSGRDWRHHGGCREHHRREINKPPEQTSERTQGLTRQYAKSYSRTPWRPGTSPFLIKSAPRA

SEQ ID NO: 210870 - protein, 94 aa, Triticum aestivum
  Clone ID: PAT_TA_105288.pep
ARIQGSRWSAAAATTTADERVPTRAGKCAGLELMVAASSRGGGGDGGGTRAAAPSVASVGAAQEGSGVGLAWGSHESAAAMGSRGGDRAGRLGG

SEQ ID NO: 210871 - protein, 114 aa, Triticum aestivum
  Clone ID: PAT_TA_105289.pep
DFGLARVNSDPDPDDKLESGAIAEGTDANENALDGGCDDDVSVVAESTVTTTVDGEVNVAPKSPEVDDGGGGFTLPSPDEAASTSGFDQTSLDSGLNSRSCNGVGSRTGGASGT

SEQ ID NO: 210872 - protein, 57 aa, Triticum aestivum
  Clone ID: PAT_TA_105290.pep
EVKEHQRKKIAVCKGLKVCTWATRLIKFTKFKDPQLLREWVMHLHYSFPLQMDKSTI

SEQ ID NO: 210873 - protein, 101 aa, Triticum aestivum
  Clone ID: PAT_TA_105291.pep
AGRWRHMCRATLLWASFWSWCRLVGPVVVGEACTAVGLSRDLTWVAEARRRCVVADFGDPSWWRGEPKEVVVAVPVWLTGTFQGGSRSPPWRAVTIHGVLS

SEQ ID NO: 210874 - protein, 103 aa, Triticum aestivum; identical to SEQ ID NO: 107316
  Clone ID: PAT_TA_105292.pep

SEQ ID NO: 210875 - protein, 49 aa, Triticum aestivum
  Clone ID: PAT_TA_105293.pep
AAPRALRHRLGTRRRPTAPLTPTAFSPTDICHIYILGNKFFFLYIILVL

SEQ ID NO: 210876 - protein, 60 aa, Triticum aestivum
  Clone ID: PAT_TA_105294.pep
VLRLLPVWACGIIFAAAYTQMTTTFILQGDTLDPRVGSLRVPPAVLTVFNTLSVMLWVPF

SEQ ID NO: 210877 - protein, 118 aa, Triticum aestivum
  Clone ID: PAT_TA_105295.pep
RRRAPPWRAAPPVRAAFGARRRSGRPRSRRRRRPARAASSTGAAPRSPSRGRSLAGTWRPGRGGDAGETLAACRAGGRAAVVFAVRRARDGRLGGSEEGGDGSGEEEFGRPAGRRLVP

SEQ ID NO: 210878 - protein, 104 aa, Triticum aestivum
  Clone ID: PAT_TA_105296.pep
PSGERPREDERKLEVDPLQAKGCVISRHLVDASLVLDLLEAKISDQDHVRFMRCIGDKEISDALFQIGPLKAPGPDGLSARFFQRNWVTLKDSVINAVKEFFRT

SEQ ID NO: 210879 - protein, 99 aa, Triticum aestivum
  Clone ID: PAT_TA_105297.pep
MIEHVAFLGSKKREKLLGTGARSNAYTDFHHTVFHIHSPTKTKEYGESLLPSVLDALNEIAFHPKFSSSRVEKERRAILSELQMMNTIEYRVDCQLLQH

SEQ ID NO: 210880 - protein, 118 aa, Triticum aestivum
  Clone ID: PAT_TA_105298.pep
VKPPSYSFLGSLEIGNCIMGLATSSPKRAHSSAPRAGARHGEGRSGSRDDARISPRDAPPRHRSPSDGGGAEFSSTAAYHDGHRVSSRGGSHHVSLREQPRPSDSGGAEFSSTAAHHN

SEQ ID NO: 210881 - protein, 162 aa, Triticum aestivum
  Clone ID: PAT_TA_105299.pep
GTRRTSFRVLPSAVSEIISQHPGPARRFYLRCPGAGDPGADDLCAQAESWLHSPALANLEELDISYANPQLLPSARRSASTLLVAKMSHCGFPNEIGPSMNFPLLKQLSLMDVYISEDVFHDLLSGCHALESLYVSKVFGVRCLRISSPKIRSIGFYFHSSK

SEQ ID NO: 210882 - protein, 82 aa, Triticum aestivum
  unsure (1)..(82): unsure at all Xaa locations
  Clone ID: PAT_TA_105300.pep
MGRRRSPALPLLVIFGILAVVLAALPPLAESSSSHHHHRRQGHGHHSRVQSXGHGGEGEXSSSAAAAKARGRAWPCCDSCGG

SEQ ID NO: 210883 - protein, 104 aa, Triticum aestivum
  Clone ID: PAT_TA_105301.pep
MAPVKLYGATLSWNVTRCVAALEEAGVEYEIVPINFGTGEHKSPDHLARNPFGQVPAGGDGDLYVFESRAICKYACRKNKPELLKEGDIKESAMVDVWLEVEAH

SEQ ID NO: 210884 - protein, 52 aa, Triticum aestivum
  Clone ID: PAT_TA_105302.pep
KQLSVLNHSICKCGFPKPSLKYQDHIFITLNKNFLSISLSLLAFGAKENLVP

SEQ ID NO: 210885 - protein, 55 aa, Triticum aestivum
  Clone ID: PAT_TA_105303.pep
FPSNPSHAFLSLISQRRVLTSRRPFGGVIHISLLSRSISGTNLQQMESTRADGME

SEQ ID NO: 210886 - protein, 122 aa, Triticum aestivum
  unsure (1)..(122): unsure at all Xaa locations
  Clone ID: PAT_TA_105304.pep
MANTRLAVVAMLVILLQLSTLSVARHHAKPDPCVGEDDSVPGMVHKHKKPHCPXPGGSGGGGGGGGTPGVMTVNGFQKGEDGGAPXECDGKYHSDKDMIVALSTRWYAGGRRCGKMINITSK

SEQ ID NO: 210887 - protein, 144 aa, Triticum aestivum
  unsure (1)..(144): unsure at all Xaa locations
  Clone ID: PAT_TA_105305.pep
RHEGDAQVQQLNAKLLKXRAQMEAVTAADERSKAIVSNLTAAMQQLHAETEAASKEEELTMLEKRCVLXEADNVAAEMATAEERIRQSVKELEAAKASETSAMKKLKAAVESTMQAXSTAAPRRQGTITVSRFEYEYLSGRAAL

SEQ ID NO: 210888 - protein, 97 aa, Triticum aestivum
  Clone ID: PAT_TA_105306.pep
AAAGHGVRVAVRAVVPAAAVHAGGVLPGAAPADAQDAPGHPGRRRDGGPRALPPRRAPLGRARRRLRLRLRRGAVGLRRLRPPPAGAAQGGLPLPHQ

SEQ ID NO: 210889 - protein, 166 aa, Triticum aestivum
  unsure (1)..(166): unsure at all Xaa locations
  Clone ID: PAT_TA_105307.pep
PPSLTMNRYKDTDAVSGTGGLSKLPGLGRAARRQLAAILDEFWGRLFDYHGKPTLXADAERIHLLLGLDLIRDGSAGRTDNQNTRASKKPLTRDTVPGSGISTPDLSFGLQMGTMGSSTWSQSMYLPNRDTLSSSSIFLNQNAKEITKHDVAPYCDNQFYQPTTIH

SEQ ID NO: 210890 - protein, 122 aa, Triticum aestivum
  Clone ID: PAT_TA_105308.pep
SARGYSRLVAVRAVACHAAPARAPPPLAASDRARPFPSLHFRLRAGAPCRLPPPSRRAPAPPRGFSAQGQSVERRARVGRTGGHAVRGAPGGGAGRGGRGGGAAGRPAAALGRPRRRRRVPQ

SEQ ID NO: 210891 - protein, 125 aa, Triticum aestivum
  Clone ID: PAT_TA_105309.pep
FCFVCSSPRLAKIEPARTVTGKGILAPKVAAFSSRGPSIDYPAFIKPDIAAPGSNILAAVRNSYETMSGTSMAAPHVTGVAALLKAMHPDWSSAAIKSAIVTTACVTDQRGMSILAEGLPPKVAD

SEQ ID NO: 210892 - protein, 111 aa, Triticum aestivum
  Clone ID: PAT_TA_105310.pep
GPFKAGKYEMKKFCLEPTSFTVKAEGIQKNEPPAFQKTKLMTRLTYTLDEMEGPLEVGADGTLKFEEKDGIDYAAVTVQLPGGERVPFLFTVKQLVATGKPESFSGPLLVP

SEQ ID NO: 210893 - protein, 110 aa, Triticum aestivum
  Clone ID: PAT_TA_105311.pep
SSPGSHVARSAAARTTNRARGDSTWCPGMVTMLPPPKGVGGLEEKVQTLPWALAANAMVAAVAAGGLGWLIARLTAAGEGPSWLLLFCLGRVGGASDGSKGRGYGTSLVP

SEQ ID NO: 210894 - protein, 60 aa, Triticum aestivum
  Clone ID: PAT_TA_105312.pep
TRQQHDREAYHGSLSNLKAMMTMVSQDTGDYIYEESIPVITKDQKRDYTFAIYQLLVVLD

SEQ ID NO: 210895 - protein, 112 aa, Triticum aestivum
  Clone ID: PAT_TA_105313.pep
GKVSSFSCCLATSFLMQFQVQVEDPRPLAQGQGRPDEENASWANIRTARLLGGLTSATPLPTLPAHYVSQASGVATASPAHYASQASGVATADPLCLSGQWSRDDRPIMPPA

SEQ ID NO: 210896 - protein, 82 aa, Triticum aestivum
  Clone ID: PAT_TA_105314.pep
MAGVNTSVVGLKPAAAVPQSASPAAAKRVQVAPAKDRRSALLGLAAVFAVTAASAGAARASVFDEYLEKSKLNKELNDKKRA

SEQ ID NO: 210897 - protein, 47 aa, Triticum aestivum
  Clone ID: PAT_TA_105315.pep
MVHSPPPGPPAAKPRHYADSFWCTYIVSVVAASIAKVLTYPLNLTKT

SEQ ID NO: 210898 - protein, 86 aa, Triticum aestivum
  Clone ID: PAT_TA_105316.pep
SHKIISSILLSQPATGLPSVFFRITGIKKMYQGLTVFNELTILIDRGGICTGFEISLFTGLQLVVFCMQISHSFAGVVHQCCDKLH

SEQ ID NO: 210899 - protein, 115 aa, Triticum aestivum
  Clone ID: PAT_TA_105317.pep
FPGPESLTGLGSKVMVPLDFCWDCSTSWANNFCILSHNLSTLASPILSLILSPIQSGHDQITSSPNTQVLEKHNTLIRIAKQRMNRTCSAHLGQIAWNSLTLHQSDIQLASLLLG

SEQ ID NO: 210900 - protein, 54 aa, Triticum aestivum
  Clone ID: PAT_TA_105318.pep
SCCMPTKIQLGCSPFLRMLYICIKVVRCIFICSMSTFDPVACPQNTCLVAAYLF

SEQ ID NO: 210901 - protein, 113 aa, Triticum aestivum
  Clone ID: PAT_TA_105319.pep
TSSTDVVQCSVADSKKKEKPKKYGRVLGPDEPFRLFLRDRETTEFLTAKEERHLFSQIQGLMKLEEAQRRLEAQCGREPTLPEWAQAVGMSCKELQSSIHMGRRCREKMARSN

SEQ ID NO: 210902 - protein, 70 aa, Triticum aestivum
  Clone ID: PAT_TA_105320.pep
GKGRRGRYQAAGEKWRSMSDEEKAKYGGKKADAPASKVVNKKESTSSKKAKTDADEEGSDVEDDAEEEEE

SEQ ID NO: 210903 - protein, 99 aa, Triticum aestivum
  unsure (1)..(99): unsure at all Xaa locations
  Clone ID: PAT_TA_105321.pep
LSINKKKVHQAEKMIRGALVELYKGLGYLKTYRSLNMLAFVKILKKFDKVPANXLSLSHCLKVVESSYFNSSDKAIRLMDDVEELFVRHFASGDKRKAM

SEQ ID NO: 210904 - protein, 66 aa, Triticum aestivum
  Clone ID: PAT_TA_105322.pep
EGRFSPTTYLAWELKVEQVFSHHDFSELERVRAATRAFTNFASVWWSVHCKKNIDDQPTTWKVLKA

SEQ ID NO: 210905 - protein, 83 aa, Triticum aestivum
  Clone ID: PAT_TA_105323.pep
AFARNRALEVIHGRWAMLGALGCVFPEVLQKWVGVEFKEPVWFKAGSQIFSEGGLDYLGNPNLVHAQSMLAVLGFQVLLMGLV

SEQ ID NO: 210906 - protein, 190 aa, Triticum aestivum
  unsure (1)..(190): unsure at all Xaa locations
  Clone ID: PAT_TA_105324.pep
AGDEEASGSKCLVNWKQCCSLKSLSGLGIKELTCYSRALRLRWCWFEWDDTDRPWRGSQIPCAAIDRDLFSSCTKIILGNGQKANFWXTKWLHGVAPIEVAPEVAKLAWRKNLKVADALTENKWMKVLQRMSNEEQVLQFVNLWELIQEVQLSQDRDSLVWVFNSKGIYTAHDAYDAQFIGRIKQPVWSK

SEQ ID NO: 210907 - protein, 75 aa, Triticum aestivum
  Clone ID: PAT_TA_105325.pep
LNYVLNHSRDDPIIVQQCSLIQMTGPKRGIEMYSPVFIEFDLRVKNGGQEEDDLQLIDGAIACYDQKPWRPIKHR

SEQ ID NO: 210908 - protein, 145 aa, Triticum aestivum
  unsure (1)..(145): unsure at all Xaa locations
  Clone ID: PAT_TA_105326.pep
LDWYKXGPTLLEALDQINEPKRPSDKPLRLPLQDVYKIGGIGTVPVGRVETGVIKPGMVVTFGPTGLTTEVKSVXEMHHESLLEALPGDNVGFNVKNVAVKDLKRGFVASNSKDDPAKEAANFTSQVIIMNHPGHIGNGYTPVLD

SEQ ID NO: 210909 - protein, 132 aa, Triticum aestivum
  unsure (1)..(132): unsure at all Xaa locations
  Clone ID: PAT_TA_105327.pep
TQYSPNLRIDSSSALIRDRHGVLSGGALLSHNLFVHPGTSGFTLSVDCADLVGDASARQRAPPCLPISSSSXTCWLHPEAPFEFTVPPQAASLGHINTRGATSGCSTLSANSYSSGNLSTASRSNSIPASSF

SEQ ID NO: 210910 - protein, 54 aa, Triticum aestivum
  Clone ID: PAT_TA_105328.pep
SPLLASKLYFVISLGMRQFSHLVGKIKSMSNLCVRSSRNFRNKEAEAFTHKTLL

SEQ ID NO: 210911 - protein, 145 aa, Triticum aestivum
  Clone ID: PAT_TA_105329.pep
MKNLLKLIWNQKLMIPKVQTFAWRLLRKALPTGLRVGRFSVHISQYCCKCGQQEDEVHMFFLCDFARAAWFSHPWFIRTNALVQIYTNIHSIILALLNMNHPHASVANILNFMWCLWKARNDYIFNRKKATPHQVNIAATSLSND

SEQ ID NO: 210912 - protein, 57 aa, Triticum aestivum
  Clone ID: PAT_TA_105330.pep
SLSPFHEQDSALSGLFSFLSRKFDCQKGKTNGIHLTDLGVVERTTTKMQEMHTSLWD

SEQ ID NO: 210913 - protein, 66 aa, Triticum aestivum
  Clone ID: PAT_TA_105331.pep
SGRAHLLEQGGAQGARLLENRSEAEGAGGWWGEIERNFGSRTLTLIGWGWIPEVGEVVGPMGITRK

SEQ ID NO: 210914 - protein, 79 aa, Triticum aestivum
  Clone ID: PAT_TA_105332.pep
SYFEEPAPESICSDFIACRVCRVKFVHFVNRFVPVSPGGLYCIRLFTMCRFVCAIADHVLLSVLGSIVSSYPLDLYKYI

SEQ ID NO: 210915 - protein, 124 aa, Triticum aestivum
  Clone ID: PAT_TA_105333.pep
GTLRDHLQGGGFASPVTSSWKARVMALLGASRAIDHLHRVATPRIIHRNVSSSSILLDESWAARVCGFGAAVLQEPTADGQLVGEVAGTLGYIDPEYHRTRRVSPASDVYSFGVVMLELLTGRP

SEQ ID NO: 210916 - protein, 70 aa, Triticum aestivum
  Clone ID: PAT_TA_105334.pep
SATMPMISCCHQLKPPSPPLHLQPAAHLPALRRACFAAAACVVAVSAMGAVDGAAMARGPADDGAALGAA

SEQ ID NO: 210917 - protein, 125 aa, Triticum aestivum
  Clone ID: PAT_TA_105335.pep
KQAVQDQPCTSYGVSRKRLTGGVTGGVINEETLKSLDYKRDYLFPLSLLLQNCRPIGYAETLQLLICVVLVGGGTITLLMLVQYYWISVGAFLAVLLIPPLALLSPFLAGLNALFSRGPKRSSGT

SEQ ID NO: 210918 - protein, 86 aa, Triticum aestivum
  Clone ID: PAT_TA_105336.pep
RHRLPTIVGHGGGCRSLPRAGTSCGCRRPRPPPRVRGRSRRGRPATPGEEPSSSPSPSSPDAGRPINGPRSLSLVSKQLSGFWQAL

SEQ ID NO: 210919 - protein, 113 aa, Triticum aestivum
  Clone ID: PAT_TA_105337.pep
FLASPKDRIGRARALAAACRTETKRGRYEENEYNHGSTSMQKLHRALGQQICGTKEEHRPCGRFCHRRGCVYDRPCHSLAQEASISEHHYKIWSGRSVYIVLPTSLLHCGTDA

SEQ ID NO: 210920 - protein, 142 aa, Triticum aestivum
  Clone ID: PAT_TA_105338.pep
SPLSACTNAPTEKIHCTSFKHESMNSAAVLLLQPGQAEANMVALAATDTADSEDIVCGGRACILSLLWLHGSFVRLSPFPLGLLPRLSLLRRYSLLDVAQEREMEVVRGGACVGASCRGNTVAVGRGSAIRCGDGRRRLHAQ

SEQ ID NO: 210921 - protein, 92 aa, Triticum aestivum
  Clone ID: PAT_TA_105339.pep
GITHPFPATDDGSIVDTEQFVRLISMIHYWIIITLALPNNINSRQVDWIIFRHLVQWNVSRFLKRQSNTLLHPHSALPHLTLARQCPLCIIC

SEQ ID NO: 210922 - protein, 76 aa, Triticum aestivum
  Clone ID: PAT_TA_105340.pep
AGRREGAGQHGAAVWPVQLPELFDSKSMYYYIRSIKNTACESSFKSWSVHLLKTYLLLLYPFYLLNCSCCILSLMM

SEQ ID NO: 210923 - protein, 111 aa, Triticum aestivum
  Clone ID: PAT_TA_105341.pep
MSQVNVTAVPQKYHSLLLLTRNFSSTTYSKQRRVVVTGYGALSPIGHSATESWNNLLAGKCGVVRLKGEGYDKLPCQVAARITPPIDLTKHFPKSELRTMAPATAYSLIAA

SEQ ID NO: 210924 - protein, 195 aa, Triticum aestivum
  Clone ID: PAT_TA_105342.pep
SACGENFDHKINRILRNHSGCLKTFNIDYYGTSGFTGTSYFDRWLQIALKPGIEELTLVLSETKGKYNFPCSLLSDGVRNSLRYLRLRFCALHPPVELGPLRSLKSLYLWRVNITWNELECLISNSLTLELLDLISCPEIECLKLPCALQQLSALSVLACERLKVIESKAPNLSSLYLCGNWLDFSLVETLPIKE

SEQ ID NO: 210925 - protein, 122 aa, Triticum aestivum
  Clone ID: PAT_TA_105343.pep
PSVSATRLPFPVSTRAGAALLPVFEEHLLSRSNCSSTGAAALSLPDTTTSGGTGRIRKTPRGVDARGRAWLREPGDYGRPPVLTCAGDQCAPAPGFQVRAQGTSPVRRNAQQYRGERQGSIL

SEQ ID NO: 210926 - protein, 55 aa, Triticum aestivum
  Clone ID: PAT_TA_105344.pep
VAYKHESNSLTGEDTPLMMLCSSVLQELHTYQIPIIHSSIVVLTLPHTCLSRPMQ

SEQ ID NO: 210927 - protein, 44 aa, Triticum aestivum
  Clone ID: PAT_TA_105345.pep
QANQHINSDPTIFTTSFYFTLVWICIFILGVLWILSGNHWGGGS

SEQ ID NO: 210928 - protein, 35 aa, Triticum aestivum
  Clone ID: PAT_TA_105346.pep
KREIQALTVRTNFFMSISLVRMNCYTLSVLCATYW

SEQ ID NO: 210929 - protein, 202 aa, Triticum aestivum
  Clone ID: PAT_TA_105347.pep
IHFSPPPPATDPEPGGTRREEGKGREEEITEPSARTGQQAPRSRAGAEMGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWY

SEQ ID NO: 210930 - protein, 124 aa, Triticum aestivum
  unsure (1)..(124): unsure at all Xaa locations
  Clone ID: PAT_TA_105348.pep
MADGGSSLLSFKKKDIVWVCQQGADYVELFIYLGEPCHVSQLLLTVSHGVEDSSYPATVDVRGGGSIXALKLVVEGACIPQCSNGTNLLIPLTGRIHPEDLAVTGNSARPDVQESTYLPLLYDF

SEQ ID NO: 210931 - protein, 147 aa, Triticum aestivum
  Clone ID: PAT_TA_105349.pep
NRSSKAHRVTSSRARSLASYISSAAALPCPGGESADRRTTGGHTTPARASHGAVDRGAMEALAVAGGKPLSGARARRIARSREEMLGLLADFDGGDGSDRELSFSDLVDAVRPPPNAGHASVSLPAPVGVEAEAAEQRREDAPPSKK

SEQ ID NO: 210932 - protein, 79 aa, Triticum aestivum
  Clone ID: PAT_TA_105350.pep
IINAYDDMNDRCRPRRCAGSRCTSSSRRSWPARRPTCTRQRRRRRRRLLLLLLLLILIGRRRRRAATARPRLVGATTAR

SEQ ID NO: 210933 - protein, 76 aa, Triticum aestivum
  Clone ID: PAT_TA_105351.pep
CLLLPGELARHAVSEGRPLPSSPPRRLAALVSSHNVLISPGCLKNPLYALVRYLDCINLYIVGEITLDALICVMPA

SEQ ID NO: 210934 - protein, 178 aa, Triticum aestivum
  Clone ID: PAT_TA_105352.pep
QLAYHHGMITNLLNSSILYVSRFVVTRPNPGIRHQSVIAGSTGWASAPDGNEDTRAEAGMVGAEVGLLRHVLHLHLGLRVRIGAGSLLGALANSRGPALHVPAAAAAAGVAVPGVLRLGARLAAPAAVGMIIVSRSERGDPLLLGASAALLPLTGGDGIWQERDEIGSEGSGRGGTRS

SEQ ID NO: 210935 - protein, 90 aa, Triticum aestivum
  Clone ID: PAT_TA_105353.pep
FPVVRCRLVPRVDVGYLLGGDIAAVESVVASIHEACPDHADFISSEPTAGVRDAEHSRKRRRLEDAALDGDEIDSYNDASEVRCQFKRYA

SEQ ID NO: 210936 - protein, 58 aa, Triticum aestivum
  Clone ID: PAT_TA_105354.pep
RALSGQAAATVPPVSVLPERPRLVAGAAASLMDLDVRLSFHSSWVMCCCRHSRLQNAA

SEQ ID NO: 210937 - protein, 50 aa, Triticum aestivum
  Clone ID: PAT_TA_105355.pep
GTPVTQVVYTVLLSWVADVARAHGVPAALYWIQPATVLAAYFHFFRGTDG

SEQ ID NO: 210938 - protein, 160 aa, Triticum aestivum
  Clone ID: PAT_TA_105356.pep
MAELVVAANLAASVAGRNAPKLWDYLVQDRKLRAELKHGISYIRSESLMISAAIQQDGDRPPWSDNPVHKVWITMVRDLAYDIEDCIDRFTHRVTLKPDVSWIDKKFHRMKTRSARNKFAAAIRRLRKKSEDASKLRASYSTSEYGGGSSTLESEAPSDE

SEQ ID NO: 210939 - protein, 146 aa, Triticum aestivum
  Clone ID: PAT_TA_105357.pep
SSFCSRYLPPYTTWFPFEESSGVKDHPTEETPGVRLLKSTALSQLSYLAIFIIAICVTERENLEEDPLNFSLLSIVVEVVSAYGNVGFSMGYSCSRQISPDALCTDRWTGFVGRWSDSGKLILILVMLFGRLKKFSIKGGKAWKLG

SEQ ID NO: 210940 - protein, 83 aa, Triticum aestivum
  Clone ID: PAT_TA_105358.pep
RGGRLERASRSAPWWLLGRNPWRSSPCEVASSSKLQVSLHELVLYLGVPADRLCTRCCSAGNNGMEQLPQLIWRAGRKRCYPQ

SEQ ID NO: 210941 - protein, 154 aa, Triticum aestivum
  Clone ID: PAT_TA_105359.pep
VDHGRRPLAVAPPHGEQRPDPAVPAAAVGVRPLDVGEAAPVRHGRGRRVGADGGRRRWCRRHCHGRPASFGDVVRPKDRSLIDRSVGCDRGERGPAGNRSGGGRRFASWLAFAASLRPCAAARRARPRERATALGELGGESGGFGSPEKRRAVV

SEQ ID NO: 210942 - protein, 92 aa, Triticum aestivum
  Clone ID: PAT_TA_105360.pep
MANLLHLPDLAAARPPAAGVARRREARVVAAARAGGRVKQEEPGTGTGRGRVIRVTDPVRNGRLPVPAPPPLFSVPMTPASESPAATTRRDD

SEQ ID NO: 210943 - protein, 67 aa, Triticum aestivum
  Clone ID: PAT_TA_105361.pep
LCVTSFAIWNGTPESLFPHLIVCHIIHEGDESELAVGSLAMWITSSSGNQALILIRLVVGGWETKLT

SEQ ID NO: 210944 - protein, 93 aa, Triticum aestivum
  Clone ID: PAT_TA_105362.pep
RPTPRPSPTPPRRARHGPRSGRILCPWIPSHNRRPRQPSGKCPERRSGASRPAGKQAAERGFESCRGGGVDSGRRIWIVPALDSARLSWLAPL

SEQ ID NO: 210945 - protein, 121 aa, Triticum aestivum
  Clone ID: PAT_TA_105363.pep
LRWEGRSMDAPEVVPQRVHPKKKPCVDGNQQQHSQSQTSMGQCHTISEVLNDDNLLIEILIRVGFPTTLVRAALVCKRWYHHASDRGFLCRFRKRNPPRLLGLYIDVRWTWLGLYATPRFV

SEQ ID NO: 210946 - protein, 122 aa, Triticum aestivum
  unsure (1)..(122): unsure at all Xaa locations
  Clone ID: PAT_TA_105364.pep
CERGCAPDCTYNSNGRRGRRLGNAGLRRLLHRLLSVLRSVRRAGLQCQRRPSLVSSSARRAGRRRLLHRLLSVLRSVRRAGLQCQRRPXLXSRSARRAGRRRLLHRLLSVLRSVRRAGLQRR

SEQ ID NO: 210947 - protein, 91 aa, Triticum aestivum
  unsure (1)..(91): unsure at all Xaa locations
  Clone ID: PAT_TA_105365.pep
GASWTCADGLGAGRSSGGRSPAPAXRPSGQPPRSANTDDEYFAKASPANGGQSPPPPTPSGPSPAAPAMAPDTTSTPIRRRSKLASRPASS

SEQ ID NO: 210948 - protein, 148 aa, Triticum aestivum
  Clone ID: PAT_TA_105366.pep
YPAFRRHTVPTAIIPLPAAFLRYLAGRTAYPDPDEGDQGPLPFVLPTLTSGRAPFPPLQGHFPDPVSLLDRDNTDPLFGDSDSDDEGLLPPAFPELEAAVDAAIAGLGGAALPKLNWSAPKDAVFMAADGTVRCTCFAEVAMLLRASD

SEQ ID NO: 210949 - protein, 128 aa, Triticum aestivum
  Clone ID: PAT_TA_105367.pep
PVLDFLRQNGSPFMINPYPYFAYASDTRDETLAFCLFQPNPGRVDAASGLTYMNMFDAQLDAVRAALDGKGYAGVDIVIAETGWPYRGDADEAGATPDNARAYNGNLVAHLRSQVGTPRTPGRSVDTY

SEQ ID NO: 210950 - protein, 79 aa, Triticum aestivum
  Clone ID: PAT_TA_105368.pep
HDIHPSVCLVVGKVWCGNNRVGVKVCKKHILFQYEAFPVLLMEQTILGSANYLTTLTQESQATCKCGERLQQNVKQSKM

SEQ ID NO: 210951 - protein, 135 aa, Triticum aestivum
  Clone ID: PAT_TA_105369.pep
ARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 210952 - protein, 83 aa, Triticum aestivum
  Clone ID: PAT_TA_105370.pep
HLFLLLPLTCCPPSPADPWRWKLVGGGEMVAVQQSCRSAGADPMTLPQIKRRRHRLSPPCPHVSDLSGMSGEGAGWEWEEARE

SEQ ID NO: 210953 - protein, 102 aa, Triticum aestivum
  Clone ID: PAT_TA_105371.pep
NVGSSAVCTNVAATSVSRRGASSWPRPRRWPPPAPWRRAGPPPPPPARSSPSPSATRPPRWPSCAAPTPARTRPTTPRLSPPPAASRPPSSRPPPSSPPVHG

SEQ ID NO: 210954 - protein, 145 aa, Triticum aestivum
  Clone ID: PAT_TA_105372.pep
PPAMALPPPRSCHITGHGGSGSSAEPALTRSLEAAIALVPCAASDILLHHRPWRLGLLCRACSGRSVETAVALARPQGRLPLPPPTGQAGQADAHAPLSSSIPLLSNLSHTFSPGSPHGGRRLSACIHPPPDPPPVSSREPAMEV

SEQ ID NO: 210955 - protein, 77 aa, Triticum aestivum
  Clone ID: PAT_TA_105373.pep
WPPPVWVVDLRATSCRRGASRRRPPPPPPPPQAVTVASPPPWLACVSPTREDDVDHAAEPSGRGPTQWSSPRIDGRR

SEQ ID NO: 210956 - protein, 86 aa, Triticum aestivum
  Clone ID: PAT_TA_105374.pep
MRRSSGAAAWALGVAVAFFLAAEAAGAAPVPHDYEQALRKSLLYFEAQRSGRLPYGQRVAWRDHSGLTDGLEQGVDLVGGYYDAGD

SEQ ID NO: 210957 - protein, 62 aa, Triticum aestivum
  Clone ID: PAT_TA_105375.pep
TATHRAEFVTGHMALSRLCLKKALAGRAAAMARPASSSSHGGMDLRSLFSAAADSAATRAPL

SEQ ID NO: 210958 - protein, 71 aa, Triticum aestivum
  Clone ID: PAT_TA_105376.pep
TNRWVVALSAIKVELQVCSMAHAPPEMVRLAAGTICLLLRVSDSTVDRPIDHLLLSWDDSRPPFQSLIKPS

SEQ ID NO: 210959 - protein, 123 aa, Triticum aestivum
  Clone ID: PAT_TA_105377.pep
LPTSAAAATAAVRIFQPTGFRLPRTSSVFAPKRSASRRLSGITCSPGIASVAGQATSPEDAVRIVAVVGDGSISPLKDTPWDEVMRHTADRLKWVDEGFEMLVFTDKSIDHDDLKKELSHCDM

SEQ ID NO: 210960 - protein, 77 aa, Triticum aestivum
  unsure (1)..(77): unsure at all Xaa locations
  Clone ID: PAT_TA_105378.pep
LGTRLNFGGXPLRYATGGPTAGAQKIVSLCDRWQKKPAPNPKXPAPVGTLSVRIDDELAKWYGPDRRIYLPNGLLDR

SEQ ID NO: 210961 - protein, 136 aa, Triticum aestivum
  Clone ID: PAT_TA_105379.pep
MTSTVTTPTPSRPLPAGPQRRRYRPTVLAIAGGSKPPRRRAPAAATSCAALAAPEKQSTAPSKLPAPSPAPEGTDYDEVAATLETLYKLSPVIVEEDGKRSKKQAATKKKRKQGRAKSGAATTTAATPRRTVVVRS

SEQ ID NO: 210962 - protein, 78 aa, Triticum aestivum
  unsure (1)..(78): unsure at all Xaa locations
  Clone ID: PAT_TA_105380.pep
DQIPKLTTLSTIQFKTGLCFRXHNRKVSHSSSLCFRRNWELPLHCFFTNISASILFTALFLDAHSLQITMSIGRKKLM

SEQ ID NO: 210963 - protein, 168 aa, Triticum aestivum
  Clone ID: PAT_TA_105381.pep
AGCPRHGDDGHPDPYLDLPLEIAEERRRAARLADECRRQHRETTTCLLSLPAPVAMDGDAHLVSLLDLHPELPEERRRPEPSSFHKTEIEEHASEVSNSEGSVTMGLSEITALALNDISPILQSTYWSNVCYDTGSSESESDTVVEKPEDESDFDLDKELQDMEDYLK

SEQ ID NO: 210964 - protein, 100 aa, Triticum aestivum
  Clone ID: PAT_TA_105382.pep
LNTTVVIHATGLTNKFLLPYLHYRTCARLRPRAWVPVRLDGGGNRVVLLLVEDVDRRRLRWVVVAVRVGVPGVRVVFDHRGRRLLPRPPWRRRPAAAARG

SEQ ID NO: 210965 - protein, 121 aa, Triticum aestivum
  Clone ID: PAT_TA_105383.pep
GTFYQPRTPEENIMVKLAEWIKDVAQGRTAEGEPIPSVAIVAPDKEETLAIAEKASVMWKESCSHGRSVMIDIPAVHILSRALRTRDILYYILRKLQSSYCRRFIYHQDRVCQWICSQAGE

SEQ ID NO: 210966 - protein, 97 aa, Triticum aestivum
  Clone ID: PAT_TA_105384.pep
VARARPPLKKAASLWLPSPPLHSAVFLSTNHSPSPSPPLAPASTLLQRKHAPARARGNPACSSCGSSSSSASSVVTKDQEGAAAAAEATAPAPAPAA

SEQ ID NO: 210967 - protein, 124 aa, Triticum aestivum
  Clone ID: PAT_TA_105385.pep
FAGTNQILLPCLFAGIIFCTTFLLQQFWFFATTGTVVCYILFHEIVETLRLCVLLQPCTVFATTGEAPSWTTSYFCYNRFVVCCNQCQFLLPPTSLIFLEPALDFLFLLPLAFRFAGTSFNFCY

SEQ ID NO: 210968 - protein, 74 aa, Triticum aestivum
  Clone ID: PAT_TA_105386.pep
HYTPSMTNGSTKCFFFAHFFWVRFLWLVAIKDSSDLSVKVILYSPCSNTWTCCHMCSLSSTTQQRFSVLLSLSY

SEQ ID NO: 210969 - protein, 186 aa, Triticum aestivum
  Clone ID: PAT_TA_105387.pep
MHVMHFVLRPYIGVFVVVYFDDILVFSKSIKDHVTHLRTILQTLRKERLYANMDKCLFGVDKLVFLGFVVYSKGVHVDESKIEAIKIWPQPTNLKQVCSFLGLAGFYRRFVKDFSTIALPLHALSKKNEPFIWGPQQDTAFNELKNLLTHAPLLALPNFNKPFEIHCDASGYGIGGVLIAREAPHS

SEQ ID NO: 210970 - protein, 149 aa, Triticum aestivum
  unsure (1)..(149): unsure at all Xaa locations
  Clone ID: PAT_TA_105388.pep
FASRRSSSAYAERRHGHRAACRGGPRQPRPRAMATRGGPGRGRTRRPAPRSRAPAGRRKERRSRVATAVVWRWKRHRSRAGPRRAGGGLCXVRAWPTVGGELHNQLKGEPAPSSLRAGPWLQELHADAGSRVGRLLPRLPRPSSSSPGR

SEQ ID NO: 210971 - protein, 59 aa, Triticum aestivum
  Clone ID: PAT_TA_105389.pep
IKCSQIQIMSMFFFKLLFQKMFMNLKRCSCFKFCSYFSENVHNFRNSYLRFKKWFIFLQ

SEQ ID NO: 210972 - protein, 77 aa, Triticum aestivum
  Clone ID: PAT_TA_105390.pep
SILVTTFFYLCCGCFAYAAFGNDAPGNLLTGFGFYEPYWLIDFANACIILHLLGGYQVLLLPKTLKLKLLQAGFITE

SEQ ID NO: 210973 - protein, 80 aa, Triticum aestivum
  Clone ID: PAT_TA_105391.pep
STRPRFYFCRPSNQGLPPPGTDLHPCLLIAHARPRHRSSPAEAVLPATPATLLHVAPRSLGTGSATYKVATEIINLGSKN

SEQ ID NO: 210974 - protein, 69 aa, Triticum aestivum
  Clone ID: PAT_TA_105392.pep
HLLLASIHAHRPHRSKDYARKPGSAHAHHRTPLPVRGSIRRRKTEERPTPWRGKAAAVSGWLSPTERAR

SEQ ID NO: 210975 - protein, 69 aa, Triticum aestivum
  Clone ID: PAT_TA_105393.pep
RPCLGGLSGACVRELPEVGACCGAVVLGGGQRQLRHGLHVAVGGRPWPDPWASRPDLWAGGGCREMEVV

SEQ ID NO: 210976 - protein, 41 aa, Triticum aestivum
  Clone ID: PAT_TA_105394.pep
GDFSCMRNICFQINNLKIIFYDYSETETRCMTQRRAAEKGR

SEQ ID NO: 210977 - protein, 119 aa, Triticum aestivum
  Clone ID: PAT_TA_105395.pep
MAPSREACAIAMAVAAPFIAMASNISTDNVEKRRRTSSDMLQRTVSDVSLQLHHHGPAKEEEEAAAEAEMKLLHPVSEVEDAKCECCGMSEECTPEYIRGVRGRFSGRWICGLCAEAVT

SEQ ID NO: 210978 - protein, 84 aa, Triticum aestivum
  Clone ID: PAT_TA_105396.pep
SGTFSNVCMCSSILPYSFTGKTDRNSNSVSFKDQAEASVFNSHKELNIQNVLVICILQLYIAFEDCILALDLSLKSTEKKTIAG

SEQ ID NO: 210979 - protein, 153 aa, Triticum aestivum
  unsure (1)..(153): unsure at all Xaa locations
  Clone ID: PAT_TA_105397.pep
RLDRNSLSGPVPANLNNLTKVNELNLANNQLNGPLPNLSGMTLLNYVDLSNNTFDPSPSPQWFWKLPQLSALVIQSGRLYGTVPMKLFSSPQLQQVILDGNAFNGTLDLXRSISSELSMVSFKDNDFSSVTVTXSYNGTLALAGNPVCDHLPN

SEQ ID NO: 210980 - protein, 64 aa, Triticum aestivum
  Clone ID: PAT_TA_105398.pep
PRRGSRRVRQRELMPRSPRRRSSCTCSSGGLTEPPTTRLPCIHACNDPCTKTRLSRVQCLLLLF

SEQ ID NO: 210981 - protein, 124 aa, Triticum aestivum
  Clone ID: PAT_TA_105399.pep
SADNRFRAWDARSILRGGSISIYLSTYDCFLLRVPIICRTPSRNQRPGLIRRAPPRRICLPGSVSRTVLTRSCGKSVSAGKWRQRLGPFHCGCRILLLFRNMKTGPKKRGKGIQFFLRNGKMRG

SEQ ID NO: 210982 - protein, 139 aa, Triticum aestivum
  Clone ID: PAT_TA_105400.pep
SALPPRPRQLPGNMMTFMCLCNTQPLEEFLIDCPLVYTVSIFGGEMSEAATDHGRCLFQAIMADILKNHLDNISWDGAFSIADVLIVKHEEYVNVKIQKEPVKFEGRRQLEARVKDLNRAAAVFIPLYQNSNGVLPVFF

SEQ ID NO: 210983 - protein, 112 aa, Triticum aestivum
  Clone ID: PAT_TA_105401.pep
MSPPPASPALSAQKLTTNDALAYLKAVKDKFHDNRAKYDEFLEVMRDFKSARIDTAGVIIRVKTLFSGYPELILGFNAFLPKGFAIKLQDIDGTGDKKQPVDFMEAINFVNK

SEQ ID NO: 210984 - protein, 72 aa, Triticum aestivum
  Clone ID: PAT_TA_105402.pep
VKDAGSTAGSCFLWWLWLLQADSTSSSVGFSGNGFSNSRRSAPSPTAVAMCAIQQAALLSQSDRRNRKAAIL

SEQ ID NO: 210985 - protein, 87 aa, Triticum aestivum
  Clone ID: PAT_TA_105403.pep
MKTLLILTILAMATTIATANMQVDPSGQVQWPQQQPFPQPQQPFCQQPQRTIPQPHQATTTTTTTITSRCMRPPARALNKIKPSCVP

SEQ ID NO: 210986 - protein, 129 aa, Triticum aestivum
  unsure (1)..(129): unsure at all Xaa locations
  Clone ID: PAT_TA_105404.pep
VRRRLHLDTYTSTQPWHTYMGMGSSYYLFLLSISNISXGFLQTSPSAQPGEKEASVTLPGPFPSPEYLIIFSLFLPRPAETLSDSRFFGARSVVFDVPVPLPNNIGATDILEMLSSSSTKALSASLAQL

SEQ ID NO: 210987 - protein, 126 aa, Triticum aestivum
  Clone ID: PAT_TA_105405.pep
CHLAPSSAAPPPRRPAARLLARPPLTGDPPGLSPSRAGRETAMTAAVAGADDERKAQALVRDDAPKLLAALKEMKDGLDLVRSKVESLTRKVRKNQLPTGDGIGYLEAKHHLLLSYCQDLVYYLLR

SEQ ID NO: 210988 - protein, 69 aa, Triticum aestivum
  Clone ID: PAT_TA_105406.pep
MGSRALLLVAVVLTAQLCACTAYAGSGGDGFSVEFIHRDSVRSPFHDPTLTAPARVLEAARRSATRAAA

SEQ ID NO: 210989 - protein, 175 aa, Triticum aestivum
  Clone ID: PAT_TA_105407.pep
ASGDGAGGAQGAYECAIGNFGVPQYGGTMVGVVAYPKANRKACKGFDEFDVSFKARPGALPTFLLVDRGDCYFAKKAWNAQNAGAVAILVADDRDEPLITMDTPEESGRVEYLENITIPSALISKSFGDRLKKAIDNGDMVNVNLDWRESLPHPDERVEYEFWTNSNDECGPKCN

SEQ ID NO: 210990 - protein, 178 aa, Triticum aestivum
  Clone ID: PAT_TA_105408.pep
CYRRWGCLTLKIGDFGFARSLMHENLAATFCGSPYYMAPEIWRGDKYDAKADLWSVGVILFQLVTGELPFLGENRVELREKVLSSSGLSFPPDMEADLHPEFIDLCRRLICLDPAERMPFEEFFNHNFLATARNSEIMDESHHALDLRDTCQTVSSAVVKVKSESVDSKVFDSWEWIE

SEQ ID NO: 210991 - protein, 89 aa, Triticum aestivum
  Clone ID: PAT_TA_105409.pep
WCSTDNYSRRGSPLHTLRSYWSSRSPCRARSMLPQQQLLHRCQDRTGTTASASAATTKATLLTGRVPMRTRALPPPTQTSPSSCMENAK

SEQ ID NO: 210992 - protein, 53 aa, Triticum aestivum
  Clone ID: PAT_TA_105410.pep
MAHGQESSTQAAAGGAAPLCANGCGFYGSEASKNMCSKCYRDHLKAGDVAAPA

SEQ ID NO: 210993 - protein, 55 aa, Triticum aestivum
  Clone ID: PAT_TA_105411.pep
RRYKIGPSRFMGPCKERLVVLMHGTIVAPEEPSEWDPKSPRLWLLFGGLVGARIQ

SEQ ID NO: 210994 - protein, 104 aa, Triticum aestivum
  Clone ID: PAT_TA_105412.pep
CDGSCRIPRPHKVHPPALPDRAVKRTQSAGDEAGGATTFVLKRLRVPGMRVRQGASWAVSSHHQQPHGRAGGVLPRIQIYASRCRLQHMLPSPPCVARVMGSIV

SEQ ID NO: 210995 - protein, 53 aa, Triticum aestivum
  Clone ID: PAT_TA_105413.pep
GHEYYKMGESCNPPLQQFVEYLRMQFLVAPGKIHTQKGLQTPKLAKKAGKASK

SEQ ID NO: 210996 - protein, 49 aa, Triticum aestivum
  Clone ID: PAT_TA_105414.pep
WCTARRKLWRASFARPRTPASPPLPCRARPGRASKGRGRCPCRGLDSRS

SEQ ID NO: 210997 - protein, 81 aa, Triticum aestivum
  Clone ID: PAT_TA_105415.pep
AWAWGPGLLQARHPPPTNNRDFVWCVVEVLLLRIIVVILVDVMGLLNYTTAGCSSLFQGLNSSLAFQMAMNNGINNNGTCI

SEQ ID NO: 210998 - protein, 61 aa, Triticum aestivum
  Clone ID: PAT_TA_105416.pep
PKPQVTLPLRRGSRLLVSCSATSPSSSSNAAGGVGFQGRVGFLGLRIMGAPMASNLIKAGR

SEQ ID NO: 210999 - protein, 76 aa, Triticum aestivum
  Clone ID: PAT_TA_105417.pep
QVARRCQYTQREDDATGGHGVLLSALVCGFLSCSASSFASHGSGIRRRARCRDILRDQVHGPRPRPHDAAAAGVRP

SEQ ID NO: 211000 - protein, 57 aa, Triticum aestivum
  Clone ID: PAT_TA_105418.pep
LIYIDIPYGNAINIISLELVTKPSHRNEHLNHLRYLASPCVTAKNVFYDFINQTICS

SEQ ID NO: 211001 - protein, 32 aa, Triticum aestivum
  Clone ID: PAT_TA_105419.pep
MTVIDILTRVDVICQKYDKYDAEKLNGANVAG

SEQ ID NO: 211002 - protein, 77 aa, Triticum aestivum
  Clone ID: PAT_TA_105420.pep
GSCREQLLREVSRLVDAHSAKKGEDVSVTLAGHSMGSALALLLAYDLAELGLNRAAPVTVFSFGGPRVGNAGGGARC

SEQ ID NO: 211003 - protein, 102 aa, Triticum aestivum
  Clone ID: PAT_TA_105421.pep
VRKAAILDADALTIQVASLGHRLVKANEFLNTGIKSLEEESGFQREWAQFVENSQAQVTRLLEEEKKLRLMVRSTVDYFHGSKGKDEGLRLFVIVRDLLVIL

SEQ ID NO: 211004 - protein, 44 aa, Triticum aestivum
  Clone ID: PAT_TA_105422.pep
CYKIIEGICNGLHYLHQQIDKSVLHLDLKPANVLLDNNLAPKLT

SEQ ID NO: 211005 - protein, 37 aa, Triticum aestivum
  Clone ID: PAT_TA_105423.pep
DIITAPAAKELDLWHLGSGGSTKVCGACRRNVGFITP

SEQ ID NO: 211006 - protein, 149 aa, Triticum aestivum
  unsure (1)..(149): unsure at all Xaa locations
  Clone ID: PAT_TA_105424.pep
SIPADREVLSQPADGGLDTNPTSSLGGTNGNVHPAPRKVSASSQRSTVLAAHNDATANPTGEGESIELVDSTVKRQKNXVPVEEQERTGKRRKGEIEGRDDDLTEHTDKEKRMDLRSVDKFHSVDHERGNNEEQNIIRTEKLKEKFDEK

SEQ ID NO: 211007 - protein, 135 aa, Triticum aestivum
  unsure (1)..(135): unsure at all Xaa locations
  Clone ID: PAT_TA_105425.pep
LLSHNPKPVPAADLLSPNPSPADDLLPHALTARRHRLVHSRPRPPPSTPPSPSLHAETVDRRHGHLTGEAGGEEPXHGDTGEIWYGSPLSSSSRFLHFARISLRLSEFFCGSYGQGGHHGQARCHGDLARSTGGS

SEQ ID NO: 211008 - protein, 126 aa, Triticum aestivum
  Clone ID: PAT_TA_105426.pep
GRTLVTTTIRTCYNPVKGNGRQKQYPLQTKDVNKIYPSHTSKKDRKRAVHEVYSVESFEPKYNPWLKILITCVWDDHQTIVHHGGLPALVLDPIFNSFHLIELEPQLREYTEKDALEQVMYQAGEN

SEQ ID NO: 211009 - protein, 88 aa, Triticum aestivum
  Clone ID: PAT_TA_105427.pep
APYPPLLPNSTPVLPCFAVCLRPSSSSSSTRVPAVELQSHLLTPFQSDGYGCARMDSSKAPTAMQWPREPGRGSQNLFSAPFRQITDT

SEQ ID NO: 211010 - protein, 148 aa, Triticum aestivum
  unsure (1)..(148): unsure at all Xaa locations
  Clone ID: PAT_TA_105428.pep
DEKEQKKKGKGEKKARGSRVAFATKSDVDHLDDGYRWRKYGQKAVKNSSFPRSYYRCTAARCGVKKLVERSXQDPSTVVTTYEGRHGHPSPMAAHRGARMLMATGADTAYSLAALQHHQHDLLPAGADVYGRMCMQPTTAAAPSVAHR

SEQ ID NO: 211011 - protein, 78 aa, Triticum aestivum
  Clone ID: PAT_TA_105429.pep
LSVGHDNDKQSKWSCRLKPQSNYKSHVRNATMASKDISNVHDAISRTKSERKSSKTKRENARPLDNQIDKSPFSQEKL

SEQ ID NO: 211012 - protein, 57 aa, Triticum aestivum
  Clone ID: PAT_TA_105430.pep
VPNGRHQRHVHLWVADGVDPSPWLTTPSYSRRKQLHSDLCEYKRLRSSGNATKSFQT

SEQ ID NO: 211013 - protein, 156 aa, Triticum aestivum
  unsure (1)..(156): unsure at all Xaa locations
  Clone ID: PAT_TA_105431.pep
RRLEEAEKKRQAMMSALKEQSKSKGPNFTINKKEGXNLSSAQIERNKTKEQLEEEKKIGLSFRIKPLVLDNMSVDKLQLKASDLWEQIVKLETEKYDLEERQKRQDYDLKELKERQKQQLRHKALKXGLDPEALTGKYPPMIQVASKYERRVDTRS

SEQ ID NO: 211014 - protein, 186 aa, Triticum aestivum
  Clone ID: PAT_TA_105432.pep
PGSTILCADGTITLTALSCDPEKGLVRCRCENSALLGERKNVNLPGVIVDLPTLTEKDKVDILQWGVPNKIDMIALSFVRKGSDLQMVRSVLGEHAKSIILMSKVENQEGVANFDDILANSDAFMVARGDLGMEIPIEKIFFAQKVMIFKCNQQGKPVVTATQMLESMIKSPRPTRAEATDVANAV

SEQ ID NO: 211015 - protein, 138 aa, Triticum aestivum
  Clone ID: PAT_TA_105433.pep
DDVELVAVNDPFITTEYMTYMFKYDTVHGHWKHSDIKLKDDKTLLFGEKPVTVFGVRNPEEIPWGEAGADYVVESGGVFTDKDKAAAHLKGGAKKVVISAPSKDAPMFVVGVNEDKYTSDVNIVSNASCTTNCHTEDR

SEQ ID NO: 211016 - protein, 69 aa, Triticum aestivum
  Clone ID: PAT_TA_105434.pep
CFLPSARLLFLSQKTLSSPINPIGWTSIPPEVDRSSRNYPGLYERLIDPLQLSLFLTLHGSGGTRLSFG

SEQ ID NO: 211017 - protein, 171 aa, Triticum aestivum
  Clone ID: PAT_TA_105435.pep
RQCSACTGKVTTAALKIWTVLMVILSPWKCNRLSKMPTILKGVLSPCECNHLLKMQTLLMRILSPCECNHLLKIWMILLDFSPPTENVNNLFGHSQPTQMQPSTEAVHHFAQMQPSTEAVDHSNGHALTMQMQPSSEVVDHSNGHAQTMQMQLFCRPTKLRQTMLQWDYLS

SEQ ID NO: 211018 - protein, 136 aa, Triticum aestivum
  Clone ID: PAT_TA_105436.pep
MCEYRSLVVLDGLRSREDWDLIKATFLPDSTNACIIVITNEASVATHCVDNKEDRAVNVGGVEADMTLVLFKQIIKDGMEFTPDEMELSKVTLGRCGGIPKVIATIGQLFTKENASPTLTVAQIPSSHAFSICQSS

SEQ ID NO: 211019 - protein, 72 aa, Triticum aestivum
  Clone ID: PAT_TA_105437.pep
IVYPLLQLWDVNMDSGPVATFQVHEYLRPKLCDLYENDSIFDKFECCQSGDGLRVATGSYNNVVRVFNCGAG

SEQ ID NO: 211020 - protein, 120 aa, Triticum aestivum
  Clone ID: PAT_TA_105438.pep
LIKAAAAAIDKLPELDAAAFPNHPASASANKQSSALHAEADGSQLQQQQLTRSGCSSTSETSKGSVLSLSRSDSRVKARERARDRSASVKDKDDSVTAAVRRRAPSAQAASFTELLTGLA

SEQ ID NO: 211021 - protein, 79 aa, Triticum aestivum
  Clone ID: PAT_TA_105439.pep
PRRLDKSIGASRADGLAGLLLSLPSLAFTRFWHPHRHWSHTQIIDEKTTIKKYRRRLIIFVDMSISVGPCTHAFPSTLL

SEQ ID NO: 211022 - protein, 125 aa, Triticum aestivum
  Clone ID: PAT_TA_105440.pep
MALPNQNTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGN

SEQ ID NO: 211023 - protein, 129 aa, Triticum aestivum
  Clone ID: PAT_TA_105441.pep
MPGNRPLIQQFVPAVIPRPPFVPFLPGPIPNPSFIQHHQMQHLQQLHHRFAHQRRQFYPRPGTPYQHHDRSSNDDEYAGLMTQSNKEWLIKIQNSALNFTNPYKEEFYFVSFKTKQLATAAKAKKGDNG

SEQ ID NO: 211024 - protein, 59 aa, Triticum aestivum
  Clone ID: PAT_TA_105442.pep
SLSVGYESDFYWCMIDRIWDGYLHSPLHAAGQMLNPKLFYTAGFQPDAEISSGIAACTI

SEQ ID NO: 211025 - protein, 186 aa, Triticum aestivum
  Clone ID: PAT_TA_105443.pep
DHRTCTAHALIAGMDLKRRIYGALFGLYVPQELDIRDLLMKFFWRFGEVLGHEKTRDLISHRIHCLMSIAQVEGVGYENASAMVPDVYPVAPLGRVLKVAACFFVTKDMVDRIVRLLAGGFPLVTAVPTGRCFRYVAAGQIYNAPSIPQNHAVLLIGFGTAPWPGDDFAQQNSAVTANWPTDPTTG

SEQ ID NO: 211026 - protein, 130 aa, Triticum aestivum
  Clone ID: PAT_TA_105444.pep
HRVIGTLLGSVEKGVVEVTNCFCVPHKEYEETVEAEIVYAKEMFEFNKQVNPQENIVGWWATGHEVTSHSSAIHDFYSRECANPIHLTLDTTLQGERMGVKAYLNVPIGVPGGKVGCMFTPISVDVICYE

SEQ ID NO: 211027 - protein, 143 aa, Triticum aestivum
  Clone ID: PAT_TA_105445.pep
LALAGGLARAVARGARSVQTWPFLAPVVVMGSLAGGSAWCRWRRRAVLIGGFGLWWRFRQAVALMCRFEGRASFASRGESHALALAGANNGDACGCRAPSWRCRHSRAYGLFSRTPEETLVPGSWSGRWRRFRVAVLLRGIVL

SEQ ID NO: 211028 - protein, 134 aa, Triticum aestivum
  unsure (1)..(134): unsure at all Xaa locations
  Clone ID: PAT_TA_105446.pep
ARTKQGGRLNRRFTNNDKLPAHLTSTSMASIRRPIKQLDELRLASLLXCLPDNVCPSSHVLEKDVLQAGRGGVDLGGLRQQWRPAVRARSTTRMRAPGMNSTGRRCSPSSPDGTGALALFCAGLRSGRCLSRSL

SEQ ID NO: 211029 - protein, 124 aa, Triticum aestivum
  unsure (1)..(124): unsure at all Xaa locations
  Clone ID: PAT_TA_105447.pep
RLVLQRAVTSAASSPSPSPPGWPRPLRYAVLGAGFAGLSVAWHLLKQSPKYSRVSVDGXDENGVXGGASGVSGGLLHPYSPKAKLLWRGGEFWKESMDLLRSAEKANGIAGSDGDGRDDEALIW

SEQ ID NO: 211030 - protein, 145 aa, Triticum aestivum
  Clone ID: PAT_TA_105448.pep
RHEVGSSCGSIFDKMIKGKANTAHCVRFPGDWFHVFGIGTRSTGYSIRVQVKKGSSVTEVIVSPENKTVVSKDNFLRVNLIGDLVGHESMPTFEDFYLVTPRKGGGEGQPQVLGDEFSWWMLLERVRFTLNGLECNKIGVGYEAY

SEQ ID NO: 211031 - protein, 56 aa, Triticum aestivum
  Clone ID: PAT_TA_105449.pep
LKYSFFQKRHLSRSKQTRNKIEYFCFLHQIFTIRQIVVSVVVLVLSAHTFVQTSCR

SEQ ID NO: 211032 - protein, 131 aa, Triticum aestivum
  Clone ID: PAT_TA_105450.pep
PEKYDKSCDIWSLGVIMYILLCGFPPFYSNHGLAISPGMKKRIRTGQYDFPNPEWQNVSPEAKELIRGMLNIDPTKRFTIEHVMKNRWIAQYTEVPQTPLHTGHMLRVGGDIWPDVQEEMTRSLATMRVDY

SEQ ID NO: 211033 - protein, 71 aa, Triticum aestivum
  Clone ID: PAT_TA_105451.pep
FFFFFFFFFFFFFINIGTLSLFIFELDSLVMMNGDHSYMKRVETTLPFSELLGLKGTRNYFMVGQFMRAID

SEQ ID NO: 211034 - protein, 70 aa, Triticum aestivum
  Clone ID: PAT_TA_105452.pep
GLRRRLRQRSLKQAKDPKQDLFDPPHTSAIVTKLAHTDQFRCLDKAAMVASPEEVRSGGAAAADPWRLCT

SEQ ID NO: 211035 - protein, 70 aa, Triticum aestivum
  Clone ID: PAT_TA_105453.pep
PGMTRFRPWSSQPCTRRAAAASSAAEGYGETRAAGLCAAGGDSSARARRAAMGLVATGAWLCGPTEWERG

SEQ ID NO: 211036 - protein, 89 aa, Triticum aestivum
  Clone ID: PAT_TA_105454.pep
QEGHHVVEQIVGQAVEPVDTAPLPRTLLEPQGMDAGADILSNRMANSRGGGTAVVVPDDSVEASAMRPQPEAAQRAVEEGGGAAQPREA

SEQ ID NO: 211037 - protein, 58 aa, Triticum aestivum
  Clone ID: PAT_TA_105455.pep
TCSVSRLFTKNCRCTIIYAKMYHRNNAEGLVKMGTPCSVLIKLISQRALATFSTESRL

SEQ ID NO: 211038 - protein, 123 aa, Triticum aestivum
  Clone ID: PAT_TA_105456.pep
MATQISKKKKFVSDGVFYAELNEMLTRELAEDGYSGVEVRVTRVRTEIIIRATRTQNVLGEKGRRIRELTSVVQKRFNFPENGVELYAEKVVNRGLCAIAQAESLRYKLLGGLAVRRACYGVL

SEQ ID NO: 211039 - protein, 51 aa, Triticum aestivum
  Clone ID: PAT_TA_105457.pep
LLVIHITFDQEYSILCKASTPISTWKASVKCTHPVPKIEKNITEAEENERK

SEQ ID NO: 211040 - protein, 121 aa, Triticum aestivum
  Clone ID: PAT_TA_105458.pep
FSDRYYEESPELFVNRDAALVLSYSVILLNTDQHNVRVKNKMSEEDFIRNNRRINGGNDLPGEFLSELYYSICRNEIKTIPEQGVGCSEMSFSRWADLMFKSKRASAYIACHSYPFLDHDM

SEQ ID NO: 211041 - protein, 86 aa, Triticum aestivum
  unsure (1)..(86): unsure at all Xaa locations
  Clone ID: PAT_TA_105459.pep
FLDVIXVEVGPGMVGIGTFGGSIFLCRRQAFAGRLCTVGLCLSFVADLRSSMASTHKLIMQTSGQYLPLFDFCGRVLITFIVCVFG

SEQ ID NO: 211042 - protein, 120 aa, Triticum aestivum
  unsure (1)..(120): unsure at all Xaa locations
  Clone ID: PAT_TA_105460.pep
EVIPPNITDREREREAGHQFRFRLYKFNPTATNASKPGAHRERAEVRHGPPPGPGVVGGLRHGLHGLHLHLVAVDAPGDIXVVILRRRRGHRLLLDLILHARRTAQSQKSTEIGRREAEN

SEQ ID NO: 211043 - protein, 184 aa, Triticum aestivum
  Clone ID: PAT_TA_105461.pep
MKTLLILTIIAVALTTTTANIQVDPSGQVQWPQQQQPFPQPQQPFSQQPQQIFPQPQQTFPHQPQQAFPQPQQTFPHQPQQQFPQPQQPQQPFPQQPQQQFPQPQQPQQPFPQQPQQQFPQPQQPQQPFPQPQQPQLPFPQQPQQPFPQPQQPQQPFPQLQQPQQPLPQPQQPQQPFPQQQQPL

SEQ ID NO: 211044 - protein, 113 aa, Triticum aestivum
  Clone ID: PAT_TA_105462.pep
PGFGFISPEDGSEDLFVHQSAIKADGYRSLNENDVVEFEVITGDDGRTKATDVTAPGGGALAGGSRPSEGGGDRGGRGGGGYGGGGYGGGGGGYGGGGGGYGGGGGSYGGGGG

SEQ ID NO: 211045 - protein, 67 aa, Triticum aestivum
  Clone ID: PAT_TA_105463.pep
MGKYMRKPKVSGEVAVMEVADGPLGVRTRARALAMHRQPHGAPGANDQGEYLELRSRKLDKLPPPPP

SEQ ID NO: 211046 - protein, 164 aa, Triticum aestivum
  Clone ID: PAT_TA_105464.pep
LHRYTADKLSSFGELALMYNKPLQSSVRAVTNGTLWALKREDFRGILMSEFSNIPSLKLLRSVQLFTRLTVLQLSQLADSLVEVSFADGQVIVDKDDDVSSLYIIQRGHVRLTVAADRLNSDSWDLLSTHGKQVQQSQESGNYVVEIDEGGHFGEWALIGETIT

SEQ ID NO: 211047 - protein, 173 aa, Triticum aestivum
  Clone ID: PAT_TA_105465.pep
PACQATDQLAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEPPAFQKTKLMTRLTYTL

SEQ ID NO: 211048 - protein, 115 aa, Triticum aestivum
  Clone ID: PAT_TA_105466.pep
DLTIRVIVKQGQQALFQAVYLGACGALVATMDNQFPKLGMTSADCQQMTWLQSAATPFLSFASNGTLEEVLLDRTVWTSAFTKAKSDYVLRAIPNAVWKDIFSRWFAMDGAGDII

SEQ ID NO: 211049 - protein, 153 aa, Triticum aestivum
  Clone ID: PAT_TA_105467.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFPQTQQPQQPFPQQPQQPFPQTQQPQQPFPQQPQQPFPQQSQQPFPQTQQPQQPFPQQPQQP

SEQ ID NO: 211050 - protein, 118 aa, Triticum aestivum
  unsure (1)..(118): unsure at all Xaa locations
  Clone ID: PAT_TA_105468.pep
SPPLSPTAPSASTRLCRLLPSPRWPPPPPLCRRLTQMRPQPAGAVGGGDAAKRSTSHRRRLPDDAVKESTREGGPLCAPSAADLXGSRPMRVTIQPHNEPKDAPWIHCPVCQSGFIRV

SEQ ID NO: 211051 - protein, 79 aa, Triticum aestivum
  unsure (1)..(79): unsure at all Xaa locations
  Clone ID: PAT_TA_105469.pep
VDYPFFLAFPPCFLGAGFLFHRKKLRICLFRFSKKPFDHCVLFSGYFPXDSCFCLVVCKCMWFFGSTGVVWCDVEDLLG

SEQ ID NO: 211052 - protein, 136 aa, Triticum aestivum
  unsure (1)..(136): unsure at all Xaa locations
  Clone ID: PAT_TA_105470.pep
CIIANKXVVIVKGLDEWPNEFQRQYGTIDLYWIVRDGGLMLLLSQLLLTKATFESCKIQVFCIAEEDTDAEELKTDVKKFLYDLRMHAEVIVVTMKSWESHVESSSSGAQPDDSQEAYTSAQRRISTYLSEMKETA

SEQ ID NO: 211053 - protein, 75 aa, Triticum aestivum
  Clone ID: PAT_TA_105471.pep
PSSNPNTNTNPYPTTPAASPPRPRGTHPRRRRSRNPSRREGSEGRFPEAGAWGTRVRRRRERRGCVMGGKQRVVS

SEQ ID NO: 211054 - protein, 182 aa, Triticum aestivum
  Clone ID: PAT_TA_105472.pep
TWFPGAVLNIAECCLLPWPSQNKTDDSTAIVWRDEGFDDYPVNRMSLKELRTQVMTVANALDTMFQKGDRIAIDMPMTCNAVIVYLAIILGGFVVVGIADSFAPQEIGTRMRVAKAKAIFTQDFIIRGGKKFPLYSRVMEGTSAKAIVIPATGDLLGVTPRNGDMSWKDFLSRSAGRSSMYS

SEQ ID NO: 211055 - protein, 119 aa, Triticum aestivum
  Clone ID: PAT_TA_105473.pep
MAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLP

SEQ ID NO: 211056 - protein, 165 aa, Triticum aestivum
  Clone ID: PAT_TA_105474.pep
HGGLSGIDLLGRIMNHEVCKDIPVIMMSSHNSMGTVLSCLSNGAADFLAKPIRKNELKNLWAHVWRRSHSSSGSGSGSAIQTQKCTKSKSADDSNNNSNNRNDDASMGLNARDGSDNGSGTQSSRTKRAVEIDSPQDMSPDQSVDPPDSTCAHVSHLKSEICSNR

SEQ ID NO: 211057 - protein, 159 aa, Triticum aestivum
  unsure (1)..(159): unsure at all Xaa locations
  Clone ID: PAT_TA_105475.pep
ITGDQLAIGKETXAELGMGTNMYPSSSLLGDKIDSDIAVLSVDELIEQADGFAGVFPEHKYEIVKRLQARKHICGMTGDGVNDAPALKVADIGIAVADATDAARGASDIVLTEPGLSVIISAVLTSRAIFQRMKNYTIYAVSITIRIVLGFLLLACLWK

SEQ ID NO: 211058 - protein, 139 aa, Triticum aestivum
  Clone ID: PAT_TA_105476.pep
MKRASTSFLSLTRSNSIPIPTERFAVPESSRHSYFWSFLGCRHGLAVLLNESLRKVVVWDPLTGQQHRVSFPQELSNEIFDEDGEFILWQWHAAVLCADTEEGHIHGDCFSSPFKLVIIRSGQSEGYFSTLPTYACLYD

SEQ ID NO: 211059 - protein, 50 aa, Triticum aestivum
  Clone ID: PAT_TA_105477.pep
NNAIQDMPVHEGIARLLSGTYINYFHCLKIIEILKETEADSRNVFGRYGS

SEQ ID NO: 211060 - protein, 108 aa, Triticum aestivum
  Clone ID: PAT_TA_105478.pep
CSFLIIFLALVPMQQGLPEAEFHEPGEKIVEASSNGHNGLVKKAVKKRTAQPPDGVPKMKRIKIDRKDDALYQQYVLSRYKIPRAKKDQVIGFPHITSELPWFIKATR

SEQ ID NO: 211061 - protein, 108 aa, Triticum aestivum
  Clone ID: PAT_TA_105479.pep
ISLPRPLLQAPPQARGAALLCSRPVPAHQPPRHWVATLVRRPPDVDLGADSGQAAARLGPASAHGPRPANQRRSGRPRWGLRCRPSCCTVRSGKRTRTRAATSRAGTG

SEQ ID NO: 211062 - protein, 64 aa, Triticum aestivum
  Clone ID: PAT_TA_105480.pep
CILDLASYHQTRRARSVGVTSFQNYSKNKKRNNSISPPNLNPHLAFTPKFRACSKMPLFRQSFL

SEQ ID NO: 211063 - protein, 136 aa, Triticum aestivum
  Clone ID: PAT_TA_105481.pep
VIMELKAKGSTSIKALLVEDIEVCRLVLSTILLRLHCEVTLAMNGKEAVDLFLEGKKFDIVLFDKNMPIMTGPEAIVKIRAMGETDVKMVGVSADDHAMEAFMSVGADLFVPKPMRMEALGPIIQEVINKKKNDMV

SEQ ID NO: 211064 - protein, 137 aa, Triticum aestivum
  Clone ID: PAT_TA_105482.pep
VLMIRSVFIKQYTSSNFLQLYRRAWDHRKGAAPCRPPPTCFCSAPPSGMRTCKPSIRRREAQEKTLRGRGQERSDESHLVEAGVPELVLDPVARLQPRAAGGERLDPVVDALPLGPPAVPRVVAAAAAAHRFGRRGC

SEQ ID NO: 211065 - protein, 142 aa, Triticum aestivum
  unsure (1)..(142): unsure at all Xaa locations
  Clone ID: PAT_TA_105483.pep
VGLINRDYADFVGLSARLXGVDAAAARMRAPLADLRDKVAAFRAAASAALAALRAGLEQRAAATQARELLELLLDTSHVVSKVEKLIKELPTAPSDSSDIEDRSVDKGYPGNDTTSPNVEAGTDVRETQSILLERIASEMNR

SEQ ID NO: 211066 - protein, 125 aa, Triticum aestivum
  Clone ID: PAT_TA_105484.pep
MSGRKKTREPKEENVTLGPAVREGEHVFGVAHIFASFNDTFIHVTDLSGRETLVRITGGMKVKADRDESSPYAAMLASQDVAVRCKELGITALHIKLRATGGNKTKTPGPGAQAALRALARSGMK

SEQ ID NO: 211067 - protein, 103 aa, Triticum aestivum
  Clone ID: PAT_TA_105485.pep
QGKVVVITGASGARGMGIEAARGCAEMGADLAITYASRPEGGEKNAKELAAEYGVKVKAYKCDVGSWDSVSGFVNDVIKDFGKIDAFIANAGRTADSGILDGS

SEQ ID NO: 211068 - protein, 133 aa, Triticum aestivum
  Clone ID: PAT_TA_105486.pep
RDKKKKGKTLSLGKFHIEVESAYPQGQSAVAQTRARTADPTPQTRRPNYKSKEEFPLLGASPAASSHKQNFHAAAHPPESDRLLPREQVMDVSGSPSELACLKAAAAELARLKARDDLLEELAAEGSAELKAE

SEQ ID NO: 211069 - protein, 61 aa, Triticum aestivum
  Clone ID: PAT_TA_105487.pep
MVTTGLVAVASLLLLLAGDASAATLALYNKCGETVWPGIQPGAGKEILARGGLQLLPNRAT

SEQ ID NO: 211070 - protein, 101 aa, Triticum aestivum
  Clone ID: PAT_TA_105488.pep
MKTLLILTILAMAITISTANMQVDPSGQVQWPQQQLVPQPQQPLSQQPQQAFPQPQQTFPHQPQQQVPQPQQPQQPFLQPQQAFPQQPQQPFLQTQQPQQP

SEQ ID NO: 211071 - protein, 46 aa, Triticum aestivum
  unsure (1)..(46): unsure at all Xaa locations
  Clone ID: PAT_TA_105489.pep
MASTNMASAXQIMLAAGIPSGTNGGVSSRVNFVPSNPLGLKLVGRA

SEQ ID NO: 211072 - protein, 66 aa, Triticum aestivum
  unsure (1)..(66): unsure at all Xaa locations
  Clone ID: PAT_TA_105490.pep
LSPHVRTGDXAAAPSPAASATATATAVSAASFSGEFELLFGMNQSGGVSSTPGEKITVVVSPWRPT

SEQ ID NO: 211073 - protein, 137 aa, Triticum aestivum
  unsure (1)..(137): unsure at all Xaa locations
  Clone ID: PAT_TA_105491.pep
MARTKQTARKSTGGKAPRKQLATKAARKSAPATGGVKKPHRFRPGTVALREIRKYQKSTELLIRKLPFQRLVREIAQDFKTDLRFQSSAVSALQXEXAEAYLVGLFXDTNLCAIHAKRVTIMPKDIQLARRIRGERA

SEQ ID NO: 211074 - protein, 98 aa, Triticum aestivum
  Clone ID: PAT_TA_105492.pep
CCASSVELRPWHAIPIAVVTPMARAGSAIRTAGPLLGGRPSLIAGNSSGRCRVCTECHAVSDVAEHSHTARALGLRPLFGAPSGSTCAVGGSGATAPR

SEQ ID NO: 211075 - protein, 175 aa, Triticum aestivum
  Clone ID: PAT_TA_105493.pep
KLLGMVTSRDIDFLEGKQNHNIKLENVMTKREDLVVASAGVTLTEANDIIEKSKKGKLPIVNDSDELVALIARTDLKKARSYPDASKDDNKQLLVGAAIGTRENDKERLRLLAAAGVDVVVLDSSQGNSTYQIDMIRYIKQTYPELQVVGGNVVTAAQAKNLIDAGVDGLRVGMG

SEQ ID NO: 211076 - protein, 130 aa, Triticum aestivum
  Clone ID: PAT_TA_105494.pep
YTTCSQGYGQCQQQPQPQPQPQPQMNTCAAFLQQCSQTPHVQTQMWQASGCQLVRQQCCQPLAQISEQARCQAVCSVAQIIMRQQQGQSFGQPQQQVPVEIMRMVLQTLPLMCRMNIPQYCTTTPCSTIT

SEQ ID NO: 211077 - protein, 66 aa, Triticum aestivum
  Clone ID: PAT_TA_105495.pep
PPASTAIAATHPARRARPRHQAHDTKCWNRSPLATSPLTRTEVEEEEQWTQDFWPATNAATGVQTP

SEQ ID NO: 211078 - protein, 120 aa, Triticum aestivum
  Clone ID: PAT_TA_105496.pep
VNILAVNSSGSTSAVLSFVCDYLDAVQLIVEIWWFIQLDDSHAFGPTSLDILLEKLDTSVRRMKCCYAGLHRELEVQVLEFALLAILCRLSEFGTCSKLVLDKLHWIINHIDGLCADGSY

SEQ ID NO: 211079 - protein, 131 aa, Triticum aestivum
  Clone ID: PAT_TA_105497.pep
SCGSFCKGALHGQTLRGLALRLANHGELTRLSGLVANLITAGHGCEAAFAAAVLGDNALMEKAWQDTGMLAEAVLHAQAHGRPSLRSSVITWNKMLQKELDHMPTVKTDAAAAFLASLEDPKLTSLGETEK

SEQ ID NO: 211080 - protein, 67 aa, Triticum aestivum
  Clone ID: PAT_TA_105498.pep
KFQFSFLCSIQRTHSLHWGIKLSTTYLCVSTYACDASCCQRPTLSSIIVMLKMPIGYSAYSHLISHI

SEQ ID NO: 211081 - protein, 51 aa, Triticum aestivum
  Clone ID: PAT_TA_105499.pep
ASLPFSTMNVFSQKRKKTSPHLQRITSLYKEDHRYIKKRSIHDQVGKYCKL

SEQ ID NO: 211082 - protein, 100 aa, Triticum aestivum
  unsure (1)..(100): unsure at all Xaa locations
  Clone ID: PAT_TA_105500.pep
FPPPLPSPPSELPSSSGGRPPFHLLSSVRPPHAPAVCATPAAARPPLHVSRRCPPPPXGGAASSTSATACRCTAGSLPAASASAWDWTRWSWHFAEVDQA

SEQ ID NO: 211083 - protein, 128 aa, Triticum aestivum
  Clone ID: PAT_TA_105501.pep
AALRFSGPVGGGEMLAPLMEGPDPESGDGVGAGARREGWGRWVRGQLARTPSSVAAAAAGAGAARNDRRLLLGVMGAPLAPVHVCAAEPLPHLSIKDTPIETSSAQYILQQYLAASGGHKLLASVRNS

SEQ ID NO: 211084 - protein, 161 aa, Triticum aestivum
  Clone ID: PAT_TA_105502.pep
MKTFLILALLAIVATTATSAVRVPVPQLQPQNPSQQQPQEQVPLMQQQQQFPGQQEQFPPQQPYPHQQPFPSQQPYPQPQPFPPQLPYPQTQPFPPQQPYPQPQPQYPQPQQPISQQQAQQQQQQQQILQQILQQQLIPCRDVVLQQHNIAHASSQVLQQS

SEQ ID NO: 211085 - protein, 122 aa, Triticum aestivum
  Clone ID: PAT_TA_105503.pep
IISYPTTTHRVTFWDGQCVCRGNSGHGVRLYNSSMDRRITSGCLWWISSSTPAGGPSIFFPSLSTRWALGYPVGRRGEGQRTGSGGGRMCDGDGIFRLRSSGRWRKQSHGRARACIGSGPAA

SEQ ID NO: 211086 - protein, 54 aa, Triticum aestivum
  Clone ID: PAT_TA_105504.pep
LVSQNAFLCNRKCLLVQHKFFTNLLRTKFFRVVCVLPTKEKVCYVRGEPCGNCL

SEQ ID NO: 211087 - protein, 119 aa, Triticum aestivum
  Clone ID: PAT_TA_105505.pep
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTD

SEQ ID NO: 211088 - protein, 125 aa, Triticum aestivum
  Clone ID: PAT_TA_105506.pep
MAPTHTQHVQARPRLLRPQAGLPPRAQPMKTAAAAPAAVKLYRGVRQRHGCKWVAEIRLPRNQTRLWLGTFDTAEEAAHAYDQAACRLHGDAARLNFPDKAASSRPPLNAAVDAKLQVISRTIAA

SEQ ID NO: 211089 - protein, 149 aa, Triticum aestivum
  Clone ID: PAT_TA_105507.pep
GREDKATWKANYFTKIVQLLDDYPKCFIVGADNVGSKQMQQIRMSLRGTAVVLMGKNTMMRKAIRGHLERNPALEKLLAHIKGNVGFVFTRGDLVDVRDKLLENKVKAPARAGAIAPCPVIIPAQNTGLGPEKTSFFQALSIPTKISKG

SEQ ID NO: 211090 - protein, 101 aa, Triticum aestivum
  unsure (1)..(101): unsure at all Xaa locations
  Clone ID: PAT_TA_105508.pep
GAGSVFXSHTHHRXGPARFRSLDFGERNGYLKGVVTDVIHDPGRGAPLAKVTFRHPFRYKHQKELFVAAEGMYTGQFVYCGRRATLSVGNVLPLRYVPEGG

SEQ ID NO: 211091 - protein, 121 aa, Triticum aestivum; identical to SEQ ID NO: 167940
  Clone ID: PAT_TA_105509.pep

SEQ ID NO: 211092 - protein, 144 aa, Triticum aestivum
  unsure (1)..(144): unsure at all Xaa locations
  Clone ID: PAT_TA_105510.pep
MANSNLPRRIIKXPGISASPSEENMRYFNVMILGPTQAPYEGGVFKLELFLPEEYPMAPPKVRFLTKIYHPNIDKLGRICLDILKDKWSPALQIRTVLLSIQALLSAPNPDDPLADNVAKHWKANETEAVETAKEWTRVYANDA

SEQ ID NO: 211093 - protein, 62 aa, Triticum aestivum
  Clone ID: PAT_TA_105511.pep
TVEHPIDADLLMGVFDGGPLETRTMSRVGCLDYTATPWEETKPGVLERHASYKFNRYMSIFG

SEQ ID NO: 211094 - protein, 88 aa, Triticum aestivum
  unsure (1)..(88): unsure at all Xaa locations
  Clone ID: PAT_TA_105512.pep
VLVACGWRHSVSVSSSGGLYTYGWSKYGQLGHGDFEDHLVPRKIEAVXDVSISQIAGGWRHTMAVXSDGKLYGWGWNKFGQVGVGDDV

SEQ ID NO: 211095 - protein, 181 aa, Triticum aestivum
  Clone ID: PAT_TA_105513.pep
AAFVAPVHSSSSHAEPERMESSRSLRHLAEYDDFFFGWLDDSARHSPPSLDHLVHGVGHSFQISTSSSFIDLYPRDDLFSIDLTTAASDFDFDLPVVDDAAPSPMMPQISASRLLPCEPGGGSGAQEDGDESVSVITSRYHHSADAPSAPWLSAFSSPVSHSARSTLVSLSACSIATSKHA

SEQ ID NO: 211096 - protein, 94 aa, Triticum aestivum
  Clone ID: PAT_TA_105514.pep
MNALLPMQATTFALVLDGNDLVGRARTGQGKTLAFVLPILESLVNGPHKATRMTDYGRPPSVLALLPTTELANHVHANFEFYGGTFGLSTCCAY

SEQ ID NO: 211097 - protein, 181 aa, Triticum aestivum
  Clone ID: PAT_TA_105515.pep
TTPQPFPQLQQPQQPFPQPQQQLPQPQQPQQSFPQQQRSFIQPSLQQQLNPCKNILLQQCKPASLVSSLWSIIWPQSDCQVMRQQCCQQLAQIPQQLQCAAIHSVVHSIIMQQQQQQQQQQGMHIFLPLSQQQQVGQGSLVQGQGIIQPQQPAQLEAIRSLVLQTLPSMCNVYVPPECSIM

SEQ ID NO: 211098 - protein, 208 aa, Triticum aestivum
  Clone ID: PAT_TA_105516.pep
LPQQPPFSQQQQPVLPPQQSPFPQQQQQHQQLVQQQIPVVQPSILQQLNPCKVFLQQQCSPVAMPQRLARSQMLQQSSCHVMQQQCCQQLPQIPQQSRYEAIRAIIYSIILQEQQQVQGSIQSQQQQPQQLGQCVSQPQQQSQQQLGQQPQQQQLAQGTFLQPHQIAQLEVMTSIALRILPTMCSVNVPLYRTTTSVPFGVGTGVGAY

SEQ ID NO: 211099 - protein, 100 aa, Triticum aestivum
  Clone ID: PAT_TA_105517.pep
QSLRMAITIGTANIQVDPSGQVQWLQQRLVPQLQQPLSQQPQQTFPQPQQTFPHQPQQQVPQPQQPQQPFLQPQQPFPQQPQQPFPQTQQPLQRCPQQPQ

SEQ ID NO: 211100 - protein, 116 aa, Triticum aestivum
  Clone ID: PAT_TA_105518.pep
PHPPSPLPTKRLSSAPEAKSETAAPLLEEGENGATEDEARGAQEGAEGYVESVGAGDPAGPPAHHLAVRAGLGDPVFFLLTFVAVTTSVAFISMVAVAIPTMLAMRRAANSFALLA

SEQ ID NO: 211101 - protein, 183 aa, Triticum aestivum
  Clone ID: PAT_TA_105519.pep
MKIAWVSLRRNTSLRISLRSVSQCCSGPKSMSTQSSKGHMDPPLYLSSIDAEPLHRYRQGGYHPIILGEFLHSGRYKVLHKLGWGGYSTVWLARDQRDEVYVAIKIGVAEAYDKVIRELQVMKRLVTCYPRPKHMVLMLDHFHLKGPNGRHNCLVFELLGPNIPDIIGAHFPHGRLPGKLAKV

SEQ ID NO: 211102 - protein, 158 aa, Triticum aestivum
  unsure (1)..(158): unsure at all Xaa locations
  Clone ID: PAT_TA_105520.pep
MKTLLILTIIAVALTTTTANIQVDPSGQVQWPQQQQPFPQPQQPFSQQPQQMGGPXPQQTFPHQPQQAFAQPQQTFPHQPQQQFPQPQQPQQPFPQQPQQQFPQPQQPQQPFPQQPQQQFPQPQQPQQPFPQPQQPQLPFPQQPQQPFPQPQQPQQTI

SEQ ID NO: 211103 - protein, 111 aa, Triticum aestivum
  Clone ID: PAT_TA_105521.pep
EELLQLRKEGRRNEYERHKLQALTQRQKLVLQRKTEEAAMATKRLKEILEARKSSGRDNSAGMNGTSPGSHMSEKSLQKWLDQELEVMVHVHEVRNEYEKQSQLRALLGEE

SEQ ID NO: 211104 - protein, 52 aa, Triticum aestivum
  unsure (1)..(52): unsure at all Xaa locations
  Clone ID: PAT_TA_105522.pep
PPPPPPPPPIHAVAGRXRAPPRRAVPXPPPPPPLPRFASSLSAPSPARRRGS

SEQ ID NO: 211105 - protein, 210 aa, Triticum aestivum
  unsure (1)..(210): unsure at all Xaa locations
  Clone ID: PAT_TA_105523.pep
EVDAHVKSLXKTLCKRKAKTAKEAEALIMKWVQQLINKAVDNLERYIKGTSQDSRGCSYNTGVTGKLKGRKEASTSKEMSEAVIAVFTVGSVILACPDASVQGIIPLLHTVITSGNPEPRPTMLAGGAVSFNEVAPSLYIQSWDTMAKICLVDDKLAKRYIPLFVQELERSDLATLRNNIMIAMADFYVRYTALVDCYMSKITKVLRDPC

SEQ ID NO: 211106 - protein, 128 aa, Triticum aestivum
  Clone ID: PAT_TA_105524.pep
DWDRRFSLPHITDVFDLEPRLTTFSLKKNRTPRGASDASSPDKWNGYVNKDDRALLKVSDYASNTSAGAECIDPDCSWVEHWVHRAGPRKEIYYEPEEVKAAIVTCGGLCPGLNDVIRQIVFTLEIYG

SEQ ID NO: 211107 - protein, 129 aa, Triticum aestivum
  Clone ID: PAT_TA_105525.pep
PSPKPVERAVSMPPSQKPVERAVSMPPSPKPVDRVVSMPPSQKPTGHVVSVPPAPKPGERVVSMPPSQKPAGQVVSMPPPAPKPVERVVSMPPPAPKPVERVVSMPSSQKPAGQVVSMPPPTPKPVKRV

SEQ ID NO: 211108 - protein, 87 aa, Triticum aestivum
  unsure (1)..(87): unsure at all Xaa locations
  Clone ID: PAT_TA_105526.pep
LQRRAVMAVFKYNFXLSRIIPFLYNGWFVRQLNADDCAAYALQLPLFINCVLFLSREGWRRACLRNNSGRRSGDISPSELLHEHNHM

SEQ ID NO: 211109 - protein, 65 aa, Triticum aestivum
  Clone ID: PAT_TA_105527.pep
CFNFFCQSGIYRHTLVCLFTHFSPYVVHIEIPRTSYIYEQREYNIAITKSHIYITSSACLRSHFC

SEQ ID NO: 211110 - protein, 124 aa, Triticum aestivum
  unsure (1)..(124): unsure at all Xaa locations
  Clone ID: PAT_TA_105528.pep
GAFKKRAISAGNKFRRSLKRKSKKKSGDLASIEDIRDVQELETVERFRRCLLDGGLLPXRGDDYHTMLRCLKARKFDIEKAKHMWSEMLXWRNAYGVDNIEEFDYTELNEVKKYYPQFYHGVDK

SEQ ID NO: 211111 - protein, 130 aa, Triticum aestivum
  unsure (1)..(130): unsure at all Xaa locations
  Clone ID: PAT_TA_105529.pep
AAYANRGCPLTGELHEHDKAWYAAAGKRLLLHTEGDFRFLDKAAIREREACTVTEVEEVKLIAGMIVVWLVXTLVPCTIWAQVNTLFVKQGTTLDRSVGGVRIPAASLGSFVTISMLISIPIYNRVLVPL

SEQ ID NO: 211112 - protein, 78 aa, Triticum aestivum
  Clone ID: PAT_TA_105530.pep
SPILISSCSSCTLLPCSSKANRDGRSALIRFSRQGPRAHSYLSSPRPHVLDHYHPRYCSCCTAPIQTESTNRRSYRET

SEQ ID NO: 211113 - protein, 135 aa, Triticum aestivum
  Clone ID: PAT_TA_105531.pep
VAVKVRHPGVGDSIRRDFSIINAVAKASRYILDESVQQFAVFMMSQVDLAREAAHLSRFIYNFRRWKDVSFSKPLYPFVHPAVLVETYELGESGSHYVDDHDGEERVKSALAHIGTHALLKMLLLAESSLQQRIN

SEQ ID NO: 211114 - protein, 96 aa, Triticum aestivum
  Clone ID: PAT_TA_105532.pep
PLTTDDIKAVIVDIFIASSETSATALQWAMAELMRNPRVMRKAQEEVRRALDGRDRVTEESLAGLRYLDLVIKEVLRLHPPAPMLLPRECRAPCRV

SEQ ID NO: 211115 - protein, 107 aa, Triticum aestivum
  Clone ID: PAT_TA_105533.pep
RWQRWKHRKHVPHAQQKLVKSPFQFASDSPRSTGDNFDALLHEIQQRTNLKPASRLADWAETARGRHRPRVEVEAEASAGLRSGADRRERRAGVGDEAPNLAVHRGG

SEQ ID NO: 211116 - protein, 135 aa, Triticum aestivum
  Clone ID: PAT_TA_105534.pep
PHAINGSGDRRHGDKAVQLRGCRFPFHSPHTVNGPGSGDRRHHGDAVWFRGVQCRRGASHLFFAVEAYRRGRRAHCRGGRLATVVGGGGQNPPHLLDPSLPRHPGSPERARRSPNYFQWMSMSCPLRGMLDLGLW

SEQ ID NO: 211117 - protein, 106 aa, Triticum aestivum
  Clone ID: PAT_TA_105535.pep
GHVLPHASCMDCLHHHCFIRIILLAGCLSVVLVHVLPCPNPFLQRRRNKFSTGISPNTCPRGDHRGADGTCAADVREVWTGGTGQAAWRPVVALEVREGLAGGRGG

SEQ ID NO: 211118 - protein, 46 aa, Triticum aestivum
  Clone ID: PAT_TA_105536.pep
RANTGTELYAGVDGGACRRAEPDAGGGRRRVETGGAGQRPAAGDCW

SEQ ID NO: 211119 - protein, 111 aa, Triticum aestivum
  unsure (1)..(111): unsure at all Xaa locations
  Clone ID: PAT_TA_105537.pep
PGPPFLDNAASSVATSLRRCANDKLPVSDNRDTTVSRWRKHCPTPIENDNIFEIETHCKDPXLCSTLACDIYKHLREAEAKKRPSPDFLETTQKDIDTSMRAVLIDWLVEV

SEQ ID NO: 211120 - protein, 45 aa, Triticum aestivum
  Clone ID: PAT_TA_105538.pep
RSGSRQEVRKWGSGCKLGLRRQFLFSIIWFYYDSHIFIFVNSTSS

SEQ ID NO: 211121 - protein, 132 aa, Triticum aestivum
  unsure (1)..(132): unsure at all Xaa locations
  Clone ID: PAT_TA_105539.pep
TKSDLPXWLPQLPTLGNPPPPRSAIGHHIRSTEQRCCGADRRAGPVRWRNSLPPPLFLFFPLPSPHALHEPPQQPCLVDVDLVILDEVAGLEEVATLAKKQGGAPLPLAAPCSVSGRRPRHLLPCPLLYNHH

SEQ ID NO: 211122 - protein, 78 aa, Triticum aestivum
  Clone ID: PAT_TA_105540.pep
AYGGGRNHPPQPPYYHGGGRGGYPSPQFGRGVGAGGYSCYGGGGGGYPPSSFPSEEEAAAVMVGSATLTEGRRRRSRG

SEQ ID NO: 211123 - protein, 156 aa, Triticum aestivum
  Clone ID: PAT_TA_105541.pep
RLLASLAAASASTALLFPSTSSSKPRLPLSTSLGFSAPARSRRATAVAGSSGRRPGLLVVRAARGKFERNKPHVNIGTIGHVDHGKTTLTAALTMVLASVGGSAPKKYDEIDAAPEERARGITINTATVEYETETRHYAHVDCPGHADYVKNMITG

SEQ ID NO: 211124 - protein, 188 aa, Triticum aestivum
  Clone ID: PAT_TA_105542.pep
VIHFTRLPSTVAQLQKLVRLFVSNETQLRTSGFRSLQALEELRVHETDDPVRFAEEVNELGKCNLRYLYTDAEIAERLFCNPCLQVLKIWPQIGMVPKGMASLKNLVKLSIMVQKFDNEGLQVLMGMPSMAHLQLCVTGVIEEKLTMGSNGFKLLKVLQFKYTSVLHPAFLLEPTNGLRLIFEPDAVP

SEQ ID NO: 211125 - protein, 76 aa, Triticum aestivum
  Clone ID: PAT_TA_105543.pep
RTQPKGDGCAYQYAADWGGGWQQQRLWLVRRDGEPIWRLLGVRTTDMRHWLRGRAMRGGGDGGCSTGVAAGVVLDA

SEQ ID NO: 211126 - protein, 49 aa, Triticum aestivum
  Clone ID: PAT_TA_105544.pep
FFCHLNMNTRFAVRQYSFYALVDFVFASFCSVVINFAVFTLKFAKCSFN

SEQ ID NO: 211127 - protein, 142 aa, Triticum aestivum
  Clone ID: PAT_TA_105545.pep
LCLPSRARRRLPSPIRGRRSPLALEGSPSLLANPLVLVLIFARSIHRSAFTSAVPRRLFLLRLLLFVCLFFFFCSNHGCRLPLDLFRQEPRRRAAAAAPGGRIPPLHAAAEHAQPVGQVLRGQVHPGSVGDGHGRGLLPAHG

SEQ ID NO: 211128 - protein, 63 aa, Triticum aestivum
  Clone ID: PAT_TA_105546.pep
QRRQRGQPEPAGARGLPEVARDRRGDGARGWGGAGTGTMEIYASVSVRLTTTTTCALSELGGC

SEQ ID NO: 211129 - protein, 80 aa, Triticum aestivum
  unsure (1)..(80): unsure at all Xaa locations
  Clone ID: PAT_TA_105547.pep
VDQDPSSLDSIWCNXSVKESSHNPFVSNSQYIMQIKSILDVDFKSFVLSLLVLFMLVRKQFMLPSGCMTHFGCMHVMSIK

SEQ ID NO: 211130 - protein, 148 aa, Triticum aestivum
  unsure (1)..(148): unsure at all Xaa locations
  Clone ID: PAT_TA_105548.pep
MAAFCRAAGSMSGAMTSLLHRSSMTLGLLLRGYGLRRRRGAAAQVFGHAASVAMAFLWLEFSXSFQELDIXASTXAHAVTFRFRFXLNNAGLPVARAARSGSAPVALACQLXWLLGCNLVCHAGVVWMHFGGAAAGRRSGIGAWVFST

SEQ ID NO: 211131 - protein, 108 aa, Triticum aestivum
  unsure (1)..(108): unsure at all Xaa locations
  Clone ID: PAT_TA_105549.pep
MPALAKPAARPAKPAAAAPKPKPAAAKPKXAAAGAAHPTYFEMIKEAIAALKDRTGSSSVAIAKYIEEKHGKALPPNFKKMLSVQLRASAAKGKLVKVKASYKLSDAA

SEQ ID NO: 211132 - protein, 131 aa, Triticum aestivum
  unsure (1)..(131): unsure at all Xaa locations
  Clone ID: PAT_TA_105550.pep
VQVVKSCFVTPAADTPRKTLWLSALDLMLANKGYTPLVHFYRRCPGTETTDLFNGTKLKTALGMALVGFYXASHLRVDADGRLKIGCNSKGMXFLLARSQLTIDDFSNLKPSPRLRRLFVPQILPAEVCAT

SEQ ID NO: 211133 - protein, 48 aa, Triticum aestivum
  Clone ID: PAT_TA_105551.pep
AGLKSVDGAHEDSIWAAAWVPAVDHRPTALLLTGSIDETVRAWQPDDL

SEQ ID NO: 211134 - protein, 121 aa, Triticum aestivum
  Clone ID: PAT_TA_105552.pep
LSMVCQARISTPNAQLGLTELQFGVIPGFGGTQRLPRLVGLTKALEMMMLSKPINAEEAHELGLVDAVVSPNDLLNDARRWALDICESKRPWVRALYKTDKLESPEVAREILNSARVLSRK

SEQ ID NO: 211135 - protein, 70 aa, Triticum aestivum
  Clone ID: PAT_TA_105553.pep
MAALLHVAALQPPHPTPKTHHPWTHSRATTSILSAPEAAPSKRRRAPARRLHAAGNGSGVGTPATDSTSN

SEQ ID NO: 211136 - protein, 57 aa, Triticum aestivum
  Clone ID: PAT_TA_105554.pep
MADEGTANCIDIILAIILPPLGVFFKFACGIEFWICLLLTFFGYLPGIIYAVWVITK

SEQ ID NO: 211137 - protein, 89 aa, Triticum aestivum
  Clone ID: PAT_TA_105555.pep
MPALRLPLEIKIQEPSPSMDDAGGDILPSLGRVRLGDLAAVEGLASDSDKICVSTLMQSLAQYSAAIIQLPPADAALLRSGLDSARLFF

SEQ ID NO: 211138 - protein, 73 aa, Triticum aestivum
  Clone ID: PAT_TA_105556.pep
LHMIFFLQGNHGIHIFLGLSLILCMLFPLKFQYLGFRAALIDFNWFVLYIIINHVIILCASRTFHVFSILFLL

SEQ ID NO: 211139 - protein, 82 aa, Triticum aestivum
  Clone ID: PAT_TA_105557.pep
YTVALFLAVALVAGPAVSYAAYAPGAPATPAAPGTQPKATTPEQKLMEDINNGFKAAVAAAAGVGAADKYKTFEATFSAASN

SEQ ID NO: 211140 - protein, 127 aa, Triticum aestivum
  Clone ID: PAT_TA_105558.pep
YVCRCGSIHTSTERPQICHCLHAHGSLDQSSESLSSSILMTLTCTCKSSMWLAASWNSSPSPHGSWQQGTSLLSSLTCFTSTLESSRKRFSPASLLLLLPFILFSAQLNPSRGRPSTTARREKRPKK

SEQ ID NO: 211141 - protein, 78 aa, Triticum aestivum
  Clone ID: PAT_TA_105559.pep
RCCMAYSFECIGRTPKLFQWTQKSCHLPKYRGGWRWWVPYFHVGRVQCISFWWSIIARLIEIPTIINNSIIYANYKLL

SEQ ID NO: 211142 - protein, 64 aa, Triticum aestivum
  Clone ID: PAT_TA_105560.pep
AVVDRGPHRHDLELWHLGLLTFASLAQQFGFFLRAAQFMFLVDFGHASRGNFEDMHLSPRRVAR

SEQ ID NO: 211143 - protein, 91 aa, Triticum aestivum
  Clone ID: PAT_TA_105561.pep
TPLSSECYPLMSDPESQSACSRKVDNLFKDGMEVLDSTSEVSPREEIVESYPVGSETISNSGDELKLIHTSNTSTDCSTERSSQNLSAQDT

SEQ ID NO: 211144 - protein, 72 aa, Triticum aestivum
  Clone ID: PAT_TA_105562.pep
KGLAWLEFSHRNRFGSHQMILTNVNHAVQLLLASVQYNLETLFWVAVAEAEDCLNHPHLLANSIRCFQWIDQ

SEQ ID NO: 211145 - protein, 65 aa, Triticum aestivum
  Clone ID: PAT_TA_105563.pep
PCQRPPPLHLLLCHRRPAHPTASCSPLTMDPPWTEGVKRGRKSSASQAALADEHTRMSSSWASQL

SEQ ID NO: 211146 - protein, 113 aa, Triticum aestivum
  Clone ID: PAT_TA_105564.pep
SFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLS

SEQ ID NO: 211147 - protein, 87 aa, Triticum aestivum
  unsure (1)..(87): unsure at all Xaa locations
  Clone ID: PAT_TA_105565.pep
WASIPCDESAGVQKVVMMQSCSTLHRWKXTAVASPQRASTHGLSGGDRPLRFKGAQLHDHPIDGGGEQQARVVELEDLPSPRACSHR

SEQ ID NO: 211148 - protein, 61 aa, Triticum aestivum
  Clone ID: PAT_TA_105566.pep
MTWFQFGIFRVTRLNQIPIPLNPPRCPLIRLHRRFSGRRRHSVPAVWVVCGGRATIAMRPA

SEQ ID NO: 211149 - protein, 148 aa, Triticum aestivum
  Clone ID: PAT_TA_105567.pep
HGNAVSLLRPNATSGNQNNMLILQETCTDASGSLVVYAPVDVQSMHVVMGGGDSAYVSLLPSGFAILPDGHTAPAAATDPSPQGSSPNAHGGSSNNSPGSLVTVAFQILVNNLPTAKLTVESVDTVSNLLSCTIQKIKSALQASIISP

SEQ ID NO: 211150 - protein, 67 aa, Triticum aestivum
  Clone ID: PAT_TA_105568.pep
MSNGSPPTSSSPSVCSRSWSISEDSLRRYVSYASESCIQELLAASDSGGAGRGGEGSGGGGEEDDGW

SEQ ID NO: 211151 - protein, 81 aa, Triticum aestivum
  Clone ID: PAT_TA_105569.pep
KTHTSNQPEPNQAQIVCPVLLISLPLPCVEPSIRASTAAMNLSGNGFLYMSLYFCISAADAAPGGAPSCQISLCLRRTIFT

SEQ ID NO: 211152 - protein, 43 aa, Triticum aestivum
  Clone ID: PAT_TA_105570.pep
PNPADQKWLKGAWLWSAIDRTLKRAPRVASSSPTRTKHPVPRE

SEQ ID NO: 211153 - protein, 55 aa, Triticum aestivum
  Clone ID: PAT_TA_105571.pep
VFKGKLPVTIQGTYSDSNSTPMIVNVLRTLPPTYDNLWSSMPPPKTNVGKIHPLQ

SEQ ID NO: 211154 - protein, 81 aa, Triticum aestivum
  Clone ID: PAT_TA_105572.pep
MSSFPVLKNRPIDQWKVTGGKDELRKRRLPVKGLKEELVRRLFESIQSEEASDESAEDVGANEGTPIGKDAKDVGANGPAD

SEQ ID NO: 211155 - protein, 91 aa, Triticum aestivum
  Clone ID: PAT_TA_105573.pep
VRQQEEDGPCGDHGVVQGVVEEDDEGGVELVSADNHDSLRRRGQRVLGHGLTHRRHRQQMWHLAVHGGSELLLRGVHVDPSYLGRHRQQGT

SEQ ID NO: 211156 - protein, 35 aa, Triticum aestivum
  Clone ID: PAT_TA_105574.pep
LMRDFKRLMQDPPAGISGAPQDNNIMLWNAVIFGP

SEQ ID NO: 211157 - protein, 117 aa, Triticum aestivum
  Clone ID: PAT_TA_105575.pep
RTGCSESSVLMLLAEIQKQEGLGEIQNNTKKASVYSVQKDTMNWSPPTAAPFADGVLAGVVEAWGKGIRRLLAGAGSPEHPVLAVARQSRAEQLGRGGRVRGRLAAAAELLHSAAEG

SEQ ID NO: 211158 - protein, 51 aa, Triticum aestivum
  Clone ID: PAT_TA_105576.pep
PKFSSHEKADKPRASKLATASGRCWPWFQDPGEAIDGTYIDKKCPFTGTVA

SEQ ID NO: 211159 - protein, 126 aa, Triticum aestivum
  Clone ID: PAT_TA_105577.pep
LCLTTLYLGIFNKPHHVLPRIADFDPDSLRKMLTMALDPVKGATSYSHANLRDASTVCYMRSKVQVSAASSSTSKRVHRCAKTPVAVSMVNTTTPVHVYTSHACNDSAAHSNKAAPGPLKFAHYLR

SEQ ID NO: 211160 - protein, 109 aa, Triticum aestivum
  unsure (1)..(109): unsure at all Xaa locations
  Clone ID: PAT_TA_105578.pep
FYPLPGRRTVSRRCSGGDGRRGFPAARGFGAASXGKRPLTRPPRPRASCRRPRAPPPLRARASARGTGAPPRPRPSPAAGRKEEREEAGRGGRGREGEEEEVGCCARPV

SEQ ID NO: 211161 - protein, 122 aa, Triticum aestivum
  Clone ID: PAT_TA_105579.pep
KPVMSSPKNISRAFLNKTSEPQLQPRVLVVVDLKLHITQSQDKLSHSVANYPLHFQISNLGSVDLLEGQRDWCSSCGSCAECGLIADTCQGCSIDPTHSIRSAKTKPPKFSPGSEYSLPRIE

SEQ ID NO: 211162 - protein, 146 aa, Triticum aestivum
  unsure (1)..(146): unsure at all Xaa locations
  Clone ID: PAT_TA_105580.pep
KLIWREKRYLLLIDDIWSAQTWENIRKCLPHNDKKGSRVIVTTRFQAVGSAACSRRAEINFLHSVDFLSDEESKKLFDQSVSESNNNIGSEKELPPEDVWKICRGLPLAIVTMAGIVAXNPRKSIKDWKEACNSLFPELMPSLTLD

SEQ ID NO: 211163 - protein, 70 aa, Triticum aestivum
  Clone ID: PAT_TA_105581.pep
YHILEESESLPDLWFSCLIALSSCNVLLCKIFLALLVCCYLSPSFLANFLLPSAYICGVSQVKLLLYNDE

SEQ ID NO: 211164 - protein, 72 aa, Triticum aestivum
  Clone ID: PAT_TA_105582.pep
GSPSTRTGTPLPPPHAASPAIRRHCRAPPLCHPPILFPLPIRTNLLRRHLKPPQPPISCCQALPISPEHGLN
